United States Patent 6,812,339 (POLYMORPHISMS IN KNOWN GENES ASSOCIATED WITH HUMAN DISEASE, METHODS OF DETECTION AND USES THEREOF) - sequence listing, part 37

SEQ ID NO: 13765 - DNA, 128470 bp, Human
acgacggtgtgctctctctccatgaagcttcggggtgggtagacagtcctcctcttgaaggaacaggagggacgcaagggaagggaccaacttgtatctcatctgagagagatacactcctggaataagaggtctgcggttaagtgtgtttctctagaagttcagaaacagaggaagcatctgcgggctaagctgctgagggctaggtgagagctaactgacctaagttttgaaggatggatgggtgacaggttggagggggaagatggaaaagtcacatgggagaggaacagcatgggccaagtgtggaggaaccagtgagtgggctgggtttcagaaacaggccttggtctgcttttgagccctccctgaacttttccaccccaaccccacctcctgcctgtgtctgccatgcacctcccttcctgtgagtctgtggacagactttgcccctttgccctgtgtgtgcttgggagaaatctgctcagtttctgtggcagggatgtttctacgtgttcatcaaaccggctttgtttacttccgaaacactcatgaagaccacagctgccagagccccttgcatcctggtgggactgtgcgactacttctggcccatggatgtgggtggaagtgacgtgtgcttccccaggcctggctcctggaccccaccgacggcttctcacctgtaaccccaccagccttctacctggatacttcacggggagctagagtggccttggctaagaaggaggcatggcacccgcgggtaccgggccgccttcatcagtcggtgcactctggtccaccgcccacatgccttcatgtaatcttcactgtagggcccacagggaggggaacttcctcgaggtctagctttgcctttccgccttcagagccaagtaagaatgaggggtctgggctcggcccaccttccctgcaaggccctgtgcccgctcccctcaaagctggtcttgcatgttgctctggcggcctctgtagcaggagttcactctgttttccgtggaggaggagtggaaggagggattcaagctctcccctagagacgctagaaagacagttttgtctcagcctcatacgatcgcccagctccacatttctggctgtttctgtggttacctttcttcggggatgtttggggcgggaggtgggtgtgtgtgtatatttgctcttctgaagccgtttttccggagctcctggtgggggtgggggtgctctgtccctggttcctctcgaggcaggtgcaggggatggaggatgcccccctccccgagagccaggaggcgccgaccctgggcaggaggtgccagaccggcgcctctcccgcgtggagctcgaagaccacagatgcctggaagggaggagcaccttccgtggttaggtggggaaaccgaggcagaggcggcccaatggactcgcctaaacggcctggggagtcactgcaggtaaccagagctggagccaggcttcccactccaggcccggggctctcccccgaacaggcgtgggaaggggtgcgagctgcacgcggggctggggctgggggtgcggggctggggcaactcggctcttccccttcctaggccgcccgggccacttcctgcggcgtgggggcggggggcgcgggcgcagggctggcccctcccgggcgccgcctctcggcctcttctataccagcaggccagaggccaagggttaggggaacagaaccggtgcccggctccgcccctgtcccgaaagccactgggggctgggacccggcagggccaggtttgggccgcgagggccgaggagcagcgaggtgcaggggctgcgagggccgagccgggcgctgagggtccggcagggggcgtggagggggcggggcccggagggggcggggccgtaggaaacttgagcgcccgcctctggccgcgcgccccgccccggcccccgcctccgggtcccgcctccaggtcccgccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggtagggaaggggcgggctgcggtctgctggctgctgaagtgtgccccgggcgtgtgcacccggcgtgtgcaccggcgagcgctgcgatccggctctttgcgtgtgtgttgtgcgcgcgtgtgtgtgtccgggagtgcccgcgtttctctgcgcggtggagttgtgggtgactgcggacggtggtgtgtctttcgaatggcgtgtactcgtgggcatccatgtgtgccttaggtgtgcacattttggactgcgtttgtggaattgtgtgtcggggcgcagttgctggtggggagcggtgcctggcgggtgtcgtgtgtgagcagctgtgcgcagagcggggtggcggggtgggtgtgggtggtccagccccacgcccagagccccctgtccctgctggtcggcgcagtgcgtagcttaggagcctcgaggacagctgggacccgacggggcaagcgcgggcctcgcgggcaggctgggccagtccctcaggggaacaggtccgtgcggcccacgtgggtcgcctgtgagcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagtaggtactgtgttaattggattagcgtctcctgtttaaaatcctttttttttcccctttatcgtgggtggggccttacattttccccgggcgtgttttgtgcctctccctggccctaacttaaccgcgaagcactgagattcgagaaagtttagctgccagctgcgctgcctcctgcagcacctcccgggcggcgccgcctccgcgagtgcccgagagcgccgcgctgggcgccggccctgccccagcccccaggctcccgcgcaagcgtgggggtccctctcctggccgggaggcagcgactgcggagttgagaaccctttggttcaacaagttcctagtccgggaggatgcagctcagctcgtggagtccgagagtcacggcgtaaaattggcgcttcccgcacatgcagatctcgggctcccggggtgtcccggccgccaaaggccacccctttcctcctggctgaccccaattccaccagaggaggatgtttgccaggacgccgagtccagctgctggcctcggcattagacaacccccagccccagcccctgccatccctgctcccttgcagccagcctcatgccgggggtgccacatgggacacctcctcctagtcccacaccttaatttaaaacatttacttttgaaacctactagtcgtaaaattgaaccgcagtgaacgagcacccagctcttaccacgactcactctctggagagttctggcgcctcggcgctggctcggacgcagcaaggccagctctaggggtcgggtggctctcggccagagcgaaggatattctttcccttcatcgccttggtgtctttctctgggggaaaaaaatcgcctttaaccaagggagccaagatctcaccagtgcaggaggctctcaaaatggagcgccggcatggggttgggctgcggaggggacagcatgggcggccttttggtatggatgcgcttcccaactgtcaggggctacgtgatggtgttcccagagaggcgggctgctttgcgggcttttaggagccagggatagaaacctggtccggttcctttggtttccctcggccgagactgaagccctgcaatcctagccatggcaggccagggggatgcgatgaactcattttctcatttttcatcctgacttagtgacaggggcacacttagaatgcaccctgttttctgtttcatcaaatgattttatgtcctacaagaaaaaagggcttttggtgtgaatcctactctttcctcataatcaggttccataataatattaaaaaaaaaatcagtctggctttctcagctcagaagacagacccaaacccaggtttgtgttttgttttgtttttgtttttttctagttaaagccagccctttgtctcaagcaagccagtgttttggccttagatctatttctgtttcacttttgaaagtgcctgtaattactgagctcttgaggttttattggataatgtggcaaagggaaggcccgggggccctgcctctcccttgcggtgggatgtggtgccacggtggcacgttctagccttgcctgctccctctgcgtcccactttcatgctgtttttaaggtggaacataaatgtcaatgtgtgataacaatttgggagactttgtctttggaatccaataaatggaaggtcctttgatctgtggagaaaccagaacaagtcaaaaccccagaagaacagagatttgcccaaactccagccaatgacccatttatttccaacaagccctcctagagatagattctaagtgaaatacaagaacgtggacacactccgtcccctttctggccacagggctgtgcagaattagaagtgcagtctatggaaggacaaggactggacttcgcttggtgcaaacgccccagccaggcgccccatactcacctagcaccatttcaccctggagctgtttcctcctgttgaagcgctggtgctcacaccccctaccttcagggctctgcaagcacagttccaaggtctgcagcgcgggtacagtgcatgccctgctgagtgtgcgtcagagcagttgtctccctgtgacacttattctaagaccctttttgctactcataagtggtagagtaccacactcactcatgaaccagtgataatccagggtactaacgggggccccggagtttatttggcaccgaagattaagctacttggcagctgaatttttatctagattggggttaggtttgtattaaaattttgcattccagcaagccctaaaccgtgcttgttcattgtgggataatgcgttcaactgatgagttgccaggccaggattgatgggggattatgtgtattctgctagtttgtcagcacctgatgtcactgtgctggggggtgggggaggcatgtttggagttaggatgagcagacacttgtagattttaatcacactctactttggggctccctgctctcctatggtagcagggggtttctgtgtcgttcttatgtcctcatgtaaagctgcacatctgtgaatgtcaggtagctcttgtgcttttccccttagattgagtttctaatctgggaatgacagagggtggctgtatatggagacagcagcatgggcttaggggctcttttggtgccagttaccctacggaaaaaaggtttcttcaaatcactttctacaaagactaaaaaatggttggaatctagtggtgcagattgtaatatgacttcaggtaatcaatacggtttgacaggtggaacatttcttagatgctgatgagcagggcgcaagtctcaagatttttaaatcatctgaaaagcacagtaaatcctttaaagagccctaccttggccatgttgtttcaagtaaaattgaatttcagaggcaaagcttcacatcggaggcatgacgaactaaagaaatccttcccagagacctccactctcttcctgttgccaccctcctctgccagcagcagggcaggaaagatgacttcttggggctgtgtgcctttaccttaagaagcaagtgcaccctgaatgcttctaatcccgcagctgggttgtctgggtatttggatctttttggtgcttgaggtactacccaagttggcaggaagccaggagcctgggggtggaggtgtcttagccccacctgtggcatgagacaagaggtcttctccagcaagggatgggtctctgacccttggctaagaaaactcaggattgttaaatacgtactgcatggataaggttgctgtgaccctgaaaaaaggaagaaggcttttgggtggtgcgtggttctcctcttggaagtcttcccagatttcgcctcagtactctcttgccctagcttaaatctttccttgctctgtgtccccttaggcaagtgaggtctcctctcaggtaggcatgatattaagtgcatgtctagaggacagttccttctacctgcccaggtgcactggctgaactcacctatgcccacatctgtgcattggcaggtgatatagatatacacctgagctgtccccctgagctgcagacctaacactaggtgtgggctccgagctgttccacatcaaaacagagccgaggacacatctccctcactgaagctgtgtctcctacctattatggtcaacacgtctcatctactcatttgttaaagctagaaatctctggagagttttggagctctttctctgtcttcacttgaaatctctggagagttttggagctctttgtctgtcttcactttgccatctaattgggtcagccctctctgagggctcacacccactcttccggcacagcggagccttatctgcccttggcccagagaatgcttccagttccttcactccagccacaccggcagcacttcccagtttaaaacgcagatttcatcatcccactctcttctgcctccccaaccccaccaaaccttggtttgttctcttaacgcagtaagtgcttctgatacctactgtgtgccttggaccaagctggagtctgagaaggttgggcccaggcatcctccctacctgtgcagagtttaaggtcttgggctgggggttgtatgtggggtacctatcaaataagaccagggagcgtgaagtgctatggaggggagctcctaccccagtatagggggctccctggagaagcaccctctaagctgatacctgggagagttgggggtgcaggggaggggttggagttggggctggattgttcgatgcctttcttctgtctcacccagacttccttatctgctaaactcctactcatttttgttttaattaataccaagatagaatttatctctcataaagcatgcccattctaagtgtacagtttaatgattttcagtaaattaatagagttcatagccattaccacaatccagttttggaacatatccatcaccccagaaagatccctcttttgtacaaactccctgtccccgtcctcaagccgccagtcccccacagatttgctttctgtctctagatttgccttttctttctatgtttcttagtgtgttttcataggttcggcccaagagctgtttcatttgggccttcctagagtcttctagttagaatcaatttatcccccagcaccgacgaagtgagctgggtgcttggccatcccgctgctagatggcgagctcccttacctgcctctcctgcctgcacctggctcagcactggcacctacagaatacccaaggtgtgttggctggaccagctgaagttgtgttcctcacatttcttttgtataactcctgagtatctagcagagtgtggggatttaaaatacagcgcatgtattgatgtgtcaggtgatgtgagccctgctacatacataccttaacttgtttcatcaagaacttgtgaggcaaatggcaaatcaaaaacaaaaacaaacaaaacaaaacgaaacaaatctattttctaagccaggcacagtggctcttgtctgtagttccagctactagggggtgctgaggtgggaggattgcttgaaatcagggatttgagcctgggcaatattgtgagaccctgcttcttaacaaactttttttttttgagatagggtcttgctctgttgcccaggctggagtgcagtgatgtgatcccagctcactgcagccttgaactcctgggcccaagcaatccccctgccatagtctcctgagtagctaggactacaggtacacaccaccatgcctgctgatttttaaattttttgtggagacgaggtcttgctatgttgcccagactggtcttgagctcccgggctcaaataatcctccagccttggcctctcaaagtgctggaattataagtgtgaactactgtgcctcagcccaagccatttttctaaatgaaaaaactgaggaggcccagagcaaataagtagcccaagggcatcagcagaaagtagaaggatcaagaattaaacgaggtcactttctcttccgcccttgttttggtagtaatgatatgcccttttatggccttgcctgggctggtgttcagattttcctgtacgagtcttgtcatcccttcctaagccatggaagctccttctagggcatgagtgctgtgtgacacatgttcacacagtgttgccccagtacctacctagtccacaactgaacaggtagagatggttcaagcaatgtgtgtgtgtagagaggtctcctggtaaatagaaggggctgggggagggcgttgaatgcagtggtgctgtggccttgggtggcttggtgcatttctgatgcatttctcaccttggatcattttcactctttgaggaagagagcagaggatgagatgccatttgacagatgcacaaaccaagacacagaaattgtatacccattgtacgccaggtagatcacaaatgaccgttctctcccatggttgtagagaactctcatggtggacagaaaccatgaaagaaatcatggtggaaagaaccaagacattcttgaatcggagtattagaacctcatttgcaaaataccttggaaagatcagggacactggggtttgaattgtagtctttgctctgttgtttattggctggtgatggtctctgaatctgtttgctcaggtgcagaaaggggttttaggctgagctcagatattgacaggaactacaattcaaacccaggtctgcagatgtggcagactgggtttgaactgtagtctttgctctgtttactggctggtgatgttctctgagtctgtttggtcatgtgcagaaaggggttctaggcgcagctcagacgtagatggggacgcagatgtgagtacctaggtgagtctggctggtcacgtgtggaataagtggtggtggctgccattactctttaagcattcttggatctagtgcctcctctgccactgagtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgtcctagcctcatgccttctgagaagcatctgtcagggtccctgatgcacctacagagaccctgagcttggtggtgggggttgcacagagagagctgcaggttgttcctcaggcataacgaggcccggagctggtggtcccctccctctgtgagtgtgtgcagagcatggatcgggtctgggagtgttcgtgctggcaggccggaggaggactgctgggcacacttgcagaattgcggttctgtacagcagtgtgtatcgactgcagcgctctttttctctagcagcaaaatgctcagctctctgccttctttctgtgcatttaacagacgtttccagaaagcagaattgatgacagccccaactcctccctttcactcccatcttttctatttgctgccctgtaatcaatttttggagagaagtgagaacctctcaaaatcgatcacctatgttgaaaaaaaatcatttttaacatcatgcagttttccgtatttactgtgtgtggctggagacactcctggcagaatgagtgtgggatgtaggaggtccagaaaagcccccagcttcaggggctgagatagggccatgggtggcagaactggttgtccccccgccccccaatccctcagcagtggttgaggtgtgctttattagaaactcttcagtcatgcagtttggagcccgtgctggtgatgcagcctggatgcctggcaggggcttagcctccaggggtgggacatgagatgtggctgccgtggcttctctgtgtctttcttcccagcgagtaaaggtagacgcagggctctggcaggtgctaaggccctgcttgccttcatgctggaatgctggcaggtacaatttattcttatttcttaggaggtgctttcccctcttctttctgaagacatccagggataaagaattgctgcttttatgagcacatgttcttggtgatatgctgttaccttatctaaaaacaatacggcctggctgattattctcagagctcattgtaaggtgaaaggttatgcatttgagaattattttcacagtgtggatgggagtggggggagaagatgtagagcacaggtaaggaattccaggttttggggccagggatcgccaagcagtgtaaagggctcactgtggcctgtagctccttccccctgtggtttgtgctgggccagttgctggctccccaaaaccattatcaccattatcattatcactatcatatccatcacctcaccatcattatcactgacatcatcacttttctccatcaccatcatcatcatcatcactatcatccccatccccatcatcatcattaccatcatcattgctgtcgctatcatcatcatcattccattcatcaccattcatcatcactgtcatcatcaccatcatcatcactgtcatcaccatcaccaccaccatcatcaccatcgccatcatcactgttatcgtcaccattcatcatcactgtcatcatcatcgtcatcactatcatccccaccatcaccaccatcattatcaccattctccatcaccatcatcactatcatcctcaccatcatcaccattctccatcaccatcatcatcatcactatcatccccaccatcatcaccatcaccatcatcatcactgtcatcatcaacatccatcatcactgtcatcaccatcatcatcactatcattaccatcaccatcaccaccattatcactgtcatcatcacctttctccatcaccatcatcatcatcatcatatcatcatcatcatcatcatatcatcctcatccccatcatcatcaccatcaccaccgtcattgctgtcatcatcaccattcaccatcaatgtcgtcatcaccatcatcatcactatcatcattatcaccatcatcaccatcaccatcatcattactgtcatcatcaccattcaccgtcactatcatcactgtcattatcaccatcatcatcaccaccaccatcaccatcatcactgtcatccccatcctcatcatcatcaccatcactgtcatcatcatcaccatcaccaccattgccatcaccatcaccatcattatcactgtcatcatcacctttctccatcaccatcatcatcatcatcatcactatcatccccatccccatcatcatcaccatcaccaccatcattgctgtcatcaccattcaccatcactgtcatcatcaccatcatcgtcattatcatcattgtcaccatcgtcaccatcaccgtcatcatcaccattcatcatcactgtcatcactgtcattatcaccatcatcatcaccaccaccaccatcaccatcactatcatcgtcatcatcatcactgtcaccaccatcaccatcactgtcaccaacatcatggtgcttctcaacctttgggctgctttgggtcgtgcttgacatggcacattcctggtgagttagctgttctttgggggttttctactgttggtgtggtgattagggtagtcaggacaggatgagtataggcatagagaacccaagtggatgatggtggagtgtgattcttctgaaagggtcttcatgagaaccactgatctagaagattctgggagaatctcacgtattctttcaggcccaggagtaagccagtgttacctgctctgtggagctctcctttgtccctccagggaggacaaattctggctggagcctgaccttactgcttgtccatctctcccagggtggtaggccactttaggtaggaccctgtggatttctccttggtgacccccgcattctgggcacagagcctggaacacaatgtctgcccagatgtgtgactgaaccaccccccaattccttaactgtaggatggcggctgccttcattagaatcttaacaccttgcctgagggctggctttgcaggtctgagtggctaggtcagggcactgctagtgttttctatgtttgtagtcaattggtgagagtttgttttacgcatttgttaaaactgtgggacagtggtctggaagccaacaaggctttagggttggcagagtgactcccatcccatcattgatgtctggctttgacttggcatgggagacattgcctctccagatctcagttctctcgtttgacaaatggggcttagggttgaacagcctctaaatcctctgtcagctctgcaattcaggaaagatgtttaaaaatgcatacttgcattgtaggtacatccaacatagagcaaagagagaattttcctagctaaattgactgcaaaaaaatgaaacctcttgggccgggcgtggtggctcatgcctgtaatcccagcactttgggaggctgaggcgggcaaattacgaagtcaggagttcaagaccagcctggccaacatggtgaaaccccatctctactaaaagtataaaaattagctgggcttggtggcgggcgcctgtaatcccagctactcgggaggctgaggcaggagaattgcttcaacccaggaggcagaggttgcaatgagctgagagatctgagccactacactccagcctgggtgacagagcaagactccgtctcagggaaaaaaaaaaaaaaagaatcctcttataatatgcaggcatcttagcaactgccatcttagcaactgccatcttaagaggcagcattatgattcagaagaaactgataacattgaggaatacatttgtggagcacagattaggagagattggtgcaggggtggggggtggcaggaagatattaaggttggaatttagggaggtgagctctgtgggttggtttcatgcatccagctcaccattcaacctttcctgttaacttcctatattaaggaggctgagattaagaagacagggactcgtggcgtaagggcgagacagacatagaggtgagtgactgcagtgggatattcactgtggaagcattgaaggttggcagtcagctagattcttaggctgtagatcgggggccttatttagaagctgtttactgttcccttaagaggatcctctagcaggaaaaaccactgctagggttgttgctttcctcattataatgatgtctttatgttcgtcttaggaggtgatagtactgattatttaagaaactggtcagccaaacttcttaactaattgtgaattagagaaaagtcagaagtagggagtattatagagataagtaattgtattattttcagacaaaagtatatgtagtaatgtaaactactgaccagattttgtttcaaattgttttttttaaatgaattgctaagaattatttgaaattagcacattagcggtaataagatagtagatattagatagattagattaggatagtaggtagtagatgtaggtataaagagactgaaaatcagctgtttaaacatttttcccaaatgtggggctaggaagcaagataaagaattatgcaggccaggcgcggtggcttatgcctgtaatcccagcactttgggaggccgaggcgggcggatcatgaagtcaggagatcgagaccatcctggccaacacggtgaaaccccgtctctactaaaaatacaaaaaaaattagccgggcgtggtggtgggtgcctgtagtcccagctacacgggaggctgaggcaggagaatagggtgaacccaggaggtggagcttgcagtgagccgagatcgcgccactgcactccagcctgggcaacagagcgagactccgtctcaaaaaaaaaaaaaaagaattatgcagacagtttcatttcatttatgtttggacggggaagaaagtcagaaaatagatgggaaggaaacatatctaaatgttaacggtggttgtattccatgggatcatgggtctttcttgatttttcatgttttgccacattctaaattttcaccagtgggcatttattatttttgcaattagacaggaaagagcctccaggaggaactccaaatacccatcctttatttaccctcttaatttgcttaccaaactttcttgttatggttagactggctggcatccataatttccatacttgtgattatttaaattaatggaaatttatcataatcccttattaaaatttcttcgctgcactgaaattcaacactgagcaaatctgttacctaggacataaagaaaaacattcagtccacgtgcggtggctcatgcctgtaatcccagcactttgggaggctgaggcaggcggatcacttgaggtcaggaggtcgagaccagcctggccaacatggtgaaaccccatctctactaaaaatacaaatattagctgggcatggtggctcacgcctgtagtgccagctactcgggaggctgacacatgagaatttcttgaacccaggaggtggaggttgcactgacccgagatcaggccactgcattccagcctgggcaacagagtgagacttgctctcaaaaaaaaacaacatccagagtcttccaggaaatttaccgtttcagtgtggcatagtgtagagtttgtttattatctagaatatggtttttcttttttgtgttcttgaacttgggcgttcacttcgtttgttgacctggaaggagccatctcggcgcctgctgtttgaaccttgggtattttaatgaagtggtttgatgtcctgataccaccagcccctgctgttgcttttcacggccctggcttttccaggaataatctccttactgtttgtcattctaatatgtttcagctccctttttgaaaataactttttctgctccccttccctgcccattcttcatgacccccagagaatgggcctgctggtctctagcccctgtgaattggaagactcctggcgatgatccttctttttctctctgtgactcaggcggttgatgttgggttgaccgtatttctttgctggctggtaagcagggccacctcagcccttgtgagggccatgcctgactttcaatggcttccctccaaaggcttcttaggccgttcctccccatcgtttttcagaggtttaatctgtttgagtccaggatattgagtcagcagtggaaagttatgaagatgaggccagccatcagaaaaattggctaatatgaaagattaattccagggtgaacaaaggagagggatgctggggccgggctgcctccccaggcaaatcacatcactgtaaaatccgagaaaccagaagttgcctttgctactcactcagtggctgcttgctgtttcttggattagatattgaaagaatcccatctttatagtctactgttcatatttatggtctggagaagaaaatgtaattttcagcaaaattctatcacgtctggtaaataatttcaggatctttacctatgataccacattaaaaaaaattcgtatggcttcagcattcagaaattgttcttttcaaactctgggccctcgggttattacaagatttaacaccgaggcaggaagcctgctcgcctatcactggagacaggtaggttgctatggagaccaggtgtgtgtccctgcggtttcctgggtatcccagttgtcctggaaaagaaatcagctcactttatgtgatatttctgcaatagtgtgtgtgaattaagtttttctaaacacagatcagatgtttttgttgacttacagtgtgatttctgacataattttgtcctcggttttgttttgcttaattatgaatcctacataaccctaccttttcctatcagaagcacttccatgcatcaagaccccctatccaaaacagccacaacaacttcaccaacaaaatctcttaaagctagagatgcctgctttggtgtgaatgatgattaccccttaaaataattcaacaattttttttttttttttttgagacagggtctcagtctgcctctcaggctggagtgcagtggcgtgatctcggttcactgcatcctgtgcctcctgggttcgagcaattctcctgcctcaacctcctgagtatctgggagtaccgggatgcaccaccatgcctggctaatttttgtatttttagcagagacggggtttcaccaggttggctaggctagtctcaaactcctgacctcaggtgatccacccaccttggcttcccaaagtgctgggattacaggtgtaaaccaccatgctcgacctcaacaattattatatatggtttgccagatcctggcctgggcactggggatgcaagatagagcaagaccattggaggccctgccctggcggagcttgtattagggttgtgatcctagaccacatgaagcccacaagggggccctgggctgacccgttcctggctcacattcactgtcagccacagctaaacctcggggcctggaacctctcttgttgtccccatgggacgagtgggcacatgccttgttggatggacaataacatcatctgtttttgtttgatgtgttattattcagaggcatttttcagaatggagaacagtgccttatcagtctgcttctgataattttatacatgaaaaaaatcctatttgtgcatattcttgggtctctccccatttctaaaggcagtcaacttggtggttggctgtaaaaagctctttacacttcctaggacttgtcaaatattgacaagtctttctcctttcatccagttcagcaccagcatcctcaaactcactgaaacagagcatcccacagtggcagccactgtaggccccaggtgggtatcctactcctccacccccgccccagactcccccaaccccagctcgcacctgcagaagttacgtctttgcagttatttcaggagaaaaaggcggccactctttctctcccttctttgggtttgtgttcagcaagggtctactgcagtcccggtgccggacagcctgttttgcccatgcttgttaactgatggggtcctcaagtggccttgtgacaggcctgataaggccgcacgtgggtgtggttagagttgatgaccgctccggacattggcgatgtgaggaaagtgacagactccagcctccatgtgcagccggtgattggccgggtgggctcggttttctagtggcaaaggatgctgtgatctgaatgagaaaacaaacctcaggccccaagtgccacgggcttagagacttgagaggaggtgcttgcaactccatctgggaggctaagggcagccaagagctgctgtcttgaggctgacccactcccttgcagtgtaatgggtagtgaacaggccatcctttttaaaggaaaataagtgcctccctatggactctgttcctatcctgctaccctccctgaagcttgaatagcacccacccgtgccttctccatgccggcccttgggtctgccgggaccactgccatgcttttgatggacacggccttgtagcgtctatatcctcatctgtgaaatgggaattccacagcctccctttcgcaggctgcttgtaatagttgccattaaacctcttctgaactctaaagtgctgtatcaatgtaaggaccatcatcaacatcattgtcgtcctcatcgtgagtctttccaaattcacctcctgctgccccagcacgggagtgtctgagactgcaggtttccttgatgggttcctggggcttcccttgtggaaatttgagttctgagccttctgcacttttccatcccccagtctggagtcaacctgtatttttcattttccctctgcaagatgtcagcccataggagaggcctggaggcttgcaggggaaatgggacgatgtttgaaggaagcccccgtgcctgtgggagcatgcagcctcctccgtctttttgtctgccaggcaggggagtaatttgccgttatgtactgggcagtctgggagctggactctcagatgaaaaatgcttgttcaagcacagacagccaggcatggctcaaatcagagcatcgatttagcaagcagctctgctcaaacagccagctgtgtgatcaccttttcaggggatgataggctgacgggcaggtggggtggggtggggtggggtggggtgggcagactaatacagggaccctgtgtttgggagcctctgtttaagcagagaccgggcctggagagagtatccctgggtagggaaaggtgctctcacattagtgggttccacctggccccttggtggagctcccattcattcattcactcattcactcattcattcacatcgtgtctactatgtgccagtctctgtgctaagagagtgatccaagcagaaggtctgaaatcctcagggattcgtttcccagccgacttatgccttactaagtggagcaggttctgggctgcaggggactgacttgctgctgcaggtctgggtcttgaactaagggagaaagacaatgcccatcttcttcttggcgcagtcatttgaggagaggagcatttgcttcttgccaacctgcctgcctgggaggccctcttgctcctgcagccccccgagtcccctttgcagctcccagtcttgcttggggttgcctcctccaagaagcctcctgggctagctcaggcatcctgtggaggcactgctgggccactgatgcctgagctcctgtggcctggctgtctgcagggcttcagtcctggcctttcacttcccagacatgagtcttatctttccacttggttagggcctccccacggacatggacggatatggtttggatttgtgtccccacccaaatctcgtgttgaattgtaatctccagtgttggaggaggagcctggtggggggtgattggatcatgggagcagagttcctcttgctgttctcatgatagtgagtgagttctcacgagatctggttgtttgaaagtgtgaagcacctccccctgctctcccttctgctccagccatgtaggacgtgcctgctgtctcttctgacgtgattgtaggtttcccgaggcctccccagccatgcttcctgtgcagtatgtggaaccgtgagccaattaaacctcttttctttataaattacccagtctcaggtagttctttatagcagtgcgagaactgacagggaccgtgtgtttgggagcctctgtttaagcagagaccgggcctggagagagaatccctggggagggaaagctgctctcacatcagtgggctccacctggcaccttggtggggctcccattcattcattcattcactcactcattcattcacatagtacctagtatatgtgccagtctctgtgctaagagaatgatctaggcagaagacctgcccgctcagggcttctgtttctagctgggagcaacaacagtaaactaaataagcagattatattgtataatatagtaatacttagaaggtgatgagactgtggaaaacaatacattagtgaagagggtgagggtattggatggaagagcgtgagtgtattaggccgttccacattgttataaagaaatacctgagacacggtcattaataaagaaaagagatttaattgtctcacggttcttcaggctgtacaggaagcatggtgctggcatctgctcaacttctaaggtggccttgagaagctacaatcatggcggaaggtgacgggggagcaggcacgtcacatggagaaagcagaagcaagagagagaaaaatgcaaggtgccacacacttttaaacaaccagatcttgtgagaactcactatctcgaggacagaaccaaggggatggtgagaaaccattcatgagaaatccacccacatgatccagtcgtctcccaccaggcctcatccccaactctggggattacaattcaacatgagatttggttgagacatccaagccgtatcagtgagagatgcagtttttttttttcaggggaaagtgttgttgttgttgttgttttaataagatataatttacataccatataccatgaaagtcgccatttaaaaatgtacaattcagttgcttttagtatactggcaaagttgagcaccagtagctactaatttcagaacattttcatcaccccagaaaaaaatctcatagccattagcagtcactcctcaatctcctcgtgccctaggccctggaaaccaataatttactttaggtgtctctggatttgccacttctggacattttatatcaaggaaatcatgcaatatgaggccttttgcatctggcttcctttaccaagcacagtgttttcatgcaccgccaatgctgcgtgtgtatctgtactgcatgcctgtagatggcggaataatattccaatgtatggatagaccacattttgtttatccattcatctgttgatgaacatttgggctgttttcacttttggctattctgaacaatgctgcgaggaacaagttttttttgtacaagcgtgcaagttttttgtggatgtatgttttcatttctcttaggcaaatagagagacacaattttactttttatttattttattttttatttttttagagacaaggtcttgctctgttgcccaggctgaagtgcagtggcgccatcatagctcactgtagcctgcaactctatggattacatgttcctcctgcctcagcctcttgagttgctgggactacaggcataccccatcattcctggataatttttaaatgtttagtagagatgagttctcactagattgcccaaattcgtcttgaactcctgggcttaagtgatcctcccaagttagccttataaagtgctgggattagaggcatgaaccactgcacccagccacagttttaaatagggtggtcagagaaggtctcatgagaaggtgacatctgagcaaagacttgaagaaaataagggcagaagccacacgaaaaccccagcaggacagcaggtgcaagggaacagcaagtgcaaggatgcttccaccaaggggctggaaaatgaaaggcttgacttcaccagctgcctcccaaccagggggcccagtgagtttaggcctcactggccctttctggctgaggggcagcctgctgcgaggggtttccctttctgaataaagagtcaaagtcccaagacagatgatttttgacccatgcatcttcttcctgcctggaaagcagatgtgattcctggagatggggcagctgttctgtggccatgaggttgaaatccatgtgctaaagacagtagagcagaagaagactgggaccttgatggcattcttgagctaccgcctgaaccttggatctcctgcacctgaactttgctctgtgacacaaagaagaccctttcttatctaagccactcttatctaagccaccgcttgtcacgttttatgttgtttgcagccaaatgcattcctcattgatggaatgtccaacattgtccccaagtcccccagatagatccctgggggctcttgacagacagacagcaggcaagcctgggacacacgctgcccccttctgctttcctgtccctccatcgtgttaagctggtctctcaggtgggcatcaggattcagctatcccaggctgaccctgaggtccaccatgactgtgctgcagccaccaccactggccgcttcatggcatgtttccagcacaactctctgacctggctcccccggttccccagacgcgttccccacggagtcccagcgtgtatgcatggggtcacggtgctccacgctctcaaccgttggttgcaggttcccgtccagcctctcaagctggctgctcccctttctcagttgtcccctgtgcctcttgtaccctaacttcagtgttagagcacctttcagggggaatggcgtaaaaaagccttcctttccagtagacagagtgccctggccagcagaggccaaacacattcccattcagctttgtttcatgctggatctggccccaggcctgcacctggccctggcagtgggcgcacgttaggtgggattgctgaagacaatgggtgactgaggcagttacaggtgtcagccccagatgaggctccccaacctgtaccctttaccctggagctggccccatctctcacagcccagtggtgtactaccttaggtaagcaccagttgcgcctcactctaatgaaaataataaaagctcaaatgaccagcactgtcctactgctttatacgcatgacctcaggtaatgagaattagcccacatccattcattccacaaatatttatggagtgcctactgtatgccagggattcttccaggcactggggagacatttaaaaaacaataacaacaacaacaaaaatctgcgtcttgtcggaacttccatatacacttccactggctacttcatggaaacatctggaacatctgatttttctagtcttcccattactaaatgtggcacaagaacgtagtctaaaggatgtacttcaccatgcaaaagctcttgtcatttcagaaaaggaaggagaattaagtaaaatgtacttcaagaaagtcagttaagaatttttccagttaatgaaaatttaaaatgattggctttcatcttgctgttttccagggtcccactattaagaactcactcatcctgttgttattaagggtgaaacccagacatttccttatgtaaaagccaattaaaataaattaaatgcaaatactgtttcattgtcatgtcagttttgagaaccggatcaatcagaggttgtggaaatgccaaagttgttaaggctgtggttaccatgacaacagctctattgtgtaagtggtctgttatttgggaattcttccttaggtcaggctaacagtgatgtcatttctcagggaaggggacggagttctctggagtcaggtctggggccaggagacctggtgagcaaaaactggggttcagccagaactaccagttttgtgaccatgggagacagtcccttccccttttgcctcagtttcctcgctttggggatagccattgcacagctgtgagtatattgtggccattcagcacttctcaaaagttgctgctctgctaaaaaattttggggattcctgatttgccggctggttttcagcctatgttttggggaaatgcaaatgataggaaaccacccctggtcctgccttaccggttctagcagacctttggtgaaactgggagttcttgggtcctcttggctagtggctagtgaatacctgctgggggagggggtgtttgctttgctttgtgttgggggtggggttgttattggtttttacattttgtttgcaatattgggtttgctggtttttgtgttttttttttttttttttttttgagacagagtctcgctctgtcacccaggctggagtgcagtggcatgatcttggctcactgcaatctccacctcccaggttcaagtgattctcctgcctcagcctcccgagtagctgggattgcaggcctgcaccaccacgcccagcaattttttttttttttttgtatttttagtagagacagggtttctccatgttggccaggctggtgttgaactcctgacctcaagtgatccacccaccttggcctcccaaactgttgggattacaggcgtgagccactgtgcccagccgggttgctgttttagttggtttttgattttagagagagggtctcgctctgtggcccaggctggagcacactggtgccgtcggagcacactggtgccgtcatagctcactgcagccttggccccctgggctcaggcgatcctcccgacatcgtaattacatttttgcagggttttcagttcacaggtgtgctctcccacatccccatttaagtttacttatttttcagccccagcctctgaggctatcattattttacagacgagaacaccgggactcagagggtgatttgtccctagtctcagggctccaaggcggcagtgccagcgttggtgggggtccccagtgccaggccagggtggcactgttctccctgtgcctctctgcttgtccccactgcctgcttctgcagaggcctgcagaggcaaccttcctcgccagcatcctgctaagcaggccctggagggcggtttccctgcttccccacaccgggccagagctgccttgatatttatttcagggcatccctgcagagggaactgctaatgcagtcatggctttaagacgtcacaagccacagctgcaggtgcttcatcttaaacatctgccttcctggctgggagaagcccgggagcacctgctgcaggtgtctttgcacctcggtcctgctggtcccaggcccagctgcggccaattagcacctctgttgggcaccatggccatttccttgctgcatgggagccgctggcctttttccactgtgttgggggaaagttgttgggaaatgaggaagcagttggggatttaaaaactctatgcaggaaataggctgttgggttaacatttaagccactgaacagtcatggagtgtttgcttggaagtgaggcccacgaggctgcagagggccatgagattcaaggatggtgttcgtcaggcctgtccgtcatcctctctgggctcgacaccatctcagggtactcatgcctgttaggtgcttggtgaacaaaggcatcccagacagaatcaacccagaaggaagaggggtgggtggtaaacgttcgttaacttagccatgttctcttagggtttcttctcaaaataagggcagatgggagatctccctgcctcaaggggtccctggccaaggggctacaggcagatattgcccagtcagccccagtgaggtgacagaaggcgggaggtggcttcagtgtgtttgaaggaggctggcatcacaggttctaaagcagatggcaggagccctgtggctgggcctgcttcagaaccttggctggctgctccttggaggtgaggtgggggcaggcagtgttggctggagacttgtggggggaattggccgcctggggtgcgtgctggcctgcctgccttccgcttccgtgccatgagccccttgttctcagctgtgaaggtaggtgaggctgccctgcaccagccagcagactgggttaaggtgggaatcaaaggagaggaggtgttcagctggctggagacctgctgagccccttgcatgaggagggatttctgtccagcgcccctggtcctcaagctcctcctcagcagcgttcatgagcacagggtgtgggtgtgactggtccctttgggcagaatctgagagtgcccccttctccctccctgtgcatttgaaagttggctggtgctcgctgacagatgccgaggctcccgtttggcagctggccatggcagccgcttgtcctccactctccctagatttggctgagctgggcccctgctgtgccccacatgccccggctctttgtctcggttgtccctttggctcagctctgggtgtcggctcctcggaagcccttcgtcacccaaccagagtgaactccttctcccaggtggccagagcatgttgaggtgaccctgactttcttctgtgggtcctacattttagcggggagtacaagtgcctcttcactgcagcatctcctaaggaagtgagcctgtggggaggtctctgatgctactgggaatccagcttcaccttcccccaactcctgggatttgcagccacagctaagagtgggagaactttgccttgtttgcattgctccagatcgtgttaaacagaatttcaaaacatgcattttgtaggtagtagttctgtcatccagaatgtgtaaagtaactctctaggtagctgttatggatggcctgcaggaaggatcataccagtgacttcttttgagccccctgccgagtggctagcgtcaggtgggggattagactctggttctttgcttcctggccctgtgagccccaggcaagtcagttaacttcttggagcctcagtttcctgacatgcaaatcatactgacctggtaaggctattgtcaggattatatgagctattatatcctaaagtatattatatcatactttatagagcgtagtatatattcaagtaactgcatttgtgttagttcctttattttgttaacatggggatcaatggctttttttttctgatttggtatttattttaagactaggttgggaaccaattttccatagtcatctgtgggtataagtactcttaccttcagccaggacttaattttggccaagagccttggcttattccagcagagagtggagttatttagagccaaactgtaggggactgaattctctgtgtagcactttctgcagacagtggtaacattaatgacttactgcatatacattcataagtgggtgatttatggttagccccggatccataactttcatttcctgactgatatatcagaagcttcatgtataaaggcgcattagatttagtaagtgtaaaagacttaagttgaggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacactgaggcccagagaggttaagtgacttgtctgagggttaacagctcctgggtggcaggatttacattggcgctcagatgcatctgaaccccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatccaatcattgagaacccagctagaacaaaaatgtagagaaagagtgaatgtgctctctctgcttgagctgggacacccaccttctgctgctcttggacatggagctcccggttctcaggcctctgggcttgagctggagtgactccaccggctctcctgagtctccagcttgcagacagtaggtcttgcgactcttcagcctccataataacatgaaccaattcctcataatacatttctgtctgtttatttctatatatttattggctctgtttctctgaagaaccctgactaatacttccccatctgaactttctctgccccttttgttcgacatgtggggggttgctggggaagctaattagaatacaggttcctgctgacaccccacccccactcccttccttcatcaggatcactagtggtgagcctttaaatgcctgtaagctgtccgaggggttcttcctaaattaaattaaatttttaattttaattacttaatttttttgagatgggatcttgccgtgttgcccaggctagtctccaactcctgggttcaagtgtcctcctgcctcggcctcccaaagtgctaggattacagatgtgagccgccactgttggtctctaggggttcttatgcacctagaatttagagactcattgctccaagcttcattgaatctttcctgaacagtcttgtgataggcgggataactcccacccctcagatgctcacatccgaatccctgggacctgcggatatgttgccttatacggtaaagggctttgctatgtgatgaagattgaggaccttgaggtggggacagtatcctggattaccagggtgtagtcactgtattcatgtaagtccataaaagtaaggaacctgtcccagctgcagtgagcccgagggaggtgtgactctggaagaagacgcagagatgaaacactgctggctctgctgacaggaatggctttgagccagagtgtggtggcctacagaggctggaaaaggcaagggaacagatccacccttaggtcccccagaggaaccagccctactgacacagtctccgtgggacctgtgtccacagacagaactgtatgaaaacacgattgtggtgtgtaagccactaggttgatttgttacagcagtgacaccgggctttgtctctgcttttgacttttcctccagtgtgatcccttcccctgcttctgacccgtggatcccagccctgcccaggcccagatcctgggctccaggtgggcctgggttggggctcccagctgcaggaatgcaaagttcatggttctacaaagtgctttgaggtgacgttggtcacatcagctcggcctcagatttgctgctttttttctaaagaagagacagctccaggccctgcctgactgacctagttggggatgcaggccgaggccatatcgagcagggtaagtttccaagaatctggctttaggattagtcgggccacacggaaggagttcctggtctcgtgacacctgcacaaatggtcttcaaccctcaaaacacttcctgttatttaaatcttggtcctttgatttttttttttttttccttttagagactatgcacaatttatgtggcaagctagagatgctttctttttcagagcggcctttatgctgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgggggacacactcagtccacgttaactcacttcctgcccacggcaggggctctctgtcagtgtgtctccgactgcggaccccgatcatctttgtgagaatgcaggttcccaggcccacaccatgctggttgagtcagagcttctgggtgcagcctgggggtgcagcaagcccacccctgcattcggagagccttagcgggaagcctgttgcttgtgcctcctttgcagccccggcctctccagttctctgtgtcttgccatcttggcttcttcctcatcccgcctctcgctccatctcgtggcctcccatctgctctcccggctgcaggagcggtttctctaagccttgcaagtgaccgcaccctcttactgcatgcgggccttgccaagagcctgcagagggcggggcgggctctggggacagcctggactctcctgcctgcccccaggtgcccccggcccagccacagggtgctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctcccaggagcttttccacggccaagcgctggctggtggtggagctgcgctgaagtcagtgtgtgctttgggcccagctgcactgtgcccggggtccagggatgggtgtgaggctgtctgccccccactgcacgcccggctgtcagaggcatctgtctcttcccccgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggtgcccttcttgtcacccgttgtcatttacgagacagccctgtgtcacctgttgattcagagggagctctcctcatcacctgttgtcatttatgagccccgtgtcacctgttgttgcttcacagggagcactccttgtcacctattgtcatttatgagccccgtgtcacctgttgttgcttcacagggagcactccttgtcacccattgtcatttatgagccctgtgtcacttgttgcttcagagggagcgctccttgtcacccgttgtcaggtgtactcactttgcttctcccttcctgcttttggggacgatcacaggacagtggcttcagaggggaagtacctcgacctggctgaggtcatgcccagagcctgactgctctctccacccacccatgatcccatcagcttcttccccctccttctccatctgatctgagcatttaccatttccttccatttaagcttcatttgagttgcatcatgatgttctccttttttcaaagttccatctgcccacaggtttccattttctctagaaccctcctccttcctctctagcccctggcccgcccctctgcggttctcaggaagcccctcggtgccccctgccccttatctagaacagcttctgcctagggtgggcaaggcagggtgggaggtggggggtagccgtgcagggaaggggtgaagcgggcccctgtactccctagctgggctgcaggcttggaggaaaataagagtcagacgcttgttaaaacagtgaggacagctttattcgaggaaaatgcagtcggggttgaccttatcagcaggggagagatcagcccaactcctaatacagcaaggaagggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcagggtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgtctgtcttggggaactggtgtaacgtttctccatctgacccctgctgtctgttggaggtcaaggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttctatttctttacccaaatattctatgtctcttcggtaagactggaaaacacagaaaaacagagaaaaaaattcccccataactaccctgcccacctccatataacttttattagcattctgagctatacccctccagactcatttctgcctctccagaagtgtgcataaagtctagaaacataggtgaagagacctaatgccatcaagaacatcaacctgtaaaggaataaaataatgtcatctgtgtccagattttacagatgctttgtagatatgtgtaacagaaatgtgggtatgttttagcaaaaataagaccatatttttgttttattttgattgattgtactataaattccagtagagcattacagagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctctttgggaggctgaggcaggaggaggcttgaggcctggaattcaagaccagcctgggcaacatagcaagaccctgttttgttttgtttttttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgacggagtggagtgagaccttgtctttaaaaaaaaagaaaagaaaacagaaagaaatactcataaatggtatatatatatatcactttgtaatttgttcttgactactttgtcaacaatttttaagctgtatccatgttgatacatagatgtggttcatggtcttcttttttctcctttttgttaactgctgtatacaattccattgacttttttttgaggcagggtctcgctctgttacccaggctggagtgcagtggcacgatctcggctcattgcaacttccacctcccaggctcaagcaatcttcccacctcagcctcccaagtagctaggactacaggtacatgcctggctaatttttgtattttttatagagtcagggttttgccaagttgcccagcctggtcttgaactcctgagcgcaagtgagccacctgccttggcctcccaaattgctgggattacaggcgtgagccactgtgccagcccccattgtctaaataagccatcgtttctctagtcatatacagttaggtcacttccattttttcattagtataaagagtgccatatgaatattgatcctccttgagtgctgtggaaggaagcctctaagatgccgccactggtccccacatcctggtcttcacacccttgtgtaatcccttccctcgggtgttggctggacttaaccgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctaggtgacaagggaccaaggcctgccaacagccatgtgagtgagcttggaagcagatctccatccgctccccactcccagctgagccttcggatgagactgctgccctgaaaacagcaaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtgctatggtattctcacgctcaacagtactgtttattactaaattcatctccaaggcatttgtggcagtttcactcccctctacaagggtcagtgagctccttttcctcatacctctccggcacttgtgttgtcagactttaacatctgaacactctgatgggtgtaaaatagtatctcatgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtcagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcagccccggaatcatgggcacaagtggtcctcctgcctcagcttcccaagtagctgagactataggtatgcaccaccacacctgggtaatttttactttttatatttttcgtagagatgggggccttgttatgttgcccaggctggtcttgaactcctggcctcaagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgaccatttaaaaaagaagaacaatattattaggtagaaatagtccctggctccccggttgcccaccgtgactataacagcatatctagcttggtagttttcaaattatttccacgttttatttacttctcacagcctccctgtggggttgcaggtgcttctccactcctccactgacaaggtgcctgaggctcagagaggctgagaaatgtgctctgggctgcacagctggggatgaggcgtagaccctggccctgctctgttctgggctctttctcctccactctggcctttggaggctgtggctaagatcttcccccagccccttccttcccaccttcccttcctgctcttgtgccccgtttttcacagtcctcagtggctggtttctcagtcccccaggaggtgcaggctggttcttaggaatggtctctgtcaatgttcccggcagtacctccgagcctgccctctgaggatgggtcggccatggctgcgccggcttagtctgtatttaggtatcactgactatcactggacttggggaggggatttactatttttagagaaagtcaggggagctccataaatcctgttagtcaacagaactgcagagaggtggctgtttatgaaggagagtgacttttttagaagtggcgcatttagaagaccacatattctatcattctgtgtacatgagcggtgcagaataggcaattctaaagagacagaaaatagattcgtgattgcagggagtggggaggagggatgggaagcgactcctaaggggcacggggtttcttctgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtcatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgttcatgcccggcaggacgtagcaacagggctggcgaaacggaggccccaggcttgtgggcctcctggggttcctgtgcgttgaggcctgagcccctgcgtgcgcccagcggagccagcactctccctgtggtcctactgggcatcacaggtgtgtatgtgaggggtatggggaggggattcttggttagtctgggcttcatgacattgggatgagttctttcacttggttttgttgatctggtaaaatctgtggtcctgtgatatcaccttgcttctcatagtatgagccttcaacatttggcctcagtggtggggtgtgcctgcaccgccttcccccatccctgcctcggctcctccccacaacaaagcggaaggaagacatagacccaagggtgcacttcagcccctcaaccagctgtgtggctttggagaagcggcttaacatctctgatcccagttacctttcttgaacgggaaagatatcaatgcttccttcactgattactggagcttcttggtgtgcagtgtctaggctgctttctaaccatgtaaggtgtagccacagtattgtaggacctgttgctaagaactgtgccactatcttgataaacatgttttccagggactggtggtggaatgttctagttattaatgtgcctttaacgttggatgactcagaatatccctcagatagtaggaataggtagctttgagaggtcatctgtaggagggcgcaggaacatcccaggagggggtgtcatacctgttggcaccatggggatgcaggctcagaggggactgaactttccagggccacgcagtctgtaagcggcagagctgggacgcaaccccaagcttgctgctctcaaagctttgctttcaaactctcacttcagacatcagggcttcctttcagactgagtcttatccctaagcactgttggagaagaaagtctccaggctgcagggccccgcagttcccccatatccctgcccttccagccagcccacgcctggggcctgtcctcccctgttcctgaatccctgtcctgttactgccctccgggtaagacagcactcttataatcatgcttcatgccgagttcatgaaattaactctcaaactcctcttctctgggttaaattatttcacttttttcccttcctcatagaatatcattataaattctagatactatattggatatgtaataaaatcagaataaattacatgtgatggccactgaactaacctcccttcatgtgtctggaggcaggttttctgtggagttatgctttaaattggctgtccttcgcgatttttcttaaagcctaggttgactactcaagggtctagatttatgatagaaactgtgggctggggtgcagtgctggggtgctggggtgcctgtaatcctagcactttgggaggctgaggtgggcggatcatttgagcccaggagtacaaaaccatcctgggcaacacggtgaaaccccatctctacaaaaaaatacaaaaattagccagacacggtggtgcatgcctgtactcgggagactgaagcgggaggatcacctgagcccaagaagtcgaggctgcagtgagtcatgattgcgccactgcactccagcctgggcaacagagcaagaccttatcttaaaagcaacaacaacaacaacaaattgtggcacaaatgtatgcatggaggtactgagggccttctttatagtaggctcaggaatgaccaatgggtgggggctttgggggaagagacgggggtctttaagcagaaactctcccctcaacacaagaaagctgctgaaggacttcagaaacctaaacacgagccgtgggcctttctaaagtggggagggattccctcctgcctaggttatgttgcaaggctgcccgagagagggtggaagggggcaggagagtgggcattggctgggtccaacgcttcccaagagatgtgactgtcttaaaagcaataccttcctgattaccacgggaaaaattcaaatgttttgaaaagatctacaagtttggggttgaagaagtcctttatttcaaagtttctctgggctgggcgtgctggctcacacgtgtaatcccagcactttaggaggctaaagtgggaggatcacttgaggattgctttgaggccagcctgggcaacatagtgagactctgtctctagataaagttttttttttttttttaaattagccagatgtggtggtggtgtgctcctgtagtcccagctacttgggaggctaagttggaaggatgacttgagcccaggaggttgaggctacagtgagctctgattgtgccgctgtgctccagcctggtgacagagtggaccttgtctgtaaaaataataataataataataaagctttgctccccgtttcatttagatggagcgtttgtgggatttaagacagatttttccttgctgagtggttatcattaacctgttgaataagcaacaggccgaggtggggaccctgcctcgcccgcctccaggggcacactgcattctttgtggaagtgtccctggaatgccacagccctgcttctgtgcgaggccagtcagtctgggtcctgggatatagccacatgtgcagtccgtgcctccagcgcgcagcctgaaagggaggcgtgcagaaacaacgtagctccaaggaggactgatcagcccagcctgggggagggtgggaggggactcccagggagcggggcttgtgctggactttgcaggatgccagacttttggcaggggaggaaattgaggtgaaagcattccaggcctagggaacagcatgtgcagaggtgctggctggaggaaccccgtgtgtttgcactgtgctctgagctccctctcatgactctcattctttctcgttgagttttgttttgtcacccagccggactcctgggcaaagagaggcacaatctgttcccggttgggccagctgccctccagtagctacgcaggatgctctggccggcctctgaggattctcttcttctgtccatctcatggctgaagaccaaggctatggcctgtgggtggcagttggtacctctccccgctgccttcccccggcccctttttggacaggatgttgctccctggggcctggctttggagatggccagtgctggtttgaagcttctgtcttctgtgtgggatatcagtgccctgccagctgttgcaagttttaaactcaatgtgcctctggatgtgtgtgtagagtaggggtccttccccagctccaggccctgtgtgtttccaagtgggcccgcagctctgatgtgcagtgggtatgcactggcaagccgtgcactgtcacaatattaaaataacttccatggtagttggtaaatagccccatcacccctctcctgggaccctggacctctagcacaccatggaggcctgccccgtccccataaaacacaccacattcaaattacttatctcctcttcccctgccactctgctgagaaggctgatctcaatcctcggagtaatgactctcttctaggagcaagatgatgctaattctcactagcatgtgaaggactgatagcaccatatctccctccaggactcccgggtgggaggtgggtgtttgcataggcaggcaggtgagccagcctagtttgtccacagacttccatgcaagtgattcctgctgttccctgggtcttcctttcttttgcttctgaacttggaggtttcttgaagtctggaggatttttagggtgggcatggctttaggtgggacctccactatatgggtttgcaagctgccactgctttgactgcagacactggattgaccgtggccaatgccaagtccaagagatcaggctgaaaccaggctaaattttaagagcagaaacaaaactcatccttgcgaagggacttttagatcagtggcagatggcatagaaagtctttctgctgttctcttgtgctgggcgtggctcagggctgaggggagagaggagagatgagggcagaaagagaagagggggcaggcctcagggatgaacacatggcccatggctgtgcgcttcccaagcaagcagttctggagtgaggctcgggcctccatgcctcctgggaggctgcacctcttgggatatagagaacgctggcttcagacccggcaggagtaccggcggctgtgtggtgcatcctgcacagagctgttgctttctaactgggttactgagctgtcgaaggagcagggatgaagactcccttattaaaaactaaacaaaacacaacacgaaaaagccagaacaaaacaagcagacggttgaggactgcagtgaactcattaaccctacagctttgatctcgaagtctcggccgctcctggctcagaggaccctggggacgtggtctttgatgcttgctttccccataggcatcacttcgaccagcgtctgtgtggggtgtgcagcagccctgagccaaggattaattacgtaacaagcccagatcccatccctgcctgagcaggccatgtgccagcaaggggggccccgaagtgccgctaggtgcctcacgattagcataaggcccgtttatccaggaagccagaaccagtgcacatctgttaagcgcatgcaccaagcggcgattccatagttgtatagtgattgtctttatggaactccagaatagcttcttagatatcactcttcaggccctgaaatggagccctgtgcaaagaaatgaagaaaagctatcggggcatctgcagccactattataccatctggcagctcagaaatattttataatcaaatgagtaagacgggcgtcccacactccacagtactctgctcccccttcccttcctcccaggacttgctctgtctctgtctctttctctgtgtctgtctgtctgtctctatgtgtctgtttctctctccctctttctgtgtgtgtctctctctgtgcctgactttctgtctctttctgcttctctctctgtgtctgtctctgtctctctctttctgtgtgtgtctctctctgtgcctttcagtctctttctgcctctctctatgtgtccgtttctctttctctctgtgtgtctctctctctgtgcctttcagtctctttctgcctctctctatgtgtccatctctctctctttttctgtgtgtctctctctctgtgcctttcagtctctttctgcctctctctatgtgtctgtttctctctctctctctttctgtctctctctgtgcctgtcttgcagtctctttctgcctctctctgtgtgtctgtctctgtctctgtatgtgtctgtctctgtttctgtctgtcttgctctctctgtttcaatctctctatctctgtgcctgcctgtctgtctgtctctttctttctgtctctctgtgtgtgtctctctctccgtctttgggacagactagaggaacctttttcccaggagtgataatactgtactctgcgtttttgccacttgctagctgggtgaccttgggcggctttcaagttcccttatcctgggtttcttcatttgtaaaatggaagcactacttcacagtgctgttgtgtgggtcaagatgagatgaatgtgacctactgtggtactatttattatttgtcctagaaaaactttttttttttttttgagacagggtcttgctgtcacccaggctggagtggtggcacaatcttggcctactgcaaccttgacttcccaggcccaagcgattctcccacctcagcctcccaagaagctgggactacaggtgtgagccaccacacccagctaatttttgtattttttgtagagacagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgacgcccctcccccaccacaaaaggggcaaggactgcgaacttttgccgtattttggaagatttcctaagtcacacaagcacacagatggtctgttgatccaaaccaggaagaacaattgtgggaataagtggaagtgtgagtgtgtgggtgtgtctgagtgtgtgccctgggggtgtgtgtgtctgtgtatgtgtgagagagccaggctgtgtgtgtgtgtgtatgcatgcaaacacttatgtgcaatgccttggggtcctcagaccccccttggtccatcaggggctggtggcctcccagtaggacactagcacagctgcactcacgtccttctttgagggggggtgacggggagaaagttggggagcagcagtgactgctgatgttgtgggggccatggggagcctcctggtattctgtctcgaggctctggggatatggtgggagaagccctcatgccagaattgggaggggatggaatgggactgaccccatcacagcccacgtgcctcattcagggcttggctgtggagtcttgggggaggtgctccctcatcctcaaatgttaactttgtctgcctggccccagtcccctctgtggcttttttcctctttcaattgggaggcagttctgtcttaaagagatgtttaaccctctaggtctccgtgcaggcatttttgttgtgagccagtcaggctataaatggtccattaaaagcactgtccagttgacataaccggtctaccaggctgagacccacagacccgggactggcatttatttatggatatgatgtgcaaggagagtgttttccagtagcaggcgttggcatcatcaaacagaatgaagtgtactgtgttttcaccatgatagtacaaaaacgagactgtgagagcttctcacttctctccccttcctccccttccttctccatgtctttgtgctcctccactgctccctccccagcacagacaggccctggctccctccccccaccctcttccttctctctccttctaactggggtcaggaccaccctggaggatgttagattttaaacatttgttcctcttgtcatccccaccaccccacccacccacccagattagtttctaagggatttatatttgtttgcagagtggtgcgaactgttttcatcctcagaggagcagagtgctcatagatgagtttgacattactgggattcactttcagaagtctctagagagccccgcaccgcccccgccccccgcaggtgctggagttcagcctgacacacaggccggcctcagtgagagggagtgtctgcctccctggcatccgtgacccatacggtgggcgcctgttctttagaacaacttgctccttccgtcgttggcttggtcacccagcccccggcccacccttttctgagcctgtcatccacaccaggcagagccctgtctcagagtctcatggggagcagggccttcagggaaggcccatgtgctgggactgacttggctcacaggaatttcctgatggtataaaatgtgccccccagcgcctgataatggtcacttcgcctaagttccagccccagatgtggaccacggtggggcaaaggtgggcgtggggaggaggaaagaggtttaaaatggccacacccactacttctcctttggaagtgcctcctgccaccctggggtcccaggagctgatctgtgggtgtctgtcctcagcacccaccctgcttttccttcaggccccgctctggctgtctgggcctttctggtgctgttcctcacaggtttaaacactccagcagcagcctttcccatggcactgtgtctgcggggcggggttgggcattttctgaggcttcctgtgtttcacggggatccagtatgaagcctggcacggagtatgggccaaatcggtttaatgtttagctccccaaacccttcacttctgtgtcctcattaattcagacaaggttgggtttagcaaactgtgtctcaaacataagaaaatgcagcgtgggaatgggggaggggaggagtgctgtagaaggaccatttcagaagccctggtttacaggagaaagattggtatcttcataagtcactcttaagcttgcatttgttcatgctttaacacagtgattagatacctactgtaagcctagcatggtggggatataaaagcaagatcaagttcaagggggcagggatttagggtcagtgagacggacctcttaatcacttattttgtacacatcagagcagtgacattgtgtttctttaaaaatactaggggccagcccgggcacagtggctcatgcctgtaatcccagcactttgggaggccaaggtgggcagttcacctaagatcaggagttcaagaccagcctgccaacatggtgaaacctcatctctactaaaaatacaaaaattagctgggcatggtggtacacacctgtaatcccagctactcgggaggctgaggcaggagaatcacttgaactcaagaggcggaggttgcagtgagccgagatcgctccactgcactccagcctgcacgacagagcaagactccatctcaaaaaacaaaaaacaacaacagaaaaaactctgggccagctgtggtggttcacacctgtaatcccagtgctttgggagaccaaggtggggggatcgcttgagcccaggagtatttgcccagcctgggtagcatagcaagatcctgtctctacaaaaaaaaaaaaatatatatatatataaattagccaggcagggtgatgtgcatctacagtcccagctacttgggaggctgaggtgggaagatcacttgagcccaggagtctgaggctgcaatgggctctgatcccaccactgcactccagcctgagcgacagagtgagactctgtctcaagaaacaaaacaaaactctggattctggccttctcctgggaaatccagatttgtctggtatgatgttcgttgaacccatttagtccagcagcctggctttccaaaagtatgtctgcctctcacggtgcccagtagctttaaccaaagagctcaggaaagggcctgtctgaattcaatcacattcagcatctatttcagcgttttactagctttcaattaaagtagccacgcatttgagcctgatggtcttattgttttatgttgttccttttgcacatttcctgcttgtttatctttgtggcacaggggcatgttcttggctgcagttaacaatgctggccacggcagtgcagcgtttccaaatttcttccctttattaacaggcggtaatggaatctgaatcttcaaaaataaattttacatacttgttctctaccataaaagtcatccatacttattagaacgtctcaaacatactaagaggtaagaaggagacaaaaaataatattttgtcacccctgcccaggtagccactcttctatttgagtgcttgtaagaagcctgcttttccagtattatctgacctggcagggagttgggtaattgaaaaagattattaaagaggggatcataaaaatgatatagacgccgggcacggtggctcacacctgtaatcgcagcactttgggaggctgaggcgggtggatcatgaggtcaggagagaccatcctggctaacacggtgaaaccctgtctctactaaatatacaaaaaattagctgggcgtggtggcgggcacctgtagtcccagctactcaggaggctgaggcaggagaatggcgtgaacctgggaggcggagcttgcagtgatccgagatcatgccactgcactccagcctgggtgacagagcaagactctgtctcaaaaaaaaaaaaaaaaaaaaaaaaaaaaaaaaaaaaggatatagacatattgagcatttcgttttgacataaaacgtttcattttcatataaaaatgcatttattccccatctcttgatacagggccaagacctctcttggattatgggtccactggcttctgtcctgatatgtcttttttgcactatccacactgttaatgcattttctgagattctcagtttctgtttctgtcaagtaatgtaggaactagcaccaaatccttgccgatttcatataccactgatattatacagttattttgttcatgcctaattgaacagccatcttcccccaaacattcaactctgtttcataaaaccaactccttttaattcctcttctgagggtttgcataaaatttaattaactttggtaattacataagtactactggtataagcaggtttggaaacaaacgtaactgagtcttggtgggctcagagtgcacctgcccgaaggttcccacatgctctatgcacccagaaggggacagagcatgccccatagtccaggggcaattaggggaagcagctaatgaagtctgctttcttctggccttttaaaaatctatgtccttttttttttttttttttgaggcagggtcttgctctgttgcccaggctggagtgcagtggcatgatcatggcttactgcttcttgggctcaagcaatccccccacctcagcctcctgagtaggtgggactattaggtgcatgccaccatgcctggctaatttttgtattttttgtagagacaggatctcaccatattgccttggctggtctcgaactcctgggctcaagcgatccatctgcctcagcctcccaagtgctagtaagccaccacacccagccaaaatttaaaacacctgtgcctcaaagaataccgtcaagaaagtgaagagacagctcacagaataggagaaaatatttgcgaattgtatagattctagacttgcatctagaatatataaagaactcttacaactcaataatacaagacaacccagttaaaaaatgggcaagggacttgaatagacgtttctccaaagatatacaagtggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggatgaaaatggtgcagcctcttcagaaaacagcctggcagttcctcaaaagcttaaatctagagttaccatatgacctagcagttgtactcctaggcatataagaatgaaagagaaatgaaaacttacacataaatgtttacagcagcattattcacagcagccagaaagtgaaaatgaccaaaatgtccatcaactgatgaatggataaacaaaatgtagtctatccatacaatggaatatcactgagcagtaaaaggaatgaagttgagattcatgctacaacatggaccaaccttgaaaagatatgctaagtgaatgaagccagtcacaaaagaccacatataatacgattccatctatgtgaaatgtccagaataggcaaatctgtagagacagaaagcagattagttgttgcctggggctgggactgggaggctgaggggaaatggggagtggcagtgaatgggtacatggtttcttttggggaagataaaaatgttctggtcaggtgccatggctcatgccaataatcattgcactttgggaggctgagtcaggaggactgcttgagctcaggagttccagatcagcctgggcaacatggcgagacctctgtctctactaaaaagaaaaaaattagccaggtgtggtggtgtgtgcctgtggtcccagctacttgggaggctgaggtgggaagattgtttgagcccaggaggttgaggttgcagtgagccatgatcgtgccactgcactccagcctgggtgacagagcaacaccctgtctcaaatataaaacaaacaaacaaataaagggcaaaattctccctgtctgaaaaagggggcagtgattctttacaaaattgatcatggtgataagcgatggttgcacagttgtgtcaccattgagttccttccttccttccttctttctttctttctttttttttttttgacggagtctcactcttgcccaggctggagtgcagtggcgcgatctcagctcactgcaacctccacctcctgggttcaagagattctcatgcctcaacctcccaagtagctgggattacaggtgcgtaccaccacacctggctaatttttgtatttttagtagagaaggagttttgccttattggccaggctggtcgcaaactcctgacctcaagtgatccatctgcctcagtctcccaaagtgctgggattacacagccaaccattgaatttaaatatgtgaattgtatggtgtgtgaaccgcaagtgttctgcctatccatatacctcccactcaccttccctctccccatctcactgttctggtgagggaggttcttgctttcctttcgcctgtttgggacctcacttcctttttcccttccccatccctttgtagccccttctcaagagagagaagacaccttgattcccacctacgctctgctaaaacttttccgttctagtcttaaatctctctctcttaagaactgatttcccagtagggtttatgtttggagctaaattagtcctcctggaagcagttgacttcatcctccagcagctgtgccatcagcagaggccatgcatgctggggcaagatccaggcctatctcttcctctgcagtcccctggggacgtctgggatctggttccttggttgggccacgcttagctctccttcgcatgggtgtctcaatgccagggtgtcaggagagctacagtagccagctcaggcccccccagggagagctggggagggagctgagggcctggtgccccccatcaggagggacctttggagtctttcttggctctgcccaggccttctgagcacacagagatcactccagccctctgccctctctgtagccaaatgaaaagactcttctagtctttctggccaactagtaagctctttgaaggtgggtaccattcttgacattagaaaaaactcagagccgtttggatactgaatatttttgacatgctctggtcactgaacgagaagactcttcatgaaaatgatgctttgtcagctctgtagagaaaggcgattggaattttggttgaccaggttagggtaagggaagaatgaatccccagtgtcctaagctggcaggcagtcgtgccgatgcagttctcatttctgctgtcaatttgccaggagactcagaaaaaggccgctatgcctttctgcacctcagtttcctcatctgtcaaatgggcagtgttttgggcgtgctgggcacaggtttgtctgagaaccagctgaggcctgtgttgcgcatgggacctactattattctttataatattaataccaaggacatttaacacctgcaacaacaagaacaagcacagtctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattataggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaagtacccatatttagatcttttttactgtggttttgtgatgtgatctgtcatctcctctgggcttgcatttctccagtgacaaggcgctcactcctcccacggcgatgcattccagccgtcgaattatgtagttctactgcttaatccttccttaacttgctcttcctgaagcctcaactcactcatcttctttctcaacccctcaggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgtaaggggacactttgctcaactgttcacttgaacagagtcttcaatgtcttctagtgaattctgggctgaaaccaatgtcgacttggccaaattaaggccacggtcttggtcagccaccttccaggttgacttgccagggtgtcctgggttggtttgttttacagaagcagagctcccagggctcatcgcacagccatggccgaggtgtcgggactcaaattccgggcccttggctgtgcttctcacattctttccattgtccgacgcactgaggcagagacaggaattttaactactcaaaaactactgtttacgtattttactttgacttctttctgggttcttgcataggcttcaaggagggaggatatggatgtgagcttattgtacaaatgccctgggttttccaaacgtgtctgatcttaaatacacagccctgcgtgctgaccttgtgttagaacttaatgatgcgacgtttgctttgcaaactgtggtcccctcctcatagatccttcaattcaacaattgaattcaacaagcccctgggcacccaccgtgcaccaggcactgtgttaggtgctgcagagatgaagatgaggaggatgatggcctgtgcccaggcaggtaacagactagcagaaggacaggaagcaaagtgggcatgtgtaccatgtgtttaaagcctgagggaacagctggtaggatcctcctggggctaggtggtggcagcagcaaagagaggggacatttgaattgggctttgaagggtgcataagagtttaacggggccgggcgcggtggctcacgcctgtaatcccagcactttgggaggccgaggcgggcggatcacgaggtcaggagatcgagaccatcctggctaaaacggggaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagagtttaacgggacagccacaccactgatcactcagaagtaggtgggttgtgaatcttcagcattctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtagccttgtgaaggtttcttttgggtctgagtaggggacgcacagggcatggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgttacctctggtttctgtttaaactgatggccagcaaggtagggcaatttgcctaaggacacgcagctcctaagctactaaacctcccgctcgcctggaagagaagacaggacgggcctatagtgaatcatgagtgcagcatgagagtgttaaaggtcacaggacgcctcttagtgccaagggagttcatagtggagaccccttttgcctgagggactggggaggtggtagttttgaactgggacttgaaggacagactggggtaaaagcaagaggagaagcttgagggaggacggtgtgtgccaggacggtgggactcagagggtggtggggggcacatccactgtccccttccatcctgcagccactccctgaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgctctgattggctttagatcgtcgcctgtgacagcgtttcctccgcggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgccagaaagcaggagcagctgggaagggagagggagggggccacacctggcctacccccagtcaccttttacccagggatcccctgaggaaaacaagctgtgaccttgagccggcaccagccccagggctgaaaccccagccctgtctgaagggttcctttcccgtgtccaccacggccccgtgctgtatagcagccccggtggaaagcctctttctcctgtacctggaggagttgctggaagaaggagaaggctcagcaccagcttctggctaaaatcgtggccgatggctggatgattccggccccactttaataaacaggatagatgtgcggtaacatcaggttgtcaggccctattttgtgatagaaaggatgaggagggaaacaagcacaaatcagtagtgtcacaatctcaaccacttcttccattttcgttaatagaatcggagtctcactatgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctccccttgaggtttgacccgtctgcatgctcccctcgaggtttgacccgtctgcatgctcccctagaggtttgagcagcgggacactgacgaagcgagccatacccccatcacatgccctttgagggggaaaagggaacctttcccgtttcacagccacagtttcctgctgttttctgaaattcctggtggccactcccttggtgtccatgggtgtctggtgtgtgcctatgtttgctgcgggctggctcggcgagggggaggtgggcagctgggggctctctggaccctgcggctggcatgggttagtggctccgtgtcacctggttcctctcacctctgttttcccttctagcccctgcaggcaggagacttcaacgcagagattaagaagttgagatgtctttgttcccagaggaaagtccctgcaggccccggcctcatggcctctgtgacagcagcaggattagaggcagagttggcccagagggaacatttctcccaccctctgtccctcggggaccccacttcccaggtggcctggaggatgaagtcagggctctggcctcattgagggcctggaactctttagagcccatcaggaccaagctctggtggccttccaggcccactcagtggctggcggtcccacctccaaatgcaggcagaccacactccctgaagggcagtggcaaggccaggccagcacctctccactctgaggaaggggccttacccagatccccgtgtcccccacagcggtggcggttttattgatgtattgtgaaggcacagggagggccctttccagagcaggctgcatctcccctcagcttccacactctgaacctgcctcctgcctccttccacagtgcccgccgggtccacagcgcccgccgggtccacagcgcccgccgggtccacagcgcccaccaggtttgatgtgggctgagcacaccgtcactaactcattccttcattcattcttcactgtgtggggtgtcgggacccagcacgggctcctggcgcagcaggcctcagaccctggggagagctttgctggaggaagtgcagtgccaaggacccatgtcctcattccccctgggtagagcgtgtcgggtgactctgctgcggtctccaggagctggcaagggaggggtgcaccaccagggaagggaattccaggcagcaggcaccaggagcctcatccaagagaaagagaagttccctagactcccaggcagggtgagccgaagggccttggagagtccctgaggtcccgtttcatgggagacttctctcacaaagcgaatgagctcaaatacggaagatggagaaatggaaaacagaaacagaacagaacctccacctgctgggtagatgttaactgaatcttttttttttttgagatggaatcttgctctgtcacccaggctggagtgcagtggcacgatctctgttcactgtaacctctgccttacgggttcaagcgattctcatgcctcagcctccccagtagccaggattccaggcacccgccaccacacctggcaaaatttttgtatttttagtagagacaggatttcaccattctggccaggctggtctgaaactcctgacctcgggtgatccgcccacctgggcctcccaaagtgctggcttgagccaccatgccgcccggccttacctgaatcttatcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatctgtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgaggagagtgtacagataagtcatgctttgttttgctctgtctctggaattttaatcagttgccctaattgccttcaaattattggaagggaaaaacgccagcagagggtcctgacagatcccagctgtctagctgaggacttatcttctcattgttcttgggaaaccagtcaggtttagggacttgaggtggatgattcattaattcttttaaactgatttcctcagccatgtacacatgtgtgaaagcccttcttatgttatcagtattaccctaatatatcagagggctaggatttctcataaggcgaccgttatcttttgataatcacataaataacgtttccatagttctcgaaagcttgccagatgctttcatgtacattagctaacttcttaaatttttttttttttttttgagatagggtctcactcttgtcaaccaggatggagtgcagtggcatgatctctgctcactgcaacctctgcctcccaggttcaagcaattttcctgcttcggcttcccgagtagctgggattataggcgcccgccaccatgcctgcctaatttttgtatttttaatagagatggtgtttcatcatgttggcctcagactcctgacctcaagtgatccatctgcctcagcctcccaaagtgttgggattacaggcatgagctgccatgtgtggctgacattagctaatttaattcttacaataatcttatgaattgggattctcatctcttttaaaatgaggaaactgaggctcagagaggttaagtcatgtgcccaagatcacttagctagtaagtgatgggcagggctgtggagctggttcacttgactctgctgccattgcatccagtttgctctgccagcgagtcaattgagcatttggagcatttgctgtgtgccagcctcatggaggcaaacggagcttcggaacccaggtgtcgagaatgagctgttggcactcagtcctggagtggcagcatggggggcgggggcaggagcatgggggacaacagtccagggagggccacatgacagcaagcagagcctcgaatgcctgagtcctggctccagagagaggccagcctgagctcctccatgtcctactcctgtggatagaccccccggaatgcagggggccgggctgagcaagaggaggagaggacagggaaggaacatgtctgcttctttccttcaggaaaggaaaggtgagctgggcgatggggaaggcctccacggtgttctgttgtaacgttctgccacttggcagcctcaccagggacatatcagccccaggctgattatctgcagaccgggatcccatttctgctgctttgggagagaagggagggtagccctgaggccatcccaaatgcgagtctgttcacagaggggctctcctggcaccttccccagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccatgatcataccactgcattccagcctggccaacagagcaagaccttgtctcaaaaagtaaataaaaaataaaacccattctcactctaacccatactgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggagtgctgggcagaggtttaccgtccagcacccccatttctgctgctctgataacttggatcgactgaagaacctcggggctttcttggctgtttgtaggagcttccagaagcgacctttcgggatgcctcttacatagtcctgcctataccctctacacgtggcgtttcaggtctggagagtcatgtggtgtagctgtatttctgggaagtgtgtgacccgaagcctcctcctgtcagaaccaccggggagctcacaagctaaagtgcagattcctgggtcatcccagacctgctgaagccaaatctttagggtggggccaggaatctgcattttaaacaagctccggaggtggctctgaggccagccacagtttgggcacggcaaggctggggagccaggcttgtttcggatctccagtccttgtgtgggctgcgtgaccttggatgagttatttcccatctctgagccttggttctctggtctgttaagtggcaatcttgccccttctgttttaggcactgtcggggttgcctgccttctggtaagcgtttagtgccctgagccgactcagctggtgctcagggaggcctgatgattcggggcgcttggccgggtggtggggtgggacaccccagagggaagggcactggtcccagcttggtggggcaggccacctggaggaggggtggaccttgggagtgggttatattagggcctccaggcctcagtttgggaggagcttgcagtgaccttggagatggtagtgaccttgtcctcctgccctgcctgggtgcacaggctcccagcacgtgggtggcaaaggtcctagagagcacccagaggcgggtgtctgcctggggtcgagtgtgggagctgggcccagagcccccacttctgcctggcatccgggggtccctccgggaagctgaggttgttttcttgaacagtaaggactggccagagccctgagcaccgagaggtgagggtgaggccccccctactctttcccccaccctcctgggaatgactgccgacatcagggaagggaggggccccaaggccagtgacctggaatgcgatggccagggaggcaggagctggaggctgtgtggggcacgaggaggccgatcgggtgtcccgggggagactcctcgctgcttccctcgggatggtttccatgaacttccctccccggccctgacggcctcctctcctaagctcccgcctcctttttttttttttttggagacagtggctcactctgtcacccaggctggagtgcggtggtgcgatcatggctcactgtagcctcgacctcccccggctcaggtgatcctcccacctcagccttccaagtagctgggactacaggtgcatgcccccacaccagactaatttttgtatattttgtagagatgagttttgccatgttgcccaggctggtcttgaactcctgggctcaaacaatcctcctgcctcggcctcccagagtgctgggtttataggtgtgagtcactgcacctgaccatccctccccgcttttatgtccttttctccctctctgaggtagggggaccaagccctcctccccaagccctgtccactgtggggccttctacaatgtgagcttgtacatctctgtgatgtcacccaggtgccaccaggtgtgtgtgtcctgatgcctttggccaccagcctcaaaatctcccagagttccaggtgcttggtggaagggattcatgtacccctatccccatccctaaatgagagtgtccacaccacccgccctgagttctgaacttagccacctcatgtacggaaggagaaatggaggccgccagagaggtctaggcctccgaccctgaccttgctcctcttggatggtattgggtggcattccaggacagctgggatcttgatcatccagtgggtgccctcactgtgcacctgcctccaggtggtggcgcggtaattgcaagagcgtgagcccctcctctggggcatgttcttggaaataaatacacctcgtgtcatggagatgggcagacgaggtgccagctatttgaacggacagcccggagtctgtgcaggagttggaggtagagcgggtcgaaggcttgcggagggacaggtgggtctcccatggatggcttttcttggaggctgcagccaggagccattgtttctcttcccacctgaccttgggtggttccccttcagccctggcgttatgatgtcccgcccaacccccgaccgcacacctccctcccccttagctgcttcgaagccaaaggtgtggcaacagctaacaggtgcttggtggtccccgcccaccctccttcaggctccctacacccacctgagtgggcctttctgtgttcacttcagggatgaggcttggagaagagggtgtgtgagggggtgcgggtggccctccagactggacctaggcctgctgcattctgggttgaggtcctcttgctgcctctctgtgagcgagcctcgcctgctgggtgctgagcccacaccgcatgtcctcggcctcccattgagatcagctatacgtgatatagaccagggatgcacgcctcatgaggagacgctcactcccccagacacactgagtactctttcctcaagctcagtgcagttcgtccacgtttgcccagcagcacgcctcccgcagcgttgtcaatatttattcgtggttgccgctgcctccctcctggaccgcccattccctgggccctgtctggtggtggctggccttggagagctggcctctcagcacagcaccgggcaccagggctcaaggtcagtgggtgtgtctttgggtcccttaaggagcaaagtctcataatttgctttattttgttttattattattaattttttttgagacagttctcgctctgtcgcccaggctggagtgcagtggtgcgatctcgtctcactgcaacctctgcctcccgggttcaagcgattcttgtgcctcagcctcctgagtatctgggactacaggcacccgccaccacacccagctaatttttgtatttttggtagagacggggtttcaccatgttggccatgctggtctcgaactcctgacctcaggggatccacctgccttggcctcccaaagtgctgagattacaggcgtgagccaccacgcctggccccttaatttactttaaataaagatctggttctcccagatgaggttcacagacagatgttccaagagcacatctgtctggcatcaggagactcacccataccaagctcacagtgctggccatgatccgactcccgccctgcagctcaagcttggtctggagaccttctctggcacctgccccggctccccagccccgggcttcctgcattgtgtgcttccactcccgtcttctccactaggagctctgtggtacgggctttctgcaccttgacctctgggcctcccaccacagcacggtgaaggcaccaactatttcactgctagatccaaggatgctggggccgggggcagctctgagtgtgtctcatacagtgaccttgtttgaggaggctgtgtaggcccaggattttcctggggtgagggacgccaggttccttgatgtgttgggacaaagacgttggctgggcgaggaggctgcctgagatcccacagtgaggctggccctgcccttgctcgcccagctgatctgacaccctccagatggcccaagagagaccgggaggagcatctggtggaggacctgggtgttctgtctggagatttcccattgcttttccagtttattgtcatctgcttgggacttgagggtaacttcatctctcaaaataggctgagactttttacagttagatatttaatatacagatgacgggcggatggtagtgttgttttaaggggggattttgttgctgtcgttgttgttgttgttttgagacagagtcttgctctgtcacccaggctagagtgcgagctcgatcatagctcactgcaacctcaaactcccaggctcaagtgatcctcccacctcagcatcctgaatagctgggactacaggtgtgcgccaccacgcatggctaattttttgtagagatgggatgttgccatgttacccagactggtcttaaactcctgggctcaactaaaattttaatctccaattcatacatttcagaaagtataataatatgtaaagcaaaatcataatagcaacaacaatcactgtcatcccacgggttggtttagatgtaaattttatgcttccttgcaaaaatttgtcgaaagtgccagaaaagcccttgtcccatatcacagtcccatgacccacactcccatggaaagccttagaactgatgtcagtgtgagccctgtgctggagtggagggtgacagagcttcggacatgagcagcctctgctgctgcggccaccctcgccggccctggatccccacacagtgtggggtgttcaggattcctcatgtgacccttaccctgcctgccctgggactgtgtgcctgtgtgcttgcatgtgtgtatgtgcgtgtgtgcccatatgcgtgtgtaggtgtgtgcatatgtgtatataggtgtgtgcatgtgtgtatatacctgtgtaggtgtgtatgtgtgtacatgtgcattgtagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggtgtgcgtgtgtacacatatgcatgtgtgtgtgtgcattgtgtgtaggtttgtgcatgtgtgtgcatacgtgtgtgtaggtgtgcatgtgtgtgcacatatgcgcgtgtgggtgtgtgtgcagtgtgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtcaatatttatttgctgttgctgctgcctccctcctggaccgcccattccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggacagcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgagatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgcggctaaggtgggggacgagggttgtcggtgggggaagccccatgggggcccactggagtcataggagcgaatggagcacccactccatgccttctgtcaattacaaagcacctattatgtcccggatactgtgtccaacacagtggacacattgatgggtaaggcataatcccccccaggagctcccagttggatcgaggaggcagacaggcgagcgtatggctgtgacacccccagcaactcccagttggatcggggaggcggacaggcgagcgtatggctgtgacacagtggggcaagtggcgtcaccaaggcagaacccagcagccggggcctgaagcccccacacccagctgcagccttcccgaaacagctgagatcagcctggagagctcttcctccctgcctgcccggagggtggcgtgggtcccatcgctctccgtcagccacggccagagcacacctgtgctgctcctcagcagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgcggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcgggtgagagtggcagcctgagagctgcgacccggggccggggttttcctggagcagcaggagggatgagttgggtttctgtaactacaagggccaagaagagggagaggatgatctgggaaggagagtggctttgggccagcatttgggccagcaggactcggaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccccacggtgtagaggaggcgccctgatcactgcctttcagccgtggccctgcctgtaatcttatcctttttgttgattgttgttggctgatgttggctgttgctgtgtcctccaccagagtggagaactccctggggccggaccccttgtccttattcacccagagaataggtgccttaaaatactgactggacagaaggaggaagagatgggttggggggccgtgtcatggaagaattccttgggccagccgcagaggagtaggccttggcagggagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgtggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacgttggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttgaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctctttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacataccgtattgtattgtgtgtagtacaatacatagcgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctggacagtgcttgcaaaggtaactggcattctgccggctgctcaactctgtggacaccagtgcagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccgagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcaagacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtcttttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcagtcgggtgcggttgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagcgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgatgagaaagttcaagtgtgggaaccgctggggatcttgatggcctgggtcctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagaacatcatgtcatttgggatccctgatggcacattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggtgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctagtaggcatgtcccctcaactccccagttgtaataaccaaaaatgtctccagacattgccaaatgtacccgggaaaatcactcaggttgaagtcactaaattatatgtgtgtacatataattacacatgcatatacatcgcgtacacacacacacacccacacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggatcctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagaccccgtctcaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagtgtccagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttactgctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcctgcctgggccaccatgttgatcctctgggtccattgctcaagagcccaccatggctccctgttggcaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccgcatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcacgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggttttgattccagacagtccagccatgcagcccctggccttgccacctccctctgccattctccagagactcggagaggggcctaaggcctgacatgaacaaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaatgccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagagggaagatgcctctgtggagctggtcactgagagtgctggccaggcagggctgcccccaggaagctggagacagtggggcctttgcaaccagatagcgagggacctcaatgtggagattgggtgtgcttgctgagcgtgccagcaggcttgtgctcacctgctccagctgggggcatgcagaggcccctcctaccccaggaggatgcttactcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccgcggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggcggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagttgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcccggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatatacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttcttttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtctccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccgcctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggaggctgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctgagttttgcgtctgcccgcgggagcccccattcctcaggccgtggcccctgcactctccaggcaaggcgggtgtgctgcgtgccaccgctgttggtaaatccggcccctcttacgtccctccagctgtccccgcgtttataaatcttgcacagcctgttcttcaatatctgcctaatgccaagaaatactcgtggaaataaacgatgactgttcttggcagatctgacggtcaggcttctgcctccccccagcccttccctctccttctccttccacggtttcaggtcgtaggaaagccacattccaagagaggacgggcatagccaagggtgcagtcaggctggacccagaggtggcaggcctggttctccatccagccttcgccgctgccgtcagtgcttctggtcccagcagcagaaggcccagctgaagaagtgggggttggttggtctcgcctgccaagggatccaaaggcagcatcgctggggatccccaggcatcagcttgtctttttttttttctttttttaagagagagtgtctctctatgttgcccaggctggcctcaacctcctgggctccagcaatcctttcgcatcagcctcctgagtagctgggacctcgggtgaacagcactgcgcctcctaatcacagtcagcttttcacctcaggcttgtcttcctggggtgcctacaactgctgttgtggttctgggcagtacagctgacatgggagcatcaagaggcagggagagaagcctctgtcctcccactgagggacaggaaaaccctccagaatctgcccaccaccccgtccccaccagccccacatctcatggctgaaaccatggcctgtgttcacaagatgaccatgtcatggccacggctggcttacgctggtcaagatggcccttggccaaggtggcatctgcctcccccagagggcatagggttgggaaggggtgagtggaatggaggttctattaccaggacgggcactacggcgtctgcccacctgcctgctgctgtcggctcctctgtgcctcagtgtcttcactgtaggggatggggggagctgggtggctcaaggtcacatatgcaaagcgcatggcttggaacctgcctcccagcaggccttcagcaacagcagctaatttgttgattttagtcattttaatattttttaagactccatgtctcttttaatagaaatggtgagtctgtttgccaagtgccttctgagtcaatggcactgctagagctatttcatagtaaaactctccatgcacccagagccaccaagccttgatgggggaaccaggtggggtgcgagatggaggccaggtgccctgggcagatctagcttgctacaaagaggcaagacggtgcctttggcaacactgcctcacctggaagaacagccagtgaacggcttgaattttataaacatttaactgggactggcaaaggttaaatcaagagtgcttgttgtggggagggctcacttatgatggggacagagtccaacagaaacagatgggagtgaccactacattagtcagggttctccaggaacagaactgataggagacatgcatggatgggaggggtgggtggatggatgggtgggtgggtgggtggatggatggatggatggatgtatggatgagtgggtgaggggatgggtgggtgaatggatgggtgggtggatgcatagacaggtggatgcatggatgggtggatgga

SEQ ID NO: 13766 - DNA, 10597 bp, Human
cggcacggttttgggggcggggcacgcggccgtcgggcgggttaagagcggctagcggtagtgccgctcgggcctgggggcgggcaaggtctaggggccggggcaacgacgggaggcgggagcgccgcactgccttggaggcggggcaacgcttggaggcgggaacgcggcacgcgagcgttgggggccctaagcgtcgcgacctgggggcttcggggaggtagccgtggacgtgggcagagcgcgggcctcgtggtgtgcgggcactgtgggccgggcgagccccttcccgcccgtgtggtgagtcggcctcggcgcccggttctgtgacatcacagggggtttagtggcgcagcctgcgggacagaggccggggatttgaggtggcctcgtcttgtttgatctcggggaacctcggcagacggaaagctttgatgctttggtgcatggcagatagagaggaaacgtgtatcttcgtacatttaaagtttcctttcctttttttttttttttgatagggagtctcgctctatcgcccaggccggagtgcagtgggcgcgcgatctcggcccactgtaacctccctgggagggaggggtattactcttctcagcagtaatatcaccctctcgcccccggcttagttttcttttggaagagatcagctcattccagcctcttccctcctcccctccagattaaagagacggtgagggtctggtgcggtggctcacgtctgtaatcccagcactctgggagaccgaggtgggcggatcacctgaggccgggctttcgagaccagcttgaccaacatggggaaaaccgctctctactaaaaatacaaaaatcagctgagcatggtggtgggcgcctgtaatcccagctactggggaggctgaggcaggagagtcgcttgaacctgggaggcagaagttgtggtgagccgagatggtgccactgcactccagcctgggcaacagagcaagactctgtctcaaaaaaacaaggccgggcgcctgtaatcccagcacttcgggaggtcaaggcgggtggatcgcctgaggtcaggagttggagaccagcctggccaacatggtgaaaccccgtctctactaaaaatacgaaattttctgggcgtggtggcggacgcctcccagctactctggaggctgaggcaggagaatcgcttgaacccgggaggtcagttcaaggccagcttgaccaacatagcaaaactctctttctactaaaaatacaaaaattacccaagtgtggtggcgggcactgcagtgagccgagattgtgccactgcactccagcctgggcaactgagactccatctcaaaaagaaaaaaaaaactgcaaagagatcctctccgggttcgcggcaggttggcttcttgtcaccacctgctagccttgggacagtaacagatgacttccactcccgaatctgtggagggaactggtggaatcgccatgggccctacctgcgtggagtgctggaagcctaggcggaaggccccagagtccctgagagcatctgtagggacactgctttggcggctttgccgcctcagagagccatggtcagggcgccgcggccactggcagaccgactagatggcctcagtgttggctcctcctccctgggcagctgctcctcctcccagccactttttggcttgaacctcaggagttaattttattaatcatttacccaagaaaaatatgaacttagtagccctttttaagagtcaggatttttggtggcaacgcttgccagcttagttctgtctgtgaaatgttggcttaaaagccgaattgtcatgagcattccttgaatgtcttttactacacctcggtgtttgttgctatagactattgcatgtgcattacatgcctactgtaggcttctgatatgcatatccacatgcccatcatgggtggcctctgtatttcccctgcactgagaagccgttgtgttgtgtcgcctttaggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctggtaagaggaggtgggagggaggagcgtttttgtgaaatgactagagtagctgaactcagtgtgttgaagaacttgtgagaagattccctgggatgctggcaaataagttgcgtatcctctctgtgtgggtctgaaggagtagaaactcttcctttggccaggcatggtggctcaagcctgtaatcccagcactttgggagggccaggcaggcagatcacaaggtcaggagttcgagaccagccagaccaacatggtgaaacctcatctctactaaaagtacaaaatttatccgggtgtggtggcgggcgcctgtagtcccagctattcaggagtctgaggtaggagaatcgcttgaacccgggaggcggaggttgcagtgagccgagatcgtgccactgcactccagcctgggcaacagagcgcgagaccccatctcaaaaaaaaataaaagaacaaaaaaagaaacttttctttcatttctgaaaaatgtgctctttctatggatggatcataccttgctagctacgtggttaatgtccgtgggatgaaacctacagattaatgtgagaaagtgaaatttacttccccaggggaatctcggggtggagcttaggttctccagcctagtgtcagaatatatcggtagcagctggagaaagcatgtactttgacatcagattgccttcgttgggtggcacctctgccctcccgtggcagccgactccttaatgtgagttctgtgagttgggtgcagtaagtcactcttgctttttgtttttttaatttgctacatctgtgaaagtacttggaaaaattgcatctcagcttggagaagctgagaactgtaggttgctaacagaagtggaaattgtgattgtcctgggctggaagcttgctctgaaagaagagtgtagaaagcagatttggagagggataggaagggcctgtgggttgtcgggagggttgcagaagtggtgggcctggcggccaggagctcctctcagagttccctgcactgggctcttgtgtaggtttgggagaggtaaacacgttgggaataagctgagaaagcagagtgcctcatgcagccttgaaacccactgggatgttgaaaacagggttaactgagtgtctagatgattctgtgtaaaggtattgggagcattgtgatgaattaaatcccttttaaaatttaaagcaaccttttaacatggtacttttttttttagtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtttgcagcttcccaggttgccggaagacctacttcaaaagttcccaccttaaggcccatcttcgcactcacacaggtaagcgctggggcaggtggggcattgggcacaccagaccctgtggttaggaagcacaccttgagccgcctttggctgggaggggatcatgagaacccctggcgaaggtggaagtgtggctttttctttggttctgaaaagcccgcacaaccttgtaagggtgggattgtttgcacagccatcaggattttgcctacagagcgctcgccctggaagataaaatgtagtatagttctgtgattgtgtcttttggtagcttttagagtgacttacagtgcccccttctgttcacattgcagtagacgtttcatcctttttttttttttttttttttaaagaaaacatgcattcattcacatttagtaaatgtatcttaccagtgtgacttatgtttatgtgagaaaaggtctggccaaactatagaaaagttcaaattctaaaatattttttaaaagagtatagttttcttacctctgagagtagtttttaatttaaagtaagtcacacaagaaactatgctgacctaatgatctctctgttgtctaaccagctctgtccaatataattttttgcaatggtggaaatgtttgttgtctgtccattagggtagccactggctgctcacacttgaagtgtgtggctagtgtgcctgaggaactgaattttacattttttagtatttgaagtttaaatagctccatgggacctgtggctgccctgctgcgcagcagtggtctgagtgttgctggatagacaatcgcttcagtaggtgagggcaccatttctcaggtgttctgtgagtttgtgttctgttgctctgatcgtggtagcctccacgtgtagaataaagtgcagtctggtgttcagacattataagaggaactctactactccattctactgagtggctgcttgctttgaggataaagccaaacttggcccatgaggtactcacctctgcccattcagaaacagcctccccaacattctatgtctggttccatatttccacccttccctcttggccctctgcccatctctacttactgaaaccctctgagggccttcctaggattagttattagattgtttctttatcttccttctttgatcctagtggtttattgtaggtcttactatagtctccctttgttttttagttagttgtatatctcacctggatatattcctggtgcttgataaaagggcctgacactagtcagtaaatgagggttggttgtttgcatggcagatggacgtggggctgtgtcagggaacgggtgtttctgaggggaattgacctgcctgcctcttttaatgggcttgttgacttggtgagctctgcatttcaccgggactctccaggggaactttgcattacaccagagcacggcttccaaatgttggaggtgactgaatgaagttttaccgtttatttggtttaccttggtagaagtactgacagaatgacctgcagtgattgaaacaagttgcttccatgtttcctaaagtacttccaattcaataacaggccttgtacaggggctcacgcctgtcatcccagcactttgggaggccaaggtgggcagatcacaaggtcaggagtttgagaccagcctggccaacatggtgaaaccccgtttctactaaaaatacaaaaattagctgggccttctggcgcatgcctataatcctagctgctcaggaggctgaggcaggagaatcacttgaacctgggagatggaggttgcagtgaatggagattgcgccattacactccaacctgggcgacagagcgagactcttatctcaaaaaaaaaaaaaaaaaaattggccaggcactgtggctcatacctgtaatcccagcactttccgaggccaaggcaggcagatcacgaggtcaagaaattgagaccatcctggccaacatggtgaaaccccgtctctactaaaaatacaaaaatagttgggcttggtggcacgctcccgtagtcccagctacttgggaggctgaggcaggagaatcgcttgagcctgggaggcggaggttgcagtgagccgagattacgccactgcactccagcctggtgacagagtgagactccgtctcaaaaaataaaaataaataactgtaagagttctgaagaatccccttgtgccattttgtaaacttggaattttcatgagaagtagaaactgggcaagtttaccttggataagattgctttttgtatatatttctgccaacctgaaaaatatttaaattggagtaaggtagagtgaatagatgctacctttttttttttttttttttttttttttttttgagatggaatcttgctctgtcgcccaggctggagtgcagtggcgcgatctcggctcactgcaagctctgcctcccgggttcacgccattctcctctcctgcctcagcctcccgagtagctgggattacaggtgccagctaccatgcctggctaatttttttggtatttttagtaaatacggggtttcaccatgttagtcaggatggtctccatctcctgacctcatgatccgtctgtctcaacctcccaaagtgctgggattacaggtgtgagccaccatgcccggccggtgctactttttttttcttttttggacagtctcactctcacccaggctggaatgcaatggcgcgatctccgctcattgcaccctccgcctcccaggttcaagcgattgtcctgcctcagtctccggaatagttgagattacaggcacccaccaccacacccagctaatttttgtatttttagtagagacagtttcgccatgttggtcaggctggtctcgaacttctgacctcaggtggtctgcccgcctcggcctcccaaaatgctgggattacaggcgtgagccaccgtgcccagctggatgctacattttttatttttaattttttgagacggagtctcctgtgtcgcccaggctggagtgcagtggtgcaatctcggctcactgcaagctctgcctcccgggttcacaccattctcctgccttagcctcccaagtagctgggactacaggtgcccgccaccacacccggctagttttttgtatttttagtagagatggggtttcaccgtgttagccaggatggtctcggtcttctgactttgtgatccgcccgcctcggcctcccaaagtgcttggattacaggcgtgagccactgcacctggctggatgctacatttttaattaatttatttttgttttttggtaaagattgggttttactttgttgcccaggctagtctggaactcctgtgctcaactgattgtctccagcctcccaaagtgctgcgattataggtttgagccgctgtacttgtacttcgcctgatttatttttaaatatattttgaaagattagcttgaaatctttgggtgctaacatagctgcatcttaagtgtgggaggaataaatgccttttggaggatttcttgacccaaatcatccaattccagagtaataagataccactttcttctgagtttgatgaacacgattttaaaatgacatgaattaaccccttgaataaggtgcttagcgtttcctttctctttaatatgtattttctcacctcacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacccgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttctgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcata

SEQ ID NO: 13767 - DNA, 11826 bp, Human
  misc_feature (1)...(11826): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggatggcgacttcacccggcctttaacaacacgtacgcatctttcggcgtcttctacaatggctatgttaattacgtggccaggaactaaactatcaatgaagccacctctgactacttcagttacagtgagtttaacaggagcaaaaaagcacgtggcgccctagggcaaccgaaacgagggttttagacgctgattatgggaaattgaaatctgagttgagtatgagatgacaccaataaattataattttgttagataatagctttatcagccataaagtaatcaataaaaataccagtttcctggagatggatgctttagtgtgtttggggtgaaaatggcgatgaatggcgagttgctttaaacaaatcatggtacaccaaagttttagttgtggctttgtgtaaggaatgtgatgggcacttattcctgcaacacgagaatactatgatttacaagtccgtagtacttttaagaaatgagagaaacagacctaggtggggagggtacctgtcccaccccaccctctttaaagtatcttatctagaaaaggctttgtgaaaaaaaaagtcccgggtctctctcaataacagccctgagcgcagctgttgaagctttctcaggttaatgatttctttcttggatcttaaagtttctttctcttcctttatttttggcattttgcccgttgcagggcctggcaaatcagaaagccacatagaaaattaaatgaaagctattgctaagttccagtctctacaccagtggagttttcaaactcctcttcagcatatttgacgcccaatgagtagtacattaattcctagtcctaaaatcattctgtgaactttctcccaggaatttttgctcagtttgcaattaaaacaactttttttcttctctttttaatggcagaggcggggtctcactatgttgcccaggatggtctccagctcctggcctcaaacaatcctcctgccttggcctcccaaagtgctgggattacaggcgtgagccaccgcgcccagccacagtttgcaattcttaaggcaagggtgacaataggggtcaggggtctgacaggagacaggatttctgtggaaaactgcaccaagggccttctcgccatgtcccgtagtttgaaggtttacaaaggactgcacattttacatgagtcatctcaacgaacgctctcctcaccgcattaacagtccacgcggttacgagtcccattttactcacggggacaccgaatctgtaagaagcctggtcgcttgtcccagcaaaacgagccacggggctcagcggccctaacttttaggctgtagggtcctcgccgaccaccccgccaaaatgtcaggcctcggggcccttgcacccccaccgcagggacacggatcgaaagggtcgcagcaacgcctcccccgcacccaggagcgttttccaggcctttgcaccaacctcgttggctaagccccctgcccggcggcggcccggctgggaggaggtgctttcgggaggcggggccgcggcccggggatcctctcgcgcccgcgggctccaatcgctgctcctcacgcaatcctaaacggttcccgggcgaaccggggcccgcgcgcgccaaggccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgaaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacggtgagcccgcggggagggcgctgcgggcaggggagggaggcagggaaagcgaagccgctcctcactcacacgcgtctccccgcagccgccggccctgagcgggacccgcgtcctggccagcaagaccgcgaggaggatcttccaggagcccacggagccggtgagtggcgggcgtggggcagaggggccagggacggccttgggcgtcttggcgccaaagccgcattgtttcctcagctgttcacactcccgccccggctcctttcccgcctaggcggcccctccccagggctgcctcccgcgcccctcggcccatttcccggttcgggcgtgcgctcctctgctgcgacccacggagtgcgacgggacagccacgttttcacatcgggccccgtgaaattgccgccaatggaaaggacttggtccagaaaaacgttagtttcatatggttcgcccggtacttaaatgttttattttctcccccaacagaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtaatcggaggaccccagaagacccctgcaggggtgaccgtcacgcctcagacataaatgcacttggaggttcccgttggcaaggggggctaactgtggggcatagtaagtggtgccagcatacttaaagtttgagtgctcagtgtgagtcctgtaggctttactctcttccttttatgctaaaattgtgacttccgaacctcaggtggacctctccaaggacattcagcactgggaatccctgaaacccgaggagagatattttatatcccatgttctggctttctttgcagcaagcgatggcatagtaaatgaaaacttggtgagtttccaaaacatctttcattcatttgacgttgacgatctgaggtcgaactagttcgctttcctcgtcttgtacgtttttccatgctgagtgcatctgtgtgtgtaagctgggttttatattacatggcatttcctgttttgtaacactttgcagttctttcttatggtattttcccgactctagagaagctgagacaatattaagtggtagcaatgtgatgactctttgtggccaccacatctgccccctcttttttttttttttttgagacagagtctcactctggcccaggctggagtgcagtggcgtgatcttggctcactgcaacctccgcctcctgggttcaagcgattccccaacctcagcctcatgagtacctgggattacagacgtgcgccaccatgcctagctaatatctgtatttttagtagagacagggttttaccatgttggccaggctggtctcgaactgctgacctcaggtgatccacccaccttggcctcccaaagtgttgggattacaggcgtgagccaccacgcccggctctgctccctcctttttgtggctttgctgttttaataataatttggttgtatctcttattgcgaatggatctttcttgacataaattaattaggaaatcgagcgctcacaaatcctattttatatgtatctatttcctgatatgtaagttgagcatatgacataaaatatcaaagaactgtgacaaattggatgaaatatatatagaaataaaccttataatggtacaaagagtgcgatgctgccagtatccgttgacagttgctgctgttggttttttctcaagcttaactttgatgtgttttgccactaggtggagcgatttagccaagaagttcagattacagaagcccgctgtttctatggcttccaaattgccatggaaaacatacattctgaaatgtatagtcttcttattgacacttacataaaagatcccaaagaaaggtgagtattcaagtggtatgccaagatttttaggactcactaattgttgatttattacacatttttagttcacctagggataaaaatgactccagaatgactaagacagtcataggcattcccagcacccgtggtcatgtctgctcttagcaaggggcctaaatgcactttattattcacttagagttgtgaaggtactccttttaaagttggatgtctaccaatgtaaaaccttcttttgaaaaaattcctagatgttgggtaagacaaactaaaacctatgtctgaccatctttgctcatttggtaaagttgttgagaagctagaatgtggggctgcagtgggatggacggggaggacttgcctcctaagaagcctgcagtatagtataggcaaataagacttagtaggagttacataaggcagaggcagcagtgaaccctgagactgatttaggcatgcaggagtttggctgaataaaggtagcttaaggtctgttttgttttggagattggaggtggggggattagaaatgggctgctggagtagtctagatacaaaggtcagctttagggtggcgcgcggtggttctcgcctgtaatcccagcactttgggaggctgaagcgggcggacaatgaggtcaggagatcgagaccatcctggctaacacggtgaaaccccgtctctactaaaaataaaaaaagtggtggcgggcgcctgtagtcccagctgcttgggaggctgagacaggagaatggcgtgaacccgggaggcggagcttgcgctccagcctgggtgacagagcaagactccgtctcaaaaagcaaaaccaagcaaaaaaaacaaaggtcagctttggggaccagaaccttgtatggagtggaagtggtgaagctgcaacctaaagtagccgttgtagactttgaagtacatgaagaggaaaagtggtaacttgaaaggactgaggaaacattgggagtaaagagatttgaacatgtttataggtggaaattgagaaaagaaggcaaagattaggggtacgatcgggggcaaatgcccagaaggggaacaggaaggtctgctggggaagcctcaaaaacaagggagaggcagacccaggtctcagagagagggacagtgagatggaaagaatgaacgacagctgggcatggtagtctgagctagtagtcccagctacttggcaggctgaggcagaaggatggcttgagccctggagtttggttttaccgtgagctgtgatcatctcgctgcactctagcctgggcaacagagtgagaccctcatctctttaaaaaaaaaaaaaaaaaaaaaaaaaaaaaagctgcccaatgtctggtgcccttggcttcagaacacaaagtcatctgggtaggaacagtctgggaaatgagtagcctctcaaggtgggcaccagaataaagggaggcagaggagggtggtaagggagatccagttaactgtagtacccatggatttgctttcctgacctgggatcgacagtgtagcacagagtcctagtaggaagcaatcttagtttattggtttaattattttatgatatagatgtggcaactgaggccaaataatgcacctaatcatagtctgataatagcacagcagttaggattttatggttcttcaaatttaaattctatgattcttcaaattgaacaatgatctggacttgaaataattttaaaggcaacaaatgtccctgctgtactggactatgttttactgtctgtagaccctgaagctcaatatgaactacagaatacccaaacttgtattaatgtaaatcaagtgttgaggtttttaaaagaacactggagggaaaaactgaccagtaaaaataaaacatttcggtgtgagttcttcctttaggaagaggattggcaaatacttgaatttggcctttgtcccagagctcttatctagcagttggtaatcggaggtcttttactgtaatgcttcaattgctgataccgtatgtgcctactagggaatttctcttcaatgccattgaaacgatgccttgtgtcaagaagaaggcagactgggccttgcgctggattggggacaaagaggctacctatggtaaggagacccttgcccctacttaaacctgagcttcattttccaagtaatgttactggatttttggcccttgaataccaactcactagaatcatgttggtgttaactcctaaataggtgaacgtgttgtagcctttgctgcagtggaaggcattttcttttccggttcttttgcgtcgatattctggctcaagaaacgaggactgatgcctggcctcacattttctaatgaacttattagcagagatgaggtgagtctaagtcaaataatagggtgacctaaaccccaaacacaactcgggcatgctcttgtgttcactgacggggacctgagatgctagatggcatatatccacatttaatgtgtgagttcaaccatacacatacttgacaaaagaaggaaatactttcatttactgaaactgttttacttgcattctcaatatattgtaatacatttgtacatatgtattcccctataggctttgaatgcataaaactacaagttctttgttttttgaggtgacggaatcttgctctgtcgttccaggctggagtgcaatggcgtgatcttggctcactgcaacctctgcctcctaggttcaagtgattctcccgcctcagcctcccaagtagctgggattgtaggtgcctgccaccatgcccagctaattttcgtctttttatacagacggggtttcaccatgtttgccagactggggttgaactcctgacctcagggatcaggtgatccacccgcctcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaaaaagaatgttcatagtagccattatgttttctcctgtttgatctagaaaattgcccctctacttcaatattaataagcatttcaatgaaatgagtatacattttggtctagtgtatgtctttgattaagtcacatttgaaaagccaggagcatgaactccatcttacttggagcccagtgggcaaatcaaatatggttaccttgtaggagggccttccttactggattgggagataagctgtgaagcttgatgtttaatgcagtaacttgcaaacttgatttacttgaaattgcatacaaatttcctgagcatctaaaaactagccttattactgagctttgcctttcctgctgggagtagtggcaaaattagcactcatggctgtagaaagatcactgagtgaagctctgactcctcctttgccaacacacagcagagcaagaaatacaccttgcctgtcttcatctaggtggcaactttgagggtcttgaatgggactgagcttgccttggtagtgacatcagcagagaagtcagtagttgaagtcatcttccctttgagagttcaagtgctctcagtatggctgagcatgttggataaggagaatgcagaaaaggacaaagtaatttcatattccatgttaatgacagaagtcttctggctttagtgatcttgaacttttttttctagggtttacactgtgattttgcttgcctgatgttcaaacacctggtacacaaaccatcggaggagagagtaagagaaataattatcaatgctgttcggatagaacaggtaaagtgggtgatgaaatgggtcactcaagcttgctagaaaatgcctgtgctttagttgtattcagaagctgtattttggttcctaggagttcctcactgaggccttgcctgtgaagctcattgggatgaattgcactctaatgaagcaatacattgagtttgtggcagacagacttatgctggaactgggttttagcaaggtaaagtattgtttacatagccttttgcttgttttgaagctggtgctctgtatttatatcttgatgtgaaccttttcaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataatttttttttttttttttgagatggagtctcgctctgttgcccaggctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtcagtttcttgattggtaaaatttgcattttaattcaggaagagaaatattttttggccaggcatggctgtaatcccagcactttgggagaccaaggtaggcagatcacctgagctcaggagttcgagatcagcctggccaacatggtgacaccccatctctactaaaaatacaaaaattagcctggcatggtggcacacgcctgtaatcccagctactcgtgaggctgaggcaggagaatcacttgaacccgggaggcagaggttgcagtgagctgagattgcaccgctgcactccagcctgggcagcagagtgagactgtctgaaaaaaaaaggtgttttttgtaaaggctaacgaattcatttgctttccactggttctgggcaagagacttgccttgtgcctattggcacaaggtgtataggagacaggtacacccgaaaggtggtgcccaaaaatactaactgccatactgcacgtggggtttgtgaagccggggctgagttaacttctcaaccgtgggggagccactcctggggctcttttcccgtttgcaaaacaggtggggctagaggtcttcccagctggagttttgctctgctgtcccacatctgacctgtgtggactccagcacaggtttggattggtccctgtgtctataaaggccctttcctgactcggaatcccacccactttgataaagccttttagaattcatgacacccatccccaaacgaaccaatcattccttgtacctcacgccactgccattcagttcattgaacaaacagcagctctcttgtcaggtgacgttttctacctgcattttaattcaggaagatggggcgctaagccagaggggaggcccctccctctggagcttgggtttactcctagagaggaaaactgatagatgagtagatctgaattgttgggcagtggtgggggcagcagagaattctaaggtggatgggagtgattgggagaggtctcatggggggagatgatgtttccttagtggaggggactgggactagtgtctgaggttgtgctgcttccgactcctgtgttctcatgaagatttcttcc

SEQ ID NO: 13768 - DNA, 96866 bp, Human
  misc_feature (1)...(96866): n = A,T,C or G
caatatcgtgagttttcagataagcaagagattgagagctttagataaagctaccatctacaatattggtggcaaattctgttttgttttgttttgttttgtttttatagaagtttgcaggccaaacaaaaatatatgtgggtcacttgccatttctggttttggtacctgtcatagcaggtacaagtgttattacagcattttcgctaatctctcagtgtatataggaagcagcttttcagtttatatagcacttttgttttttgaaagaaccacatagaagcagtttgatggagtttttaaaaagtcatgttgtttagcattatttgcaatagccaaaaggtgaaagcaacctaagtgtccattgaccgatgaagggataaacaaaatgtgctatatacacacaatggaatattattcaccctcaaaaaggaagggaattctgacacatgctgcaaggtggatgaagcttgaggacgttatgctaagtaaaataagtgagacacaaaaggacaaatatgtatgattccacttatatgaagtatccggagcagtcagattcatagagaaagtaccgtgatggttgccagggttgggggaaggaagaaatgggttcttcaatgcgtgtagagtttctgttttgcaagatgacaaagttctggagacggatagaagtaatggttgtacaactgtgtgaacaaccttaacactactgaaccatacacttaaacatggttaagatagtaattattttattttattattttattttatttttatttatttattttttttgagacaaagtcttgctgtgtcatcaggctggaatgcaatgatgcaatctctgctcactgcagcctccacctcccggattcaagcgattctcctgcctcagcctcccgagtagctgggactgcaggcgttcaccaccacacccagctaattttttgtattttagtagagatgaggtttcatcatgttggccaggatggtctcaatctcctgacctcatgatccacctgcctcagcctcccaaagtgctaggattacaggcttgagccactgtgcctggccattttgttaaactttaagatgataaattctgtcatgtattttaccgtaatcttaaaaaaaatttttttctaagttatattgtttaatgataacacatagaacagagctacaggaagaaataaacaccagaaagggtaatgtatggttaatacgaaatcattagaccatttaaaacaattggcagtagcttacaggattttaaaatataggtaggaataaaaatataacagtacacaaaaggtaaggtgggcaaatagagttaaattattgtacagttcatttttaataagtggtgaaattaccaatttaaggtaaacagtaataagttaaggatggataattagaatcacaaaaaggataagaaatcatgaccaaaaagatagtagaggaggaacaatggtgtaatacgattccagttaaatcaagttcaaatacaggtaaaactgacagagtccaaatagtggctagctttgggggtggaggtggacattgactagatgagggcacaggtacaccttttctctagcaacgtgctggcgatatgtctttatattactgtggggagtggttacacaggtgtttacatatgtaaaattcattcaactatacacctatattttatgcattttaccgtatgtaagcttttacctcaataaaacagaaaacagtaaaaattgaaaaataactttttaactaatagcttaagacaggggtcagcacgctactacccacaaaccaaatctagctctccgcatgtttttgtaggactcgtaagccaagaagggctttatatttttaaatggttggaaaaaatctacagaataatattttgacatgtgaaaattatatgtaattcagatttgtgttcataaggaatatcttgttagagccacaaaaaaagttatattgcttaaatgtaatttctttgtttctcagctaataccactcgaatattccaagggaccagaatagtgaaaacaggagtggtaagtagagaatgggaaattgctttgtcgtggctggttgttaatttgcttgcagttaaaactgtcaccacgaagtggcagtataatgttgttaaactgctcagtgtaaagcggttatagtagagaaaaaattacattattcactttttataattcagtaccttatgaacacaagctgtgcaacagtgttaggtggttatattatataattttgtgaaggtaaaaattcttcatatttttagttatgatttgtgggatcagacgatgcaggaccacaaaggagttaaatctgttccaaccctttcatttgacatatactcaaattcagaggttgtcatttgcgtaaagttatatggatctgaaaatttctggaaccagaattaatatcttagtttccccattcctggttggtataatgaataattaaaatactaatcacagcagtggtgataataataatagcctaaaattcactatgctcttcctgggtttcaggcacagattattttatttacttctccaggcagcccacaaggtcagtgttactgttgttcccgttttacagatgaggaaaccgaggctcagtgagttaaagtaatgtgtccagcatcacccagcaggcaagctaaaattagactaatagctcagagcagcacttcttgttttcctaagataccttatgtgagtaaaacccccagacttgagccccagtttagtatggtggtaagaacaagccgagtcttagacccaggcagccctgcatttgtgccttccaggtcatgtaccttgtgtaagctctttaacatctctgtgtctgagtttcctcacctgcaaaatggggtgatgatcatgcctgcctccagagtagcatggaaagccctggcacacggttggcatttgttaattggaattcttgttattgttgttgatgttgttgtcatctgtatgggctcagattttcccacggatcaacttagaaactgcaaggtacagtgactctgcagtgcccaacatggagatgcagagatgtaaaccagtgcccagagcatgcagtgcagagcatggctcctgcctctgaccctgtcattgcagacctgggcaggctgctttccctccttgtccacccacttcctcactgggagacagtggggttggactggatcacccagtatctttccagacctagagctgagtatctactcaagtgtcagtgatatacataaaatcaaaggtcttctgcctctcatcaccccaagaacagatgaccatctgatttttccagttcatgacttctttgttgtgtaagtcagctttaacactacttagtttttttggcacctagcctcatcttgggtaatatcagtgaaaagctgagtttgatcgactagttatgcgttttaacatgttcacaattataaaaccattaaaaataaaagttgatcacccatggaccacctaatgtcaactttatgccatacattggaaaactccatagcatagatgagtaaaatcctcagagggtgacaaccagggcctcattcccaatctcaattactgatgcttctctgctttttcttcttctgcctcttttccacccttgccgggtgaccctttccagcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccaggtaagtggtgcaggtcttcttcgagggttcctgctcctgtgaatagtcgtaccctttttcaaaaaattgggagcagaaggtgaagcttcagaaggtacttaatattcttagaatcatatatgtctgtcatagaaaaggtgcacacatgtgaaatgtgtatgtgtgtgtccctgttttactccaaaagcctactctcttacgctggagtaagtctttctttgatatttgttttcttgcctcggaataactccagggacttcaaccaggcaatgatatacatgaataaaaaaagccatcgatcttaagaagtttatttattaagatttcattccatattcattatataatgtatctacaaatggctagtttggtgccagggactgggcagggtgctgtcccaggggatcctagtccctgcctaaaaagtttaaaggggaaggcagacagatgacaagacagtagctagctggagcgcatgcccagaagttaggtagcaggaacgttagaaagccagcaagctagatggtggttagtcggcaagctagatggttaactggcaagctggaaaactaactaactgaagttttcgattgtgaaatggtaatagaggaaataaacaggatgctgtccaagagaattatggagaggatagggacctaccttaattaagaaaggccactctggagaagtggcttgttcatggaaacctacagaatgaaaggcttcagcctggggagagctggtattggcccatggtccttgcccaagaaatacggccctctctcccagagctcccattgctgtgggaatgagccagtgtatagacagtgaggccagggcatgagatcctcatctcctggtggcaattttgttgctctatcatatgctcaaatcttaatgaaccatcctgatagtttctgcaagggagccataagcatgaggagttgttattgttgtgagggcttttcttaataagaaattcttcattttgccagactacaagatgtttagcaacaattttttttgcgtctaagctgttgtggagttataagagtgcaaaaaaaaagcaactggtaaatatttatttgcttttgcacttgtaaacattaaaattcatctaaagctgagatctcgtatgttaagatacaacttagaataaattttcatgttttgaattactttcctcttaaagctgctatgaactaattttttgaagtgggggtctcctgtgggtattgctcactttagctgtgactgggggaaaggtgcagagtagccttttgtggaactgagtgaaggaaatgtggggccacttgggaagctgtttctgtaagaacagtgacattccctctaggaattactttgaaaaagttgaatttcttgcatttgaagacgctgaagaaacatgtacggaatgcccactgtataagaggcaccaggctaggctttggcagtagaacataggtaacacagacttctcttctcttggggtttgcattctggtaggggagcttgagaatatgccagtaaacaaatacatacccttaagtagccttaattgctacagttggggagcggagggacagtgtagctctgagtggtcaaggatgacctctgagcagagagccaagtggtaagaaggagctagccatgcaaagatccagggaggggaattctgggctgcaggaacagcaggtccagagaccctacagtggggaattaatttggatcagttgaggagctatcaggccagtgtggttagaccagagggagtgagggggagaggaggggatggatttagagattgatggaggtgctctggaaaggtactcgttgaccacgctgaggatttccttctactagaaatgagaaaccagggtagatcttggctgcagtgttacttgattgattttttgaaagacctctcaggcctctgcgtggagatgatataggaaggcaggaatggatgaaagaagcccagttaggaggcagtggtaatggtggcttggaccagtgtgttttctatgaagacaggtggtggacttggaattgactttcaagcttgagtgttcannnnnnnnnnnnnnnnnnnnnnnnnnnnnnnnnnnnnnnnnctgctcctcttaaacatttgtttgaccacattcctgaaaaatgtggctgctgagagcttaggctgggagtatttacagtttgagagatgggagagaggcagggactgggaccgccccaggtaagtggaaatgagttcttgccattggagtcaggttccagattccagagacaggggagaagaaatggatggcaaactttgggggctccctactccaggtatgaggtgtgtaggtcctcggcttccaccctacagaaatctgagagcatctacaatcttggcagagtggctttgggagtcagatcaacccagttggctctgtcccttattcactcagggtcctcaggtaagtcttagtcccgtgtcctcgtttgcaaagtggagctaatgatcatgcttaatgccgaaggtggtgtggctgtggagaccccctcactgtcactgacaaataggagctgtcagcagcccaggtgccacacaatgatggtgactgtgaggaggccccccacagccctttcctttgctattgtctgtggacattaaagctactggtccccaagtaactgccattaaaaatgacctccagatggccgagtgcagtggctcactcctgtagtcccaggactttgggaggccaaggagggtggatcgcttaaatccagaagttcatgaccagcctgggcaacatggtgaaaccccgtctctagaaaaaatacaacaattagcagggcacagcggctcatgcctgtagtccagccactcgggaggctgaggtgggagatcacttgagcctggaaggcagaggctgcagtgagaagatcacaccactgacagagcaagactctgtctcaaaaaaaaaaaaaaaaaaaaaaaaaaagaaggacctcctcctgaaactcaacactggtaaatcagagctttcccttatcaccttcagcaaagtgagaaggtccacttctgaaagctaaaaaaaacttccttgaaaatttcaagcagttcaagtctgaaaatggtggtgatgattgtttaagccagatataagcaaactttttcagctaagggccagagagtaaatgtttttcagttttgcaggccacaggtctctgctgcagctacttaattctgccttgtagcacaaaagccaccatagacaatacacagctgagaggatgtgatagtatttcaattaaaactttgtttgcagaaacaggcgatgggtctgatatggtccacaatctgtcatttgccaacccctggtttacacagaaatctgcatgtgcctgttgattagtaaaggacgtgagtgacctgaaggtaaaacaagcaaatcccacatcagtcaatgatccttcaggtcttgcttcacttccattcaccctgtcctttgccctgtctgcctcctccagtatggtatttattttttaatgaaatcgccatcattttaatgttagtgatttattttaaggactttgtgtgtacatttgctttaaatctgttacacatttattttttcttcatattaaggaaaaacaattactttaatcaatacctggtctctgaaaagagtgataatgtgtaaagttacacactgttatatttttatgagtatctccaaacagcttgtttaaatccctttggtgtttcataacatatttttaagtcctgtgagtagtggctttaatatattatctcccagggaagaagaagaagggaatccttctatagaagaagtggcaaacccagacacctacagaaaccagttaatactaatgagaaacaaggaccaggtgttagacattagggagtggtaaggactgcagcaaattaaagagcacatgacttttctaaagagggccatctcactcagctccaacagattactgccagtgagaatgcctagtgagccagaaatccaggtttttgtgcagaaccccccaacttttaagtaagctcaaatttttaaaacaatttctgctttttaaaaatgtaggccaaactaaacccatccctgggccaggtaggaaccgcgggtggtcaacctctactgtagtgttgattgctagagttgcaacttcctgagaagcctttcagaaggcttgaaggcctaggtgtactccctccctttcaccaggcttttttctagcgtttctttagtgcaaagccctcagctggatgtctgctacatggaaatccagcatgtggtcccatcctgaggagccacagcgtgagcccagaagccaactgatgcaatgaaatgttcttgggggtactatgcagtacagcataccctacaaaaacatttcagagtgggcatcatctacaaattcatcatttggtgctgggattttccatttttgtttccttaaattagggaaactcttttttcaggttgaatcttgctcagaaactcagtatgtgaacactcattgctgaaggtttactgactgcatcttctggctcagccctgagtcaggtgctaaggggacattccacttcaggggtcggcataccacagcccgcaggccacttccatcccctggcctgcatttgcatggcccatgagctaagaatgaacacaattgggcagaggctctgggctgctattctgctttgagacagagtggagggtgcaaagctgcagccactctgctcctttgggcaaaccatgaggcgcctctttggaactcttaagcactaaggaactcaacgtgaacacctttaattacagaaataataacagcgtcaccagtgaacatttgtgctagccctgcctatgcagaaggccagctgcatatgtcactgatcctagagtactcccatgaatgtcgtactttgttgctgtcatgctggtgagggaagcgaggctcagatgaaggaacgtgcccagagccacacggcccatggcaagacagagcccaaatatgggctctgactctatagtccagggggatcttccccatgtgatgctggctttggcgccagttcccagaatgagcaatgccagatgatttcagatgcagtattaattaagtgaatattttaatgtgtgcttttaaaaagagactaactttccattggtgacagtggttctcaaccagagggaattctgtccttctccctaggaacatttgggagcatctggagacatttttagttgtcataactggcactggggtgctacttggtgtctcgtgggtagaggccaggcctgttgctaaacgtcatatggcgcacaggacagctccacaacaggaaccatctggtcaaaatgtcattaatgccaaggccgagaacccctgatttatagtattcatgtaaagtttccttattgaagaagtttacttgaggacaaatagagtagtaatttaaagacaaaaataagtaccagtacaggttcatgcagatcgggcagaaatcatgaatgcagtacccagctgtctagggattgggagcactgcagcatgctttatttaaaattagttacatcaggcacttgtaaggactatcagaagtacttttcagccagtgctagttttgctcgtcaggtttctttctagagaaatgttttctttataattctgcccacccccgtcctggtctgtcatcttcctggcatgtccgtgggaacaagctcagggtaggccgaaggggttattcagctgccagtatggtttagtttcttctcagaaagtatctgggtccttggagtttctattgcccactgaacgatctttgaattaagacacatggtaaatctcatggtatggaaaaccagaccccactaagaacaattagatttccggagaggttggagtcaagaattcaggttgcagcaggtggcatatttggtataagattggtgtacaacttctgtccgtgactgatttcagaaccacgtactattgcaaccaactgtcagtggtggccgtctgataggttagggcttgccgtcttttaggggcttggaattaaattaggatttatcaaatgcctccccactttcccaccacctaattgaaatagagatgacagaccatcattttgattgtttgagtctggtgaattaagctctgcatgaaatggtaagggagcacttattcacaggaactcttggcagtgatataaatggaaacgaatgatgctctaatcctgcccacacgagttaacacagagccagtgtcctgttgcaagagaacatatttatttgtaactgatgaacaatcatttctctgcagcagtggtttgggtaacgtcagggctccagaaaaataaaaggccagttttgtggccctgtaaaaacagcagccaccttatcatttcacacccgttagaatggcttctatcaaaaatatagaaaataaatgttggcagaaatgtggaaagaagggaaccctttgtgcactgctagtgggaatgtaaaatgtgcagcccctgtggaaaatagtatggtagttccttaaaaaagtgaaaccagaattaccatatgatttagcagttctacttctgggtatacacttgacccttgaaaaacagtcttgaactgcttatatccacttatacacgagttttcttctgtctctgctacccctgagagagcaagaccaaccccttttcattctcccctcatcaacctactgaaagatgatgagaatgaagacctttatgatgacccacttccacttaatgaatagtaaatataaatatgttttcttccttaggattttctttataacatttttttctagcttactttattgtaagaatatagcatataatacaaataatatacaaatatgtgttaactatttatgttattggtgaggcttccggtcatcagtaggctattagcaggaaagcttttggagactcaaaagttatacatgaatttctgactattcagggattagcacccctaatgcctatgttgttggtgggttaactgtatgcccaaaggattgaaagcaggatctcaaagaggtatttgtagacccatgttcatggcaacattattgacaatagccaagaggtggaagcaacccaagtgttcatcaatgagtgaatggataaacaaaatgtggcatatagtacatacaatgaaataactgtttagcctgtaaaaggaacgaaatcctctcacatgctacaacatggatgaaccctgaggacattatgctaagtgcaatgagccagtcacaaaaagacaagtaatacatgattccacctatatctagcatagtcaaactcaaagaaacaaagtagaatggtggttgccagaggctgatgaaaggggaaatggggagttgtttaatggatatagagtttctgttttgcaagatgaaaaagttctggagatcagttgcgcatcagttgcacaacaatgtgaataactaaacatcactgaatgggacacttagaaatggttaagatggtaaattttgtgttatgtgtttttccactatttttttttaaagcagccaccttaattcacagatgtgggaggtttttaatgagtggtatggctcagaacaaatatgttgaaattccccacgatggaaacaggctataaatttataagtatgcatatcgtccttctctttatcttccttgcaaattaaagaatcttgctcttccctactcctgatagaggcctcttggatccaagctagttttagtcttgacaccagagcggttcttgtcctgtagcagaagttgagcccttcctggagggtaggaggcatttcagatgggtccatctgatgtattgctgccggtagcatttatagtacattgtactccgtttttatttgcttctactgggatgagagccaagccagtaaaaggcaaacagcattaattcagtgatgacatatgccactgaaaactgtttttcttttcttttttttttttaatttttttttaaaaagcagaatggaggcactttactcagattctgctgggtgctgaaataaagacggagagaaagaaaggctgtacggagagaaagaacggctgtggggaggttgttaaccttaccttcctcctgcatacgctcagagagggttcgttagcattttgctccaagtttcatggggaagacatttcaggagcaggctcattctttgagtctgggctctaactggcctcacatcaccctctgagtagctgttcacctgcacattacatccactgggggagtactgggtatcagttgatactcctttcctcattgtcatcttttctacacacagatccaaatgtgctgaggagaatggactatgttatatgggcagagcaacagcatggttagtttctaattggcctaaaaataaaatctcttcaaaaataaacagaattggagaaagctgctttgtacagaaagagcctcttctcttgagccaggttattggtatcaggatcatggtgagtttattaaaccatgatttttactttcgtttttgaggccttttcaaaagacccgagttagtgttgttctgcagactcattgggtcagagtgccatcttgcaaactgaaaccaggctggccagagtgagcttgcagtgggagttgggagtgaggaaagctggtctggtgtgacattagggagtagtgacgactgtggcaaaccagtgagacgcaccctgtctgaagggagtgtgccgcttggttccaactgatgtgtgccacgtgggaattcaggcttttgttgccaaccttgaacatttctagtggaagctaccattgctgatttttatctgaattcctttgcttattaaatgttggtagctatgtcacaattaaaaaataactacttggaaggggtgtcaaaccagggttgccagttcataacccaagtcaggcaggaattgaagggctagtcctgctgggaaaactacatcatctggatgaaccagagatggaggtgaggaggagctctgttaacccagaggtcctgtccttatcttggtgtcacaatttgggcatcatggagggaagcaaacccccagtaactgggcagctcagttctgctggacccttcaggaggcagctaggttaccagcaaagctccgagtgaaagtgtgctgctcctgacagaggggagcatctagtgttactaaactgtcagaattgttgtttggctccattgaaggaaagaaaagaatgaacatttcttgggcacctcctctgtgtcaggcactgtgcttggtacctgactgatccagagcagcttcataagcaggcagcctgtgcactcacacaggccctgtgctcagaagggcctatgcttgctttcatactgtctcatactctactgtcaccttctcaaaactctttaataactttcgaatgggccccatgatttcattttgcatttggtcctataagttacatagccataacttacatagtctgttttcacacggacgatcttttttcatcctcaggactccccgagaggtgagtgttaccatttgtctccctttgatacaggagtgaacagacactcagagatgggcatttacccaaagccacacagctggaaaggcctaagtcaaaatttgtactcaggtctgcctgagtctggggtgcagaattgcccatcttgtggcacgctgcagctgttgtaccgaaaggcctacagcatgttctggtctctggaggcctaggcatggggaagtttagcctcatggattgtcggtgtctgagggcatataatgatatgggtgtatactcagggccacattttgtgtgttgtagtagtcctagcagcttgctgttttattagggccacaaattgagtcagggagcaggacgggtatttcttctgaaggacacagcaagaagtacgggggccgtgcacagtggctcacacctataatcccagcactttgagtgggggctgaggcaggaggatcccttgagcccagaagttcgagaccagcctgggcaacatatcaagaaagtgtctctaccaaaaaaaagagggaaaaagcagtatgatacagtctagtctcagggcaaactgagattctagctctttaccagcaatctcatcataggcagccctttgtgctgatactcagcacatctgaagttctgtatgactgccacttacacactcagatgttacagagaggagtcagattcagcaaacacccggtgagtgctcaccatctcctgctgctgtgtgagggtgctgaggaagagagtggtggtgatgataagtaatgatgctgttgctaggatggtggcgggtgatggtgttgccgaagctggggtggtggtgatgacaataatcacaatagttaacattaaccaggtgccaggcaacattctaagtgttttgtatgcattaactcatttaatcttcatcccaccacaatgccgtatgcaatattattacttccatttacagaggaggagactgaggcacaacgaggttaggttagttgcccaaagttgcaaagctagtaggaggcagagctttgtaactgttcttccatacacagacggaaatcagccctgcctttggggacctagagtaacaaaagagcgattataattgagtatgatgtgtgcagtaagagcaacacaagatgatgatagtggtggtggtacttgtcatttgcttgatgccaggcacacttctaggtgcttacatgcaccttctcattgaattccccaacagtcctatgaagtaggctcttttcatcccatttgatagatgaagaactccaggcccaaactggtttaagttattggttaaaagtcacacagaaaatggccaagccaggatttgaacctataatctctgctctgcccttaagagatagtacaaactggcggcttcgggaagcctcacagagaaggcagcatttgaaccaggactgaaggatcaataagatgaattctggcatcaggaaaggaaaggcactccctgcagtaggaatgggaggggcaaaggcagagaggcgggaccatggctcagcatggtcactgattaggtgagtgtggctggaaccgtgacagggaacagcaggagatgatgctgggttggggatggaaggctctgctcctgaagagccttgctttccccactcaggggtatcctgagggctatgaggagctacttaggaaagtgacaggagcagatttgacttggtcacctggagatggaatccaattccaggttcctggcaccaggaagacaaagcagtattgtgaatttgaaaatgaaatcaactttatcatgccccacatgaaaattcagtcgctcttatttttgcttggcttttatgtaaaagacccaagccaatgaaactgcctgccattagtcaaggtcagagtgaaacttgtcagaaaaacttccttaggtctctcactgacactacaagttattgccaacctgagagctcctccacagaaattaccatttggagactgtccacagtgggatttcagataggctccaaccccctacgggaaccccccccccccgccaattattacacactttcaccaaatgttagagggagaaatgactccattgtggaaatcaagtttgagcccagctctgacctgggctgtgactcaagagccttgtcttcaggaccttcattctctctctatgctggtggttctcactttttctggggcctgaacctctctgagaatctaatgaaaactgaacactcaccctgtagaggaggagagggggacagacattatcaccaacacagagatgcccctgtggcttgagggacgatataatgtgccactgatccacacaaccagatggtcactccctaaccccttcccaaggccgagaaattctggagtggtcacttttcactggttttagaatggctgaaatatgctgggcgcggtggctcacgcctgtaatcccagcactttgggaggccgaggcgggaggatcacttgaggtcaggagtttgagggcagcctgagcaacatggtgaaacctcgtctctactaaaaatatgaaaattggccaggcgtggtggcacacacctgtaattccaggtacttggagggctaaggtgggaggatcgcttgagcgtgggaggcggaggttgcagtgagccgagatcatgcactccagcctgggtgacagagtgagaccctgtttcaaaaaagaaaaaaaaaaaaaatgatagaaataccacagaggtggtattgccagtgattgtttagggatataagtgtgagggactattttggccaagagttcctttctgtggttcgggatgaataggacatggagtttgcattctttgtagcagcacaggcaagaatcctgttctgtaaggagtgaggagaggaataagacactgagagtccctcctgtacccaagggcttcacagagtggatactgattttaactgaacatgtggcctatagcgtcaaccctcccaacattgttttccattaacaggacatccaggtctttgagattcccccccctcccccaccagccagataattgcctggctgggccacccccttctgggaccccacaaaattattcttatttgcaactctggttcctctggccagccaccagagctctgctataaaagcattatgttgatggagagaaggcatgcctgatctttgtctgctttggcttaaaaccctgcagtagtttctactgctcttacgactaaattcagtttctttatttcagcctaaaaggccctggcttcatctgccttccaattccccatctgggtcctcctccctctcattcttgaactcccactgatttgatggtctccgtgcagaacacccttcttccccaactctctgtttggctaactccccttcatccttcaacacttgccttcgttggggagctcatggagacctgggcttggagagctattcccctatggccccctgtgcttcccctggtgccacattcattgcattctaattaattgttgttgtgcctgcctctccccatttaaaagattcctccccatgggtacagcagtgctactatctgatgtactgatgtgtccccatcccctcgcaccaggcctgtgcacagtaggggcttggtaagaatctctcctatctaatgaaaaaatggagcagggagttaggaaaatgggcaggcacagctaggaaggcactttataaatggcaaagtgctctgtggaggtttttaatcagagtgtgctgcacctacttgactctgtcttcttacctgtgagcaggggatacatcaggtcctgtctgcgtcacaggcctgtgcctgaaacaaaggaggtggtcaacatcaaatgcattagaggaaatccagtgaaacgcatcgtaacacacttcttcctgactcgggagtcttgcctctttaaaaatctgctcccatagccaattctttcttccctactcagcctaccttctctcacctggaaactcaacctgattagctctgcatttagtccatcctgcagagggacactccgggctggctgaacgctggcctcgtttttgcagtgcaggaggaatccttgctgggctcaagtcagcctgcagccaatgttagatttttttaaggggcttctccctgtgatcacaggcaacctttgctttttcactgcttgcctctgtgcacctgtgctcttcccagccccagcaccccaaccagggcttcatttgggccacctggcatgttccgggcatcttcttcacagtggaagggaagataggatcttctgctgaggctcctggggacttctgaagacattcagggcctggagaggtggaggaaggagctgcctggttaacaggtattggccgaccagagagaatcctaaactatttggcaagctttccctgctaacctttagattgtggctgctggttacagacgtgctctgggaatagggtgtggtatggcttcctgtcttgggaaagaaaataggagcttttggaaggatctggggtaggtgataggatcaaaggacaaactggagaagcatattttaggaaaaacaggatctctggggatctgggtggtaggagcccacggacagaagcacctaggtgctcctgctgggatgtgctgttgctcagtcttagagtcggtggttgagattctagggcaagatgtcattgtcctggcttgagtgctaaatcgttgaccagagcagggagccccacactccgatgattgtcccaccatgactgtgtctgttagggaaaggtggtttcccaaagcagaattggggtgtagttgttactacaggaaagagtaagggatgctgagcagcaaagaatagatggccatcgtagtcacagccagttctcctagttatcctagtgaaacccatcatgccagccctcttgcccttgccctagagaacctgagaggctcttggacagccattccacccttgcttctttgagacttcagcacatgtcctcagcacattcaaaggctcttctgggtcggtcatgttcttggggtaaggctggaatgtctatgtcttctgtacagctgtctaaaaacaccttcaactgtatctgtaaatccatataactgccaattacagaatgcagcccatagaagaggccctgtgtgggttgggatggggcaggaaatggtgagggctgcggattgcccctcctgtcatggggcagctcagagcaaatggcccagttcgccagaaaccacacaaaactggaacagaactctgcatcaattctggctcccacctccactaacctctgtcctctaactgggatgatttctcttggcagcggaaaaaaacacctctggaatgataagccgccctgctccagggaggatggagtggatcatccctctgattgtggtatcagccttgaccttcgtgtgcctcatccttctcattgctgtgctcgtttactggaggtaagccaggcagcacctacagcgtagatttgggggccagatgctggccaggttttgctcacgggaggggaatcccacggcctctgcattcaggaaggtgaggtagcttaagtgtttctggtcttgccacccggaaggccatcttgtctctgttagatgatggcagggccagatccacttttgaggtcaaggcatttatggtaagcttctgggatttagtaccaaagaggtttttgtttgagaaccagggagatccaagttcagatccaagctctgctacttgctagatccaaatcccgtgtccactttgattgttagtttcagaaccagcaaaatgagttaacaagtcatagcatttgcagtttttctgagatgatgcttactttgttgtagtcacataataactcctctttaccttagaattttttttcatagtctttcactgaaaattaaattgggtgataggaaaacatttagcatattatgtggtatttaatatatgtaagattaaaatggcagattgtaagctatccggattctcactgcttctcatgggaagccaggttgcagcctctgtttagaagttgtgttttttcagccggaccgtctcagccagctcagctgagcaactccgtcaagcccactcgtttggcctgggtgccctcacctctcagactaacgtaggaggcttctgccctttatctgacaggcttcaccagtgagaaacaggtgtcatattttcatctctccctcccttctttccattcactcaattttgagcccacactttgtgccagtcttctagacacaaatgatttctgaagaagtgagtaaaacagataagaatccttactgtcatggagcttacagtttagtggaggaggcaggcaataaacaaagcaaataagtaaaacatgtaatttctaagatggtggtaactggataatggagaaagcttaaatctggaaaggggaggggcccatgggggcctagcaggagtgttcagagtggtcaaggagatgatacctgagcaaagacctaaaggaggagggaaccaaatgggctccacctggggcaagttccaagtagaggaaacagcacatgcaacggccctgaggcaagggcatgcctggtgtgcaccaggaacagccagaggtcagtggggctgagacgtgaagacaggggtaaggtggcagaaaagggtatcagaaagaaacaaggtagagcaggatcgggtcatgctgcacagccttgtgggccattgttaatgcactgcctttcactcgaagatgagtagggtttggtacagaagaatgttatgatttgacttgaagattacttggctgctgtgttgaatacagactgaagaggagcaggggcagaaacagagaccatcggggagactactggactagttcaagaaggacacgattgtgtctcagatgagggtagccgtgtaggtggtgagaattcattgtgtatagatctattttgaaggtgggagcaacagaatctgctggcagattgggtctgttcctaattggctggaacagaagaataaggaaggaggtcatctcaggtttcctcgggcgtctgacggtaaccataagccctttagtgctgcagaccagcaagtttatgaagtatgttgtattttggggtgagcataggaacactagactcaccttcatgtcatcccttctccaggaaaaagtattgtgcaaatatgtttgaagcccattggtaaactggaggccacctagtgtgagtttaactaatcaagtgaggttaacaaggtcagcatgcctatctcttggctctgctcagcactgtttggttttagtctcagactgtcaccacaggggagcagagaagtcccacagctgccacagcataaagaaacactttgtacccagcaattctggcaaaaccctccagattgtttctgactggcccaccttggatcctctacccacccctaaatggatcacagtgaccaagaaggaccatggggccaaacaggcatcaatacccagccagccaaaacatgagtatttactacaggtttcttatagggaagggctgtgtcatgtagtaaacagctttaaaatccttccattcaagatgtattttccctttagaaaatgacaactgtttatacttctgaaaatctcagtgagtccaaatggaaaatatgaattgaataatatcttaatatttcctgtctgaaatatttttatgatgtttattatacatgtatgcatatatttcatcaaaagcttcatttaaagtaaccagagctttaaacttcatccaacagagtctggacttgagcttttaccaaattcctactcccagtagcacaaaaaatgagtgtgaaaaagaaaattcttatagagcaaggaaagtaaaattaaattagtgttaggatgaatgagttggctaagcatacagcctagaggggacaaggaccttttttctgtccaacttttaaaaaattattattaatgcgaaagaagaaagcattggggagctcacatagaaaattggtaaatacagaggagacatgcgtttccctttggcaatgcagttttttagctagaacaacagtgcttttcttctgccttttgaggcacagtaagactggatgattggcaaacagacttgacataagtagagcattgaggcagatcaaaaccttctggatcatttcttcaggaggcaggcctggcaccggggggttcaaacctgctcactgtggcagcattttctaccacaaccaaggaatggccctttgcagttattctgatttttgagtgtgttttctccaagttgttgatactacaacttaataggttcatgaaatagtggaaaactacactcaaggtctctgaattctgtctcttccaagtctcccgctgtacagtggtgttagtgctaatgttcagtgagtccttttgagtgccaggcactgtgccaagcacttgggtggcaccaactcatgtgattctcacaacagatctgtacggtaggtactatcactgtcctttctatttgacccacattctttgaccaaggaagagaacgagaactcacatttgttgaaagcctgctatgggccaaatagttggcaatatcatcaccagaacccttttgttgttcagaacccttttctattgcagttgacaaaaatccatttcaaaatgccttaaagctcaaggggaaaaaaaaaagtttgattcatggaattgagaagttcaggagcattgggcctggctgaatttgtaagatggaacatcaggacttggctggtttggtctgtctgtgtttctcttgccgtcagtttctgggatttgctgtctgtgtggtcttctcgctcaagcaggccctctgcctgtttgtacagagcagcctctggccatgttagacttacatgtctccaccccagtgcaaagggaatctttcttctctaatagttccacttaagtcccaacatggcatctcttattactgacttctgtcatttgtccataccccggagtcgtctggtggccaaaaggatggaacattcttgtcaggcctaggtcttatatttaactctggagctcagaagtaggatcagtaccattgccatcaaaaccttggactgaagccgaacaagggatggctttccaaaggaccatcaagacctaaaaaagtgagtagaaggttcagctaagtattctgttacttaaaaaattataaagctgtttctattgcatgtgcactggagccattttcagcttcctattatttatgcaatgcttacagagttcctgccatgcatcctggtgggcctagagatttagagatcaggtcccttggccctcacagtccattggaagaggcagatgagtaaatagaattgagtatgggggagtatttggagaaggataaatccaagttgctataacagcatataggaagggcttcagcccaacctggaataggggttggggtcagggaaagctccctggaggacctgggccttgaaccacaaccagctgtcagccaggtgaagagggtgtggaagaatgaggctggggagaaaaagcctggcctactgcaagcagataatgtggctcagtgttgttggagcagagtgtggggacagcaagggccggatcatgagggcctcatcgaagggagatgtgccatatcctgaggatgatgggaaggtattgaaggagccaaaactgcaggagggcaagatcagaaagaaacactactgtgtctagagactgtaacacgggcctatagtcacatagcctggatttggagccacactccaccacactgtttatctgtgcagctgtggagcatgtgttcctaccagcagtgctgtcatctctaaggtgtgaatttgttttggggagatttttataaacttattttgtgtataaagcacagatttacatatacataaatagcattgtgcattcgtggtattaaaattggcactgggcaattgggggggcggagtctaaaagggcccctcagaggaggtgccaatgaaaaacaggttgagaaacactgctttagacaaagacttctccaccaacttcggtttcctcatctgcaaaatatagttaagaaatgggccacaagttcacgtgaggattcggtgcaagctatggaaaatgcttgtcctggtgcctggcacatggtgaatgtgaggtagtgttataccagatctgactttagggaaaaatggaaaatgtaactctgggtcctggtatgcctcaaatgaagtttttttttaataaggaaaatcaaatgtacagagctaaatgaattttgtcctttaaatgtcatcacattgtatagctgtacagagtttccaatatgtccattgcatacaacatgcttgaaaataacttttggaatttctttctagagttcattcttttagaaggatctcagttgtgcaaagtatttatcctagaaatagataaaactcatctgtttagagctaaatatagcataaatgtaggttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccagtggcttaataacacacaaaggtttatttcccacccacgtgtaggtctgacagggttgagccgccctcctccaccagtggtttctctttctggaacacatatctcccaaactggtgtagcagggatagagaagttgaggaggcaccaagctctcaactgcttggcctagaagtggaacccttcactccttcattcaccactggccacagatggtcacacagccccaaggacacagatgaggtagggggaacacgtgggtatttgttaagcactgccacagtattcttaaatatttaaacccattggtatcattgaattatgtatatgtttcctgaaagggagaactttggagaccaatcattagtctgtacttaaaatttggctgaaactaaaaaccatgagcagaaacctcggatacctgtatgtctgagagacctcagacatcagtctcatcggggactatttgagcagtgtttttataggcagcaacatggatctgtggggagacatttattctaaaatgtttttagctgagctgtttcaggtaggacactatagttctcccttgaatgtccctcgcaaaggtctgccttgaagagctgtaggaaccagaatctgtaaaaacacagaagttgctataaaactaggaagaaatgtaagcaaagtgattttggacaaggggcagggttgtgaggcagataataaaaataaaatcaactaacagttacagctttaatggcaccctattgtgtgccttataaatattgcaatccatacaagcatgcagtggttcagagctattggaaataaggggaaaaaatcaattcaaaagttttcacagtgtgccattttggtctttttacttaagatggtagtaaaacataccttttgaattccaacagtcagatactgcattccaagagcttcgcatcccctgccttaccaagacaagctgtttttatggcaataatgtgctgacattcctgaaaagacttggagcagcacagctgctgccactcagagagaagaggaaaattttggaaggtttctttttgatttacataatttgaggttaatgctgggagaggagctatgggagaggagctatgtgcccggtgtccaatcagtgtgctagggggtgcaacttattagttgtgctgtagaatagcatagctattaagagccagacatttctgtctgcttagaattgtattacaaagatatttttagttttgttttttttttttctgtaatcctgagggatgttgcatagaaggtagttcttattgctctgatgagcaatatctcacccctgaaatggctttgtatatctgaaaaggctttgtatatctaaaggttcttaagcaaaaaacctttttttttttttttgagatggagtttcacttttgtcaccgaggctgtagtgcaatggtgtgatctcggctcactgcacctccacctcctgggttcaagcaattctcctgcctcagcctctcgcatagcagggattacaggcacccaccaccacgcccagctaatttttgtatttttggtagagacggattttgccatgttggccaggctagtctcaaactcctgacctcaggtgatccacccgcctctgtctcccaaagtgctgggattacaggtgtcagccaccacgcctggccaagcaaagaaccttttatgactatgtaccatactagacatgtgctcagcagattatacccccacctaattagtatacgaatcctgggaaataatcagtattgttatgttcattttgcagatcagaaaacagaggcttagtaagatcatgtgacatccccaagtcgcagcgttaatttttggtggattgtggatttgaacccagacaatttgacttcatagcccactgggttagccaatacgttatcttgtccagaggaggagtagcatgcctggtggcatatacttccctccatagcctacttttatagtgcatgtttatgtgtcaaaaagacactccaggaaaaggggatgtctctgctgctggacatggtgggagtaaactggtttggaaggccagatataaatcatcctttgttttggatttgccaaaatcatgtggaagaaaacttaagaaaccaattatattttcaggtgttctggaagctaactagtggtactcactcagttacatctccattatttgagaagatttttatgttgaataatataacctatttggtcttagtcccagctgatcagtgctagttttcttgatattaaatgtttaatatcttattgaccataattctagcctagaaaaagacttgcaaaagtatagagcagctttacttctcaaattcagataggactgagctaactgcagattctggaacagaaaactggaaactccctaagtgggaattgtaacatctgacccaggtttgttaaaatttggtatgagaaggatttcacactctgatctggtagattcacttcagcacatgaccaagccatctgtaaattctgtggtaaatcagtcaacaccaatttagccacatatgcaaataggaaaaggtctctcttttactctaagtcccatctttagattttcagaaattttgccatgtgttggtgcctcctcattaagaatgctgttcatgaaaacaagtgagttttgttgacattgcaattttttttcttccctggatgttcagtgggagacagagtgtaataaatatgaagggatgcaaaccgcaaatgtgtgggggatttgtgttggcataatggaggctcaggcaaacaaacagatgcatgcgagagtcgagagtggcatgtggtaacacccctctcttgcttgagggatgactgaccacatgtgcctcactggaacacagatccctcctgtactgccacagtagcaacaatgacaccagagctgctgtgagcccaggcacatgttcttcacccatctgctctagcggccgacacttccaggtctacttgacgatgactgggtttttggtataggtgtttgtccccttttcaccccagcaaagtcacaaaggagacaggtatcataagaatgacttctcacatacaggtaactgtgaagacgtaggaaaggggaaacacccctgttaaccagcaataatagctgaattaatacaaagaacaccttatgttatttaatcctccagcagccatgtgtggtaggcaaggaatcagggactgcatcattcttgtcccaagagaggaaacggtttccagaagggggaatgacttgtccaggatcatagagcttgtaagttttagaatttctcagacttagggttttgggttttttgttgacctaaggccctttatggctggcctagttactcctttgttagttcattcaacatttcttaagcatctagttagttccaggcactggagagccattgaggggacagagttcctgcatttaaggggctcatacctgagaggaagagaggagcaggtaaaccaaggtaatcccaaatagaggtcaaaaactggtggcctccagaccaattttatttagctaacatgtttttttaaaatcttgaattatttagaaaatagaaagatgtgatgaaaaaccccagttatctggcttcttctgataaaccggacaatttagcaatgtgttctcagattcccttgtgtccgttggtggctggatggtgctatggtggcccatttttgagaggctctcccttgccagtttgccagtctctgccctccccgctattccctgcctgtttggcccctgtgggtggttgattttgcattcccctgggttgcaatagtgatcaaggaaaatagtgtgttctgggaaggactctgaccacagccagggttaggtgagaaggagagggagccaagaaggatttctcggaggagagaatgtttggactgtattttttacaaaacaaagaaaaaggaggctgggcgcggtggctcatgcctgtcatctcagcactttgggaggtcaaggtaggtggatcacgaggtcaggagttcaagaacagcctggccaaaatggtgaaaccccgtctactaaaaatacaaaaacaattagccggatgtggtggtgggtgcctgtaatcccagctacttgggaggctgaggcagagaattgcttaaaatcagaggatgcagtaggtggagatcacgccattgcactccagcctgggcaacagagcaaaactccatctcaaaaaaaaaaaagaaagaaagaaaaaagaaaaagaaaaaggacaagtgctccaggcagaggtcgctgtgtaggagatgacccagaagcactggatcatggcacattcattatttcttagggcaaactctgccaaactgcccttcctttatgcaaagcaaagtccactgttaacgggtagaatcagattcttttctggaagattctacatgtacaaagtacaaaggcactgggtcagtcctggttgctcaatgtcctcttatgctgagggagagtgagaatcaaaaggtaggtttatataaaactttgtctagtttggaaaactctgagcttccaagtcattatttttggtgggtttgtgtgatcaccatcttttctaccaacagaccatttactggaccacaggtattctggcatcatttttttcttttaaaactggtgagtgtgccattcttttctttttggaacccatatctgtggccatatttcaagacttttttttaatcattaggaataatttttacagttcagcttttcaaagcctgacaatgtgtcaagccattggggagagctcaagcacattttgtggtgccaaaatatggcttgcctcagagggtttgagtttatgacgacaccctggtgttaaactatcttgctctgagatgctaaaagagatgggggtagggagtcttttgaggtccccaaactgttcctggaggtggtcacccctttttttctttctctatgtgcctgtgctgggagatctgggtcacatggcagctaatgctgtggatcccaggcaactttttgctcaataactgtttcccaaatggctactcaggggcctttcagaattcacgagagctgtcagttgttatagtaaccggccccctgctgtcgaattggccctgagatgccagtggaagctcttggaacaagctaacacatagtcattagacaaaagcggaaagagattcactgctaaaggttgccagttaaacatgctccatgatacttaaaaagctggactgattctgttagggaagcggtgggtgggtaaatttttaaaccaagcttacttttcaggaaagggaagctccttgtatgttcagtctattctaggtaacaaccatctttctttggatttctcagaattaactgtcttctccccccggggttaattatgtctgttctgctggtttgctcaggtagcctcaaatatctcaattattcaagatattagttattgattgtgtggcatttgcttctcagcaaaagtgttgtcagtttacgggtggtagttttaagcgcctgtgattgtgtgtgaggaaaaactgcggagatagccggctctgctccaaaattcctgaaagagtgaatctggcagaattcagagtagggctaagggttgagaaaaagtctaaatattttaggaagctgcaaatttcaagtttttatgagaatttgtaaaaacattccaacacactcatgatttcttcagattaatgttcatagccacactgagtatatccatgatgtttgtaggacagttgttgtagttccaggatgtactcaatagagggagacaagaagttctgtgttacagcaatccctccccccttttaatcgtatttccaagtttgacttctccaagttttggttcctgtgccaagcacttttacccaatatggagtctaataattaatacaatcattgaaagcttgtattaagggtgaagaaaacctaacactccagaattagaggatgttcattcctagaagtgaaaaaccaccagcggactcaatagttaacaaaatgttaactcctttggaattacatacctggcttcagaattctttgtgggactcaacagaacttccaaaaaaagagaacttccatatatctgagtttgtcattgctattttatcaacagagtttggaaagaataggaatcatttcagtgtgaaatcctatagcccagctggtttgggagactaaatataattaaataaatactttcaagtgttcttgtgtgacagaagtgcatctttcaaattctgtagccaagtctcagatgctacagttatttaagttttaaggagaaactaaatataggacttaatatatagtaataacttgccaactgctgttcccatctccctgaggtgcctctcctatttattctccaatctgtattgtgaattaagaaaatgtttgttctgagatgagaggaaagcatggggtaaaagacaaaacccgaaatgtgtctaatggcaccaaattcagagacatttgtggcagaagggaggaccaaatgatctccaagttcactttactccaatgatattttaagccattctgtttgccagggcagtgtgtcaaaggtggaagagtgggtatatgaatgacaagggtcatcactgtgtttgtgatatcctaaccttccattaacaccggggtaatagaggctgcgaatatgtaaagatgacttaaaagagtaaagttcccactgggtatttcttacctcagcataaaagctcctcataagctcctttgtgcataagcatcctcttttgaaaatgtcacagatgaggcctgatgacggggtctgtctgtgttagatgggaggggagggcatttgtatgcaactcttggtggccaattgaaaatactgtattctacacctgttctcttttgttttttgtccatttagagggtgtaacaaaataaagtccaagggctttcccagacgtttccgtgaagtgccttcttctggggagagaggagagaaggggagcaggtgaggggcggtcaagcttaagtggggggcgtcttgatggccgggactggcttgccaaatttttgttttgttgccatggggattgaagtcttgtagatggcacagtgctgaaactcacctgctttacctgaattcccaaaagtaagacttgcaaatatcaattcagcttgtgggtagctggtaccaattaaaagtatgtcctgtgtgtgcttgctttgctttattttgcagttttgggggtgttatttgtttccgggtttgtatgtactgggggtgctctatgtttgtgtgtctgtatgtgtgttgcatccattttctttccaaatttttagatatttgcatggttttgagcttttaaaaaaacatataatgcatgcatatagccttatgtgaaaaatacctcttagaaacctaaatttgtagataagttagggatgaagagtaggaaggggagagagaagtgagcaaacatggatgtactatgtgtttttccttaagaatggtgaagttgttttttttttttaaaaaaaggaaatgcatatgagttctggatagtttgaatacttggaaaaattattgtcctggaaagagttatagtaaatgtttggaactcatgattgtacagttttaatcaccacacttgagtctcttgataatatttctgtaaggcctgtcttaggcaaactgtatttaatattaatatcttttaatattaagttgctaattagactaattcactaatccatattatgtcaggagcagtccctttttactttcaatgaaccaatttataggatttatgttagaatttttacatggaatgattcatctccattggttgtgggtaaatcagaatactgagatgaaattttagatatccaactattataatcagataaacctatgaaatctgagaaggtatagtttaggagttgtgacagattaatgagaaagtatatgatctattttcttttacactgtactgtgcaattttggccttgtagggaaagcaataactgctaacactggtaactaaattattctgtgatccctttttgcttattaatgtctttaatttctaatacattttcaaaactaaggatagaaactgaaatagaaatttctctgtatagttttggagtcaaagactaatcttaagagaggaagacgttggacatcacttaaatgcttaactgtcatacccagtccattataaatatgttgtgtttttgactataacactttaaaaacccagcatcaccttatgaatatcacaaagataaatgcacatccaatttcaggtcctccccagaagtgatgatgtagcctgccagactatttcttttatgtacttcgacccccacgtcagtgggcccattatagatatattttagatcctaacagagatgccccagtctctctggtatcttctctgctgctcagtgaaggaagcacaatcagtttcatctaggtctaggagttgggaaccatcttgtgaaactacaggtatttatagaatccctctgattgtgaatcatatcatttacttttttaaatagtgtagcagcttaaaagacagactttggctcagggagatatgtgttctaactgcagctctgccacttcctggccctgcgactaggaagggcccatagggccttagtttccttatctagaaaatgagtctaatgatagcaacttttcatgaggttgttgtgaagattaaatgggggtagtatatgtaaaatgcttagtgtgtgaaatatattaacccattgagaagatgaggaaattcaggctctgagaagttgtcacttggctaagccaccctgcctaagtggttgccttgggactccactgcagcggcgtgaatcctgagcagtaccccctctcacagctacatgtgctatgctaagtactccatgaaaacgatatgggccagatacagatcctgtcctcaaggggcgccatgtctgtgcttcttacgctagccgccctgctgtaatgtacaattcctcattctggcccactgtcccctctccttccccatgctctctccccaggcacttttgctgcctcctttcctgacccatgtccatcctgctgctgttctataaaagggctttgaaagacagggtgccccctacctctgtcaggcttctgcaggaggctggaatgcaagcccttcaaccaggctctctctcacctttgcctttttcattccgctctcattttctttcctggcttgtatctccacctaaaatgtggccaggaatcaaaagaagagcccccagtgatagctaaattgcaaccctccaaacagctacaagagctgttacagaatccctacacattaacttcatgtggcattactcttctgcccctgtcatctccctgtcccacagcaggaaggaaggagactgtgccgctaagacgcgttgcacagagaattgctaaaagcaggacaacagctgtgagaggtgattatcctcccagaaaggagaggaaaaaaacattgaagatcagacccaagtatttaattttttaataaagctgatttaagttttgagtaagtaatacttgacatgattcaaaataaaaaagtttaaaattatatgcaccactaaattaccatcccatcactcacccaccctgctccctacctcctcacaaataggtagcccctattgctagtttgttgtctattcttccagggattgttacacatatataatatataagcaaataatgaatatccttttatctccttgtacacaatggaatacagcatatgcaatcatgtgccttgctgttctcacttaacacacgatttccctatgcctatataatttcctcatccttttacacagaagcatggtattcctttgtatagaagtgtcatgatttaattaacctatcctctgtggctgtcattttgattgttctccgtcttttgttattataaacaatcgtgtgatgaataagtttatgtgtcactttgcaagtggataagcatgtctgtaggaaaattttcagaggaaaatttattggctgtatcacaaggtacatgctattgtgcatgtatggtgccaagttgccctccataatgggataccaaggtgggcttctctctgcagtctatgagcatgctatttccctacagccaacccagcacactgcattgtcaaactttggcctttttactaacctcataggtgaaaaagaaacggtgtctcggtgtgattttaatgtattatctcttactataagtgggattgaaccatttgtttttctgtaaactgtttatatcttttgcttgttttttctttgagttattggtctttttctaatgaagagagataatcccttggtagcaatgtgagttgcaaatattttttcccaattcatagtttacttcttaactgtatttatggttcttctttgatgtttatataatcagatttatctatattttctgctttgttttctagattttgagttttcttttaaaagtctctccattctgaggttactcttttttaaaatcacttttatggtttcaaattttaatagtaaattcatttggaatttaacctggttgatcgtgtgatgtctgaatctacttcccccccccgagatggtctcaagtattttaaaaaaaatactgtaatctggggcttagtgaagaggcatataataccttcttagatccttaaaatatcactcacagcaaaatacagtcaatcagtatattaacaaaataaggagttgccaagaggcttttacccagacattttagattataaatactgaaaaatatgtgcagtaaatataatgtgaatttcatttcttacctcctccccaaaatgagttggactatcacatcactgttaaccttccaaaatcagtgggatattgtgtcagtgccttaaaactgtggcaaatgaggtggagagcccctcaagcctcagtccagatgttcagaatattccagtctagggtctgaagggtgagacagacaccttaaagcccctgacttcaagccttcttttctaagtaatagctggaagtcttgggaagtcctgtccagggctcactttctcaaagccagctaaaataaaagaactgtcacggtctcatcaaaatgtggtttctgaagagaccttttctctcctatctcctggaaagtattaccagtacttcagtcagacctaggtatctgcaaggatttcttggcaaacttaatgcctagctaagagaatatagttttgagaccacttttgtgcctataatttatcattttctcccaccttcctaaagatgttaattgcaggcaatttgaatcatccaataaaattctcactatgggaatcagatttttgtcacttctgactgtaccaaaagtcgactaggccatctctcctattcatgtgaaatccaaaatatttttgaaacattctctcctcgttttagtatctgtttcctctttcacaccccatccatcactgcatgattttgttctcttttctcttcccttttccctttctctctcctcatatctgttaagccctgcttatctaaggtatgacagccatatgccctgggacttccacagccctcatgtgaaacttgccatttgattatcccccaaagcacattgacatttgtcaaatctcacgcccccttttatgatttggaaaatatggccactagaaacatattttggtttgagtttttcttttgagaagatcccttccggaagagatactacaagtgtaaactgagttttataaactgaatcacttaacatgccataaaagaaacttaacagcaagtgagttgttgtatatgaaaaatctcaacttagaacttacattgggctcctttccaagtggaatcccggagttatttcagacactcctctttgaggaaaagcccaacaacgcctacagcctttttcttttattgttgtatttgtcacttcaatttcttgaaacattttgccctaataaatcaatccatgcctttttaatacagctctcaatcatcttccttgaaagcatgtgaacgttttcaactttctatttgtaagtggctcttattcatgcagggtttactacaacagatccatttacaaaagtagatattaatgcgatttcttttcttgacagcatgaaaataaatgggattattagcgggtatgctactgtaaatttaaatgagggcagtgtgtaaatcagttaagattgtataattaatattcagcagcagctcagctaactgccctctctagtctgcaattagaattttgagctacacactgctaataaactctttgccaccctgatgtgattatagaaccattgagtttaatttgaagacagtcacttggtttctaattcctatataccaacaatcagttagttcatgattctgggttttcatatgagtctggaggccacactgtggtcctgcaccctgcccatgtccagtagtcatgatgttgttcagggcagtgttgtagtaagcagaggaccctggatgagaacaatgtgacatcccaagcttctcagagtgggtgtacgtgttgacccagatgtctgtaaacctcaggaacccctttttcctgtaagcaggtttggagacctgccttttaaggaggtttgtttgtttgtttgtttgtttgttaatacagcagtgttgtgtggaattccagacatttctaatgttcagtctttctgcactcaagttcagcactttgcttctgaaaaatattggtcactaaattatttccaggttcttgtcagaagggcagaaaaagatataagaaaattgttagctcatatcagaggttatctaaacaggttcccggaaaaacagaagccacagaagaaaaggcctttatgcagaaatttggtcattctgggtattcttccttaagaattcctgggtggaaatggggggtcagaagtctagaggtttttttgtttgtttgttttggttattttgctacattttgtttgggtagtaagtctctataactggaattttattaatacttataaaggactgtcagagcagctgggcgtgtgtgtgtttcattagtcaagaaggccaattaaacatactggaacctgtcatgtgctggcagtgtatatttttcagcagggagctcagggacttgacgttgacagctgatactggccgatgtgtttcacatcctgactaaaagatgtactctgcacgttgtgtgtgctctgttttcccaagagtagactttatttttaaagaggtctttatccttaaaatatctcccttatttgaaagcatggaaggttatttttagaaatttcagtccaagagaaaatattcctaatcacaagcttcatgtgtcccatgtgggcttttaagaagccatgcatacttgcacattgctaccatcagggcttcagacactgtacagatctggaccacaggtgtgggttgtgggcttgagacccagaaaactgctaaccagatgccatacagatttgatcagctactatcacacattaccctctggacttccaatcaaacctttcttagaaatcttttgaagatatatgagcccgtgtttggttttctaaaaagggatgaacgaatggagagtaacataggaagcttgcttccactctgctacttggaactttctatagaaatgtgcatatatctaatatgttagtcatctttggtcaagcaccagaagcacttcggtagcatttagggctatgctgtaagaaaagtgcattcttttgaacagagacgctcattcggtgaggcaaaatgcttactctgtgagagggatatgagaaatgggaccaacttagggaccaacagattcacatttcccgtttcactttcattctgtctcacatacccactgagttcgaactgaggagataacttgtgcaaactgagctctttcttgtacccatctgggagcattcagtgaatgtttcatgtaagtccctctatcttgggtatcttgttgatgggggtgggctttagaaagccatctaaaacagtggttttccagttggtttaagtggcaggaaacttggaattcaggatgtcggaacatcattattattaataatattgaaataaatattgacaacttcaatgccttcatagaaactgaaattaattttcctaccagacaagtatagcagtccacaagggtggactctcaggagccattttccctttctcacagtggttcataattggacacagtacataccagaatccctagagggagtcttcacaatacacagagctatatataccccaccctgcacctgctctgttagaatcatcatgaatggggcttaccctgcctgggtattctaaaagctccctaagccaaagagctatgcactgcttgttaataaccaccatttgactgatactttactgataagagagagagagagactgagagacagactgactgactgttcagggccctccaaaattaaggcatacctaaatcagagtacttaaagtgtcagaaagatatatgctgcaaattgtacaatagggggaagtagaagataactaatttgggtcattactaggcctgtcagagtcagtgaaaataatgttacctggcctcagtttcttaaagggcacagacagcacccaggcgttggggaagggatgagaagtaaaagggcagaggtggaaacatgaaatatatggtggggaatcattggattatactttgtagttaaatttgtaaacatactttttcattacaaacatctatttcattgatttccctttttagggtacttacatatacaaatgttcactgaagagaaatgataattttggaaaatggctctttgtgatcctagaaatctgattcattcagggagggtctgtaagggtaagttagttgaaagagaattagacctagatagaaaattgaaattgcacgctcagtgacacacgtaagcacttcgagaaattcttttttttctttctttctttcttttttctttctttttttttttttttttttgagaccaagtcttgctctgttgcccaggctagagtgcagtggtgtgatctcggctcactgcaacctctgcctcccaggttcccaggttccaacgtttcttctgcctcagcctcccgagtagctggaactacaggcacgtgccaccacacctgcctaatttttgtatttttagtatagacggggtttcaccatcttggccaggctggtctcaaacttgtgatccacccacctcggcctcccaaagtgctgggattacaggcgtgagtcactgtgtctgggcagcgctttgagaaattctatctccattcccctgcgctcaaaattagagacaatactgcctccttaagtagatcacagttcagaggtttagaggcattaaaacttgtgtttttcttttccttttctccaaaatccctgcttttgctttttttattcctggatacctctgaaggtcaagaagcataatttctcgtggaaattccctgaaatgagcaagttaaaatacaatgtcatgtgatatgcagctgcttttcttaggtattaaacacagtgtagaatttgtacatgcaaagggaccatcttcatattgttaaggatcatgaaaagctgacaatagactgaccaccttcatcagtccctggcccagagtagaccccccaatagatagttattaaaggaataaattaaataccagcattgtaatgcctccatgaaatggaagattaagcaaacattaataaagaggatgccagtctatatttgttatcaaggagagatgcatatagaatgatctcatttcgttttttaaaaataaaacccccatgtagtcccagctacttaggaggctgaggcacgagaggcgtgagaatcgcccgaacctgggaggcggaggttgcagtgagctgagatcgtgccactgcactccagcctggatgacagagcgagactccatctcaaaataaaataaaatacatactcccccaatacccagaaaaaaaaatggaaaacagcccatctgtctatatttgggtgagactataataatagcccacagattgatctccttgttccatttctgctgccctctaatccattcatcatgtagcagccaaaatgagctttctgaaagaagcaaatcagatggtgcctctccatggattaaagcctttcattgactgtcccctgctcctagacaccagtgaaggttctttggtcgctagatcctgcatgatctggctctggcccacctctccaaccttgctttccacagcctttcccttgcctctggcttccttccagtttcctaaaatgcaccaagctccctctgctctaaggctcttcaactagctgcttgacctgcctaaaatggtcttcctccagagttttacagggttagacctccttaatcaggcctcagctcaaatgccacctcctcagtgaagtcccttccttcagccgacttcatttaccaccacatcattcttattttcttcattgctcttgactatttgaagcaatttatttgcttgttgtggatttttccccatgaagacataaatactaggagagtaggtgccttgtgtgtcttgtttatcattgtgctcccagctcctcactgcagatagatcaaggaatagtgaataaatgaggaaaagtatacagggatagacctcaaaatattaatagtgatcatcactaggaggaagattttgggtgtttttaattgatttttttctttttgttcatttgtcttgcctaatttttctgcaaagatgatctgttgcttatataatactttatcaattactccagtgcttagccaggcttaaggaagtagttttaaggattgcagacagcggcgggaatgtgttgtctgcatacttgatgctgtgcagtgggtgctgaataaacatttgccaaatccattgaaatctttattctacgggaagacattccccacaaagttctgtagttagttgcccacccatatatttgtgtgggaggcaagtgcatgatgtgcagcaaggtacagatgcggagctttgtcccccaggtttctgatccttatccccagtcgtgtgcttttcgctggcaatcatggagttattttgctccagggaaaatccattataaacagcagcacatggggcactagagtgtgatttgcttcagtacacactgcttttttcaaagataatgtggggcctgtagttccacatataactgagactggctgaactgtctgcctgtcttgtagggaaaaaaaaatctacaatatagtatatatatatatcctttccaagtcactttaacagtaacttggccaataacaattgtatttactaatagctttacattttagaagtctaatagccataataattatggtcttaaaatcaaagttatttcttgcatgcatttgtttttttcaagttaaaggctaacccagtaaattgcatcccattcatcttagtgacttagagcacttatttgggctattaagtagttgaatagctgtcctctaactcaacaaaagcaggttttccttagctatgatactggatggttaaggctttcattcatttgtgaagtccataacctgtgttttaactttaatgttacattctggaaatctgtgcaaattggagaaggtgggggaggagaggaaggaatccaagagtagaaaacttaataactaatttagagagagaaggaagttatctcaaacatcaaaataatttgtttcacatagatttccattgctttacattcagaagatttggttagcaccagagccctataatattatgtgcatttcatatccatgtagcttaagtctgactaacttatgttcttcacaaatttaggtaaaggcagctacgcaaagagtgatgaaaacttgttttattatttatattataaatgctgagcaattcataggaaacaaaaaaaacacgctcatttttcttcagtgctctattagagtagtcctgggaggcatgtgtcaagagttgtagtaactgacgttcaaaatctcctaatggtatggagcagcagtctagattgattctagagcactatccaaatggaaactgcttagagctactttccatctgaaaataggcactgcttaaagaacagcgcttcatactatgacatgtgatcatttctgattgcgtgtggttataatagcctgtataaaacctgagatggaaacatctttgtaactctgtggtctcttcactcccaaggagatcttgttttttatagtttcttgatttttctctaaccttcccaaccctagccccttctttggcctcatagaaacagggtatgcccaatggaatcatcccaggatatttttgattagattgagcaaagacaactgtgaagaaaagttgacttatctggtagttggaatacgggccccagaaaaagcaaagctgtaatgtgtgtaaatgttgtttggtgtgcgacgccagaggaggacagatcccagtgacactgtgcaccagaaggatgccgcctgcttggctaaaagacccagcagtagggccagctattgtaaagcccctccgccaaatgaacagggacccttctctggtcacaatagccattcacgctgagcagcttcattaaatattcagcctgtgcttccggcagctcattagggccgcaatgagcagtgacgtggatgcaggaaagctgagggccagccagcatcggaggcagaggctgagtgagctgctgatggcttttctcttcattgcctgtcctatgatgaccagtgtgtgctctctgctttgcttgaaatacaggtaaaaaaaacaaacaagcagatgacacgtaagggcttcaagaccttgtctcagatgttgtctggcaagggcctctgattctgagtgcttgccttcctgaagccctctgacccctttaaagagctgtctgaggcttagggggcctttgcatgaacaatgtggtgctattgtgtacttgggctgtttgatgacgatgttggaaggggatataaggtgtggttttgaacttggtgctggggatttagaatagcaaattattcctctgtaacgtaccaaatttagaaatattgtgagataaccctagcactctgtgtggtaggtttactctctaccatgttttcacgtatttgagtagttaaatactaagcctttccctttgaactatcagtttggatgcggtgatgataaaaaaaatggatatgctgtagcaattttgggcccctccaacaggctgaatgttgtccttgtatcttgttacttttacatgagtttaccctcagtgctgtgtgatgtttaaagctgggaagatctataaaataagaattaaaagaagatgaactcaaataaagtatattctattattgacatgtttttctcttttctacacagaaaatgttttcagactgctcatttctatgtggaagacagcagttcacctcgagtggtccctaatgaaagtattcctattattcctattccgggtaagtaagacactgctcttatttccaatgggctaattgtttttctcttttattctcagttttatgtgataaaacaacaaaatattttatagccttttaaagcttgcccagtataagaaattctctttagaagaacaaataactgagttaatgtagtatacagtcataggcaggaaagggaagtacagtagaaaaaagggaaaaaccgtacaaaaacattcttagtatctacttggactaaatttcatttgcataggcaatttgtgcttatatttttaaatcacaatttgtgacacatttttttaaaggtgatatttttctaagattctttcctctaaaataatgtatcttaatgttcaaagttttggttcttacgatggttgtgtggaaatagaggaatacattactggtctggtggatatttcacttttcttctagtaagaagataaagcacttggttagtgttggggtagggaataatggagtgcacactgtagtgaatcctagcaaatgccatagacatttagaagttcagcagtgggttaggtgtaataggatgtgggatttgaagatctcacccaccatttttatttggcatcccttcttctttgccagattttaactttctacgtcctggtttcattatgtgcttccaaatacgtatcttcagatattttagatacatctatcctcttgacattactcttttgcaaacagaagcatcactttgattataatgccacccctcctccacacctgaagctcccccatcctgctgatctgccctattctccataatgctttccaccagctaatgtgctatttattttacttttttctttgctctcttcccactacaatgagagctttataagggcaagtggctatatcctcagtgctaaaataattcttggcacatagtaggtattctttaagtacttacatgaatgaacgttagaaaaatttccttaaagttctaaaaaggtcttggctgtgaaactcagaggtagagtcattctttgggtaccatggagaaatgcttctattgtttgcagattgtcactacgtgtggttatggttgtggactgaattgccctgttatgtgtctgtatattgctaagtcattagatattactgggattgtccatgttttgtacattctagtcagcttttctcactaaaacttgccacacagaaacaagaagattaacagaaagtctctgattaacttcctgttggagcattttgtggctgctaaactaattctcataaagataggataagttttgtgttactgtgtgttctccactaaccctgcccctttttccttgctgaaggagactacttttcctttgagagtagagaaggtagacaggaatcatcagtcttcatcagcatgaaataagtagtttcattgaatctactggatttgcacaatagcgtgcatatactttttcctcttgctttacctacaatatgtgttgaccactggaaaattcctggcagcctttctcccctctgacctgatttgtctgacacagactcagttgtttggtagctgtgtaactgaaatccatttttgaagagttaaatggtgaaatacttactgggctgtttttccatttctattttcttttaccactggattaggaatcagaaaacctaggtccaccctgaaatctttgttcagtgccttcacctctctgaaccttagtttccagaatctgtaaattaattaggatgcctattctccttgccttttgaggtaactgtcaagacaacagtagatgatatttgtaaaagcactttggaaaccatacattaagcgaaacgtgtaagctgttgcaactttccttcccaaatcatggtactggtaatcccagcagtcatggagagagagcatttgcatgactctcatgttaaaattgtgtccctgacaccgaactacatccactaggtgtgccctaccttgaatcactcttctttgatataggctttagaactttcaattcactaggatcctctgaatatgccttgcaacacctttgagtaggtatattagaccagaaattgcttttgaatgttttctgtttcattcccagttacctatttaattaagaagttaaatactcaaaacccaggggcatttctttaaatgtgtctttttcccttttaaatatgtttctcctaattcatactcactactagtaatataactatatcaaaagaagactgcttcacattctccactgaatgagaagcccatgtattcaattgtacctcagttggcaaggtgaggcattcttgacaagctgtaacacgtttgtaaagatgaattattttaaatgtaaggcagtgtgatgttaaagggcttacctagtgaaatgacgagtgaggctcatctgttctctcaggtcttcatagctaacatagccttattaggagtatgcctaaacaaatgaacttacttcacccttaactgagagttaccctaaatgacctttccttaaagagctttcagcttgatcacaatctctcagcttggtaaataaaaccccacagtcctatttaatagttacatttggaaaatattttaattcacaaagcactttttaaacaattcactgttctattctttaggatttcttcttctttagttatagcagtacaacggtgtctcataaaagaaaaacacaattcaatttttaacaaacttgtgagttattttcactctactaaagcttttaccacaacttttctttaatggagacctccatggaatcattttaaatgatttatcttagaaattatccaattgtttttatttctaaaaataatacgagatttatagagctcctatgaagtatttattctacccattcaatctcagttatattttatccctgctcaaaacctaaataacaataataccagaccccagatttgtcaaattattttaccacttgggctcttcactctctataattgatttttttaaagatatttgcagacaacagacataactagtaaactgaatcattatactggctaaaaatatgtgcagcagggtgaagttgaaaattctggtaccaagctgttgtaaaaatagagctccagggtcatcactgtggaatatgcaatacactgtgttcccagagcttattttacagttagcctcttaaaaaattgttatctaataattattgagctttaccaacaaagtatgtttattttcactatagtcctatagagacaggtacagttgacacccccattttctggatgaagaaactgaggttcagagacttttttttaatttgcccaaggttacagagctaagcagtggagctaacactggaattatctctgtgacttcaaagcacagatgcttataaatggctctgccacctcttggcatacgactgtaacagttttcatatctcaagacttcagactcctcatttggatattgattcattaaatcaaggcattttcaaatacatgtgaatattctctttagttttttctgagttattgatcattaacttctctcactagcactgaccatttggtttttcattaaattctctttcatcctcctggagggaatttcataattcttgggttgacattttccccatattaaaaaaatctcccctctcatctctgttctctacttatttttattcttttccttcctgagagaaagactcaactcagcaagacatccattccctgcacaaaaacaggtctgtgtgatttaaatgacttaggaaacaagtcacagccacgttgaatgttgaacaaatttagacactaactcagcaactttggatgattctgctgtggctaaaattcataaataaatagcttgtatctttaaatcccaaagcatacgtggaatcagtaagttatactgacttttggaaactattataaaataggtaaatgattaaggaaagctttgctaaccctttgatactcctccctttgagatagcagtttataggagtttttgaagaattttgaatgaccagttttactaattctaacaggaatttaggatattcagtgtgttcttctgatttagtatagcaaagacagtgttttaagaacgaagacttttttttttcccctggtctcacctaacacttatgcaaaatatggaaatgctagacagagactgtgaatatatatggtggttgaggttaattagccatgttagaaaaaactcaaaatgcaagagtatttatccagcttgaaagaagtgcttttgaggttggcttccaatcactataaaggtagtatcaattattttatcagatagattttgaatggttagtgcctgttccatgcatgacatatgggaaaagtaggagcaggagagatacgttaaactgtgacttctgcaggagagtgaaaggggttttgactcaatatatttcactaagggtttttcaaaagaaaatgttccctggttactggtttcccattgtttcggtgtgaggataaagcataattgaatgcagtaacacagctgtcagtcccctcatatgctttccatcttctaaaatactgaagtggtcacaaaattctgtctttaagatccataatattcttaacactgacaggtacttataaaaatctagtgactcaggaatattcttttgaaaaaacaaacttgaatattacaattattaatgaagcattcactacattatattattcttttaggctttcattatatataaacttttagaaatcagaacttagctcatgaaattaacctgttatagagcatattgaaagagctttcctaaatatgcatactgtcagacacaaatgtcctaacgaatgcttttctctggaaattagaaaatctaactttctaataagagcattacaaaacaaaatgttgctgctaaccagtagcttagaaattcagaaatgattcatgcctttccagcagttaaaatacatcttaataatttgaaggtcactggcttcagcagggtgccagaatataaaggggttttaaacatgcagtttaaaacccttgggattaaaccaaccttgttggcatattttatttatacagagattatctccaaaagagattcattggtcttttgactataatgaagccctttctttattgacttcattgtgtcataaatgaaaagagatttctttttatggcaggaaataaaatgttccaacctccacaacactccatgcatcctaagagtgggatttagacaaaaatctatttgttgtgtcctaactcaggaaatcttgataatgtccttttgtttcatatttgctttatcttcctaagttgacacaaaggtattaccaaacaccttgagaggcctgaatttggcctctgagagactgagagggcagacaggaggggcagggggctgaattcctgaaaatgaggtctatccactagaggtgtggttaacagtacctgctaacaggccagttgttggagcagggtggagggaagggggtgggtaaggtctgagctgcactgatttgacccaagtactatgctagggctctgtttttctctgcccatggagatttggtcggaatttgggatagggttgagagatctgccaagggttaaatgaactttacagggattgctcatagagtgggtgacttaaggacctctggaatcttaatggtatttatataaatactcacacacttccagagtaagcaagaagggatattttattaaatagaccttaagtcaatcaactgcagcagctaagcatcttgtcaggaaggtaaatgccattaacaatttatctacctggcatcatcaaggtgaccagtctaccagtgtgaattttccaagtaactgaagcctaccctcaaagccaaagaatatcatttcaatcctttttgctgaaaagtttcttttaaatgtaagctctagggaggtaatataataaggaagaacccaggctttggagtctgcctggccctattacttgataatgacagtagccttggcaagcttcttggtccctgttaggcagtttcctcatctagaaaattagattaatcacagcacctagaacatagggttgtgcatgtaaagcaagtagcacctaacaataaatcatagatatgaaatgtttactaaatgccaggcactcttataagtacttgtgttatcttgtttacttttcataacactctatgaattatgaaatgtttactaaatgccaggcactcttataagtacttgtgttatcctgattgcttttcataacactctatgaattaagtactgttagttattcccattttacagatgaggaaagggaatcagagaagtggagtcacgcagtctggctctggcttttccacttataccgctgcctctggcttcctgatacacagcaagcatctcatcactggtggctgataagaatcacagatactcagttttactgagttacatgctaatggccttaccaggagctgtgtactaaggctgggccctctgtgcagctcctccctgtggtgtatgttcagggacagctttggctgcttatttttcctttctaatatcaaataaaaaactatgggcaagaaagctgtttctctttttatttatctgttattccttaagattaagagaaaggaaatttagcgtgtatgagtaggttagaggcatcaagtgttggtgatttccctctaacagttctgaagatgcaagtacggccgatacataactgtagattttggaaacagctttatgttcgaatgccattgttctttattgcctacagtgttgcatttgaggtcagcgttatctcagctttggtgttttcttctcagtagaagttgctgtcatcagttcaccctcttctgaggctctgcttttggtacctacaaacctaatttcaagcttcatcaaaagtacataagaaggttttgttgtggattgaacaaaataaaaggcccgttatgtacataatctaattctaaccacaaaaagctaaaatctgggaacttacttaagggtaaataataatatttaataacaataagcccacctcttcaggtactgattctctacattagtcattttataatcgggtgatttagtgataatggtagtggtcccacttttgcctagtttaaacctttggtatctgaaaattttgtaagtacaaatagtggctgagtaaagtggctcatgcctataataatctcagtgctttgggaggcagaggcaggaggatcactcgagcccaagagtttgagactagcctggacaacatagtgagaccccatctctacaaaaaatataagccaggtgtggtgacgtgggcctgtagtcccagctacgcaggaggctgaggtggaaggattgcttgaggctaggagttcaagaccagcctgggcaacatagcaagactccatctctacaaaaaatgtaagccaggtgtggtggcatgggcctgtagtttcagctactcaggaggctgaggtggaaggattgcttgaggctaggagttcaagaccagcctgggcaacatagcaagactccatctctttaaattagccaggcatggtggcacggaactatacctagctacttaggagactggggtgggaggatcacttgagctcaggagtttgaggtggcagtgagatacaattgagcagctgcactccaaccagcctgggtgacacagtgagaccatgtctcaaaaaaaaaaattagcacaaaattatcaagtgatatttatcagattaaccaggatattaagaattaaaaagtttaatttgttattccttgaaattatagtactttgagaatgaagacaaacagtgtatcctagtacacaggaatacagtctttgggttcaatggacctgggttcaaatctcagctctgccacttaactgagtctttttggacaagttgcctcggtttccttatgtgcactttgagaataaccatgttcccttcatctggttcttacagagataaatgtgtgaaaaacatttagcacagtccctggtaaccagtaagggcttaataaatggtggttttcctctcattctaccagctttatcattatcctgcttttgttataccataataatctctcatttaatctgttgtcagtgaaaacatcttcactttgattccagccccttttttcctttatgcttctcccaccaccaccactgcatcagtgacatttactcccactgtcatcaaatccatccttttaatggcacttgtagtctttatcacataattacactgttcttgctctcccttgtgttcatctcttcaccaacacaaatgtccttgagcagagaccatctccctaatatctggctgaatactaggtgctcagaaacggcttcatccaggggtttcccattctctctgagtcggagcactttttatctagggtctgcagccaacttcttctgccattctaaacttttttcagctgcaagatgcatatgaaaacagtatgcatttcttggagtacatgttaatacatataaagtacacagaaagtgcctggcctagttaatgctgctaatattcccttcaatctttaatgaaactcagacatttaggtggagatagcatgttttggatgaatgtcttcttaaaacacacagggcctttccagataaaaattgagctgattaggcctctgatgctgtcctaattgcttggccttctgctagttacattgattttataatcatctggctcatgttgagagaatgtaatagaaaaattatgagaatgattagaataattagtcatagccttatattcatctcagtataaagaaaagagatttatgactcctcagctatttatcttgattgcagggcaaatgctgtattatctgggtagctgacagtggtcagtacagcatgcatctgtatgtatgtccgcctgtctggtacttttgtgacattattggtggtgcctggaaacccagagggtgtggttaggcgtccttggataaagatgcaaattggagagactagtgagtcatatatttccatgattatcacactgaactctgctggatttttgctgcttctagccatagtggcagcaggcatactgatttctgggcatgtgtgtgtgacattagcttggatattacagttgagcactttgcagaaaaaaacaataagcagttaacctgaaagcatttcttttaatgatctgaggtgggctatggcctttaaaatgctgtggtttttaccttacagagtaaaacagttctaaagctgacatgttttttcttattttgaactagagtccatgttcctaatcacggcactgtaagttctcgggaatctaaaattctaaactatcattgtcgtataaatgttgccttcaacttattactctgctaaatatgtcactctgcccttgaaaatagtgttgtatctgtcatttctaagtatatgaaagtcctatagtctacatactagagtgattctgtggttaggttgtgtcccatctcacccattttgcctcttgtttgaaaatgagtttattcttgggctaatcatttagagactctccagctttgtacatagtaacccttttctcaacttgagatcattttcattgccactgatcattattgtagaatttgcttctaaacattttaagtgaagtgatcagataattttggaaattttcttgaactgtgcattctgctaaatattctggagaaacattttggctccgcttactctgttaatgctggttacatcatgagagctatagatttcttgggcatgcaaaatgattgcatattcatgaacatcttcaattctgaaatatttgtaaataacttggcaatttttttcataaggttgcctattaacatgattaggactttaattgttcacacaggaagaatttgtacttacagagcaccacctatttgataagtaacatttctatgctaagcaacttggattatgaacacataagtcaccttcctaaaacaaagtataagagatgctattttccacttaagcatgattcaagtttgaaaatgtcaatagatgcaaaaagccaccctagagctttgctctctcgaaagaaagaaggaatgacatagtcaatgttaactgtcaccagatgaagagaaatcagattgtcaggcctggatctataaaattcttgccaaagtaggacctcatttacacatacagatcttcataccctttgctaagaaaagcatctgtggcagtttagatgtttgtgcgtttgccaaagatctttcactctgaataaagtaaatgtcatgtctgttgtttatctcaaattcagcagagtatttttaaaaggaaatatttgtgggggagggtcgagggagaagggaagaaggaggttggggagctccagttagttgggtgtggctattttatagcagtactcaagtatcatgataaataagcttaaaacatactttgggcttatgaactgaaagtctccttttgaagtgacaacacgaaataaatgggaatgtggagtcttcccgaatctatacctagtctgtcaacaccaaaaaaatccagttaattcagtcaaactgattatttggcatcatgtagacacagctgtcttgagctaaaattttgaacacttaaagatagatggcattgtacccagagccagctggtacaatggcatctatctataattgtgtataaaggattgcttaaaacttataagattggaaatagaacttaattgcttaaagttcaagctggactccattgaacagcaattaaaaaaaaacaacaacaacaacaacaaagaaaacccctggtgtgataaaatttcttggcaaatgggtacccttgataaattcacacttttagttaagagtatgctatggtaatttaactatgtaaattgcgttgaatataaaaataaggggaattctctatgtacctttttttaaaaaccatatttaacctggcttgtaggcattaaagtcataatgagatcctaatgtaaaataaattctgagacttttcttcaggacatctattttgtgtgatacaattattttgctctttgcaaaaatcaagtatttgtcttaaggatgctttgctttatcagtgtaatttgttttatggaagtattctatgtaactttgaatattattttattccccccagatgacatggaagccattcctgtcaaacagtttgtcaaacacatcggtgagctctattctaataaccagcatgggttctctgaggattttgaggtatgtttcaaggctggaagttaacttccagaaacctaagtcttactttatgcagatttttgtaaacttgaactgaattcattccaagcataacaaaacagtaactacggaaagtggagtttttcttttcatctattattttaataggcattcttttccaaataaaatttaggtgaaaggggagttgattgtacctgtcctgaatatgtatttctacaaaagaaccgacttagtgatagaaaagaagcaaactggtagggattgcttttcaggttcttgctacatctaattctaactgggaacagcagtcataactcaaggctccctaattccatgtcttttctgcaatgcacatggtatagtgaagatagcaggtttggtgtctgagaaactgggtgctggcttcatcagtagtgagcttcataatcctcagaccaatcacctcatctcggatccccagttttcccatttttgaaaaatggcaccaatgtcacctacattgtaacgtcgttggaaaaataaatgattaacatctttaaaagtgccaagttcattgttaagaaccatgcaaaggttgactgttgttgttttcatgattattaatccttggagagaagacttgggttaacacagccttctgattttaagaactggtgtgtaggaaacaaggtagagagaggcatgtaccaccctgccaactctgggttctgtgccagttcagcagtgacagggtgtcaatgaggagctattaaacagactgcccttttcttcactgaggcgcttaactaaggcacatctctggcagcaagagttgtgtcgaggaggccaagttttcatggcagctcagctgtcttctagctctgtgggtaagttggttcctttctctgtctcatttctactttaaaatggaaatgatgatgatgatgatgctaacctacccatctctttcaacaaaattggttacagggcaaaatgaagtaatggaaggtaagcactttaagatcatctaggagtcatacagctggaaggtgcagttaccttgaatgaacaatgagaaataaaaacaggatgaaaagcccctgtctatgcaaatttagaatcccaaaaggctatcataaaggcagttatattgctgacttgttttaaattaagtctttctcttagtttttttgttagtttttgttgttttgagcagaatgaaaacaaaggtggtagaaagaacctctgatttattctacgaagtcatatgttttatggaaccaacaaaagcatgtcaagtatttaatgctattagatgcttactaaaaaaggtgcctattcaactacaaagaacatggtttaagtcaaacattttgtattcatgaggacagcaaatgtgtgtggtgttaaagtgatttagttcaattgactgttggctggatgactgagcaagaatattgaggcatttaacaacgttgatggtattcaggacaaacatttatcctctagagagccgaatttgatcaggatgatcaaatgcaactccagtttctcaattatttatgatttgagaccccagtgctattcatcacagctggttttgacaccatttaattattcaaaataatcagctacacctctgtaaacttgatctgacttaaaatgggctttgctgcatcaaaatcatgcttcttaacaaatcctgggcatctgtaccctatttctgtcctaaaaaaatatactgcagctaaaagctttaatcgcctacattgaactttagagcttaaatagtattagctgatacttatgggagtggaatggggagggcaggcaggaaggtgaaagggctgttgtgatttcactgtcttttcaggtttgaaaggtttaaaatcagagctgttcacaataggaagaatatgctttcttctaaaaagaacagcaaagcagcaacgtaaaggggagaataagaaaatagaaaagctcaccaatactactgtcaccttataattaggtgaaaatttgaagtacttttaaaagagtagtattccttttgggtaactgctaaaagggaaaactggtaataggctacataagaagctattacggctattttataaacagagatagtaacaggctttataagaaaggacagaaaaagattttgtgtaattaaaaacaaaattgtattatggtaagagagttaaggtaatcttagtctcagatttccagacccatttacctggaataatgatggccagcatttactagttagcactgtgcatggatcattctatttcctgaggtaggtgtatcttattgtccccattttactgatgacgaaactacccatgagaaaactgaggctgtgggtggctacattttgaaatggcaggagtagggtttaagaccagggtatctgacttgaacccacatggttcaccttgacaccatccagactctcattaaagtagtgtcctgggccaggcacagtggctcacacctgtaatcccaacactttgggagaacaaggtgggaggatcgcttgagatcaggagttcccaaccagcctggacaacacagcaagactctgtctctacaaaaaaaattttttttaattagccaggtgtggtgacgcacaactgtggtcctagctattcagaggctgaggctgaggcaggaggatcacttgagcccaggatattgaggctgcagtgacctatgaccgtaccactgcactccagcctgagcgacagagcaagaccctgtctcaggaaaaaacaccaaaaagccagagtaatgtcctgtaatgagccaaggtcagaaggagaaataaggaagcttgcaagtgactagaaatgatcatgcctcggtgccttaacaatacaaaagtggggagagcagccaaattaggaaccccccccactaggagtattagctgcccattacatgatctttatggtctcgagccttctaagatagctgagaatacgacttataaaaatcttatccaacatgtaggcctaaaattagtcttaaaattatgagaaatacaactgaaaagttaacaactggacattaagaggagctaaaacaacccatctaacagttactgatgatctaccattctctggacataatataagatacaaatatgaattagagtccttgccctcaaagagttcaatctggtactgggggaggccagagtgtacacaaccaaaacagaaacaggacaaagcaaaataagtgctattgtacaggcataaagttctgaagaagtgcaaaggagaaaggcatctatgtattttcattggagatttcagcaaaaattctcatccatcatgtttaaacatctcggaagtaaaaaaatgttggtgaataactatcgtagtttcagaactttactgcttggagaatgagaaaaacaattcactggtacctttgactctttgtctagaagtgttgctgtaagccagctttttgttcttgtcaaataaattctagagaccgtgaaaagcaacatcatacagtatttgcagtcactagaaataacatcagtccttttcttgtgatagcgttggatgacaccattaccttggctacctgagctaacttcaacctcattgtccttcccagggagtagtttcccagagtagtattaaaagattgacagcctcttccttggcccccacaaacataatgcagaaggcttccaaaagaccagtgctagcatactctttcaaaaggaaggcactccaaagctccatgagtcagaagaattaacaggcagggactggtagaatcagaagtctaaaagagtgcaggatgaggccagaagtccacagcccctggacaagatcctttgggggactgcctctattacagttaaccagctgtgctaaatttgggctggttgttcatcttaaatcaaaagaacaaagcttagtccacctgagcccatgctctgagggaccagtggccacaatcactttaggaaatgaagggagatgtccagggctgctgatgatgtataatagggaagtctctggtcagaggtgtaatgctgcaccgactgctgcctgcaagagggcagaaaatgagcctgtaggcagggctgtccaatcttttggcttccctaggccacattggaagaagaaatgtcttgggccacacataaaatacactaatgagagctgatgagctaaaaaattgcagggaaaaaaaaaaccctcaatgttttaagaaagtttacgaatttgtgttgggctgctttcaaagccatcctgggccgcctgtggcctgtgggccatggattggataagcttgctgtagagttagtttcctcagcgtttttgacaaaaatgccagtttgggtcttaaatatcttaagaaaaacgtttttaaacggttatgaggtaaatcacagttttttgagattttggtgaagagggagataaaagggagatagccagatttcatgaaaaataattcttatgctagagaccagctgcaggataataatgctgtgttatactctccaaagataggttagttttctagggggcaaatgcagtcattttgataaagatacatggatttggatacaggaagagaacaggcattcttaccaaggtaaatggcaataaagcaataagcaggaaatcaaatggtcttttcaaagggtatggagttaatattgtctgggattgggaagggtggggaagataagatgggaccttgaaagcctggctaagggaatgtggaatctctccacacgtttctgaggaagggaataacaaagtcagcacaacgtttgaggaaaatcagtctggcagcaatttataccctgagcaggagagagtaggggctggaagatgcagtgtaaccagcacctgtcaaaggccagttctgtgtccgacactgtacatgcactgggtcactaccatgacctaaacccatcagtcatctgtagaacagtctctttaccacaattgtaggctgcctgaactcaggcactaagaatgttacccctacttggtgtaatacttggtaaccagatccaaataatttattctcagctacctttttggaactgagcaatctgaaagatttctagaagttttgttgcattatttttttgaattgagccacagtatagtaggacagtaggtctttaagtgctctttaaatagcctcttgcatcaatgactgtaggtaggaagtgatttagcctacatcacctccctaaaattctcgttacatcaatttttagggtttgttcagtcttcgattttttgctttattttacacctgttttatgttggccttctcctatgcttatgtgcctgttaagattcaaactgttctttttgagaattctagctttgttacatagggagtaaaatataaacaagcttaaactatttatcaagttctgaataggtaaatttacaatgcatactccattggccagtgtctctttaaagggtttttaacacactaaaatcctgttaactttgaaatggcagttctgatagagaaaagccactcccagatcagatgatattatcagcatctaaatgagccaggcagtactgcaaggaattacagatgacattattatctacatgacaaaatcagaaggcctcaggcaaaccccatgggttctaataaaatcagatttgacaatatttattacgattttttgtttctgtcattcatctaattggaaaagtgaaacagaggcaacagatcagacaaggggttttagataacaaagagtttggccatattgaatgacagctttaaacaatactgacagctgctcccaagcagtcttggtcaattgcattatattagaaaagaggctccaacttcagtccatagctagggtggtcagatctatacaacaggaaaaaaaaatcaataaacaaagtaaatctcagactaaggtactaaaagccaaaatctctcagcataagatacctgaacaactcaaccctaaagaagtacatgccaaaggtgtgaccttcaaaacccgaaaacaaaagactaacttgtttcaaatccattttcaaaagttgtctgcccttgaaactcttcaaaagagcatggctcagagcttataaggcagtttcaaaaggcaggtcccaacgtgctaagtttggctagcattgctcatgttcttacgtagactgatttgtgatcacactttattatctcattttagagaagagccaaagggcagccttaaagctccttaaaccagtgttttccaaaccataggttataaactatgttagaacagaatatattggagtttagtaagagtaaggaaagggtaagaactgtcattaaacacactttcccagaaaggtggattgaattaatgcctgtggggcttttttttttttttttaaatggacagctgggaaggactataattatggaaacttcaatttacagtgtccaacaattggagagtcattgaatactgtttctttgaacacacagaaattctttgcttttataccttaaattctttgagtacagtaacttcctccttctagagaagaagtgtacttctccctgggaagtactttgtgaatataaaagacaaccagttcattgttttcattatgtttaatgtaaatactatggaaaacatgcataattactaggcaactcctttgtggaaaaaaaaagtctgcatgcttctaaactctgctacatctgttctgtgtaaaacatttctcctgataattttgtgttactttgttcaggctctttgtagcagctgtgtactgctaatgacttcccttattagtcagctccagtactttcttgggtttgaagcatatagtgtagaaaaatttggcttttcagcaacgttgtattaggctaatggatgacgtttaaatccacggccaaggtaggataagagtgttatttctgctactgctatttttccaaagaaggataacttttaaaatactagagttcacaaataatttgtcaagactgtatatatgagatatgaccattagttgggctgttattagggttatttcagcactgagtctttagagtcaatgcaccctcacaattataaaatgaggctataaggcctgtaagcatattgcaaatcatggtagagattatacttcttagaaattccctttcttcctttaagacttaggtaaattttttcacctgtctaaagccttcctctgttctgtgctcccatcagagctttctcaggcctcttttgtattcatcatgtttgactatctttttgaatatttttctcacccatagactatgatgtattcaaaaagagatattgttttacatctcagggactaggtcaaaaactagaaaaaagtagatgattgatgaaatagtaaataatgaaatctttatacctttttcacattcttcataaactcgttataaatatatcaataattatatccgaagttgggattgagaaggtaacggtggctgtggccagggagtgagtaaatactttatgcctttaaatgtatatggtgttcctttgtttctaaactgtgtctataatcttgctgttttcttcactaggaagtccagcgctgtactgctgatatgaacatcactgcagagcattccaatcatccagaaaacaagcacaaaaacagatacatcaacattttagcatgtgagtaataagctttaaactaccttcaactgcgaggaaattaaattttcatgctgggtataagctgaaagccaagcagtcagaagcaggatgccaagaaagaatgattcttgcaagctaacctctcattagcccatcttcaacagtgtagaagttgggacattttcttcccccttagcctttcattaggctgtcagggctcagcgagcttaataaggtgactgaaagaaaatgtttggagcttcgctattttcacatgaagtgatgtcatatcacatgttgggagccaaaatttgaatgtcacttggttacactgacattgtttttaacctgtaagggccaaatcttttaatacaaatgaaaatattgggaattgaatcaagcaagctgaatttcaaagcattctttcaaagactacataattggcttgtaccttaaatgatgagcctccaggccttttggtccatgtgcttactcctatctatcacatttccatggtcaggaatattctgtaggttagggactcaaacaaatggacattcttcatacagagcctcaaggaataccctaggagcacaagctacttctatggctagaagaccacatttcacagacatgtggggcttggctcactggcatataatatatgctttgatactaagggtaggggcatagatatttatagttaacatataccatggtaaggacattacatagaattgtatacaatagtgcatttaaattggaccacttaaaatttgaacagtactgtataatgttttcttaaagttttagtgaaatataattcatataccatatgaaatttacccatttaaggccaggcacagtggcttacgcctgtaatcccagcactttcggaggccgaggcaggtggatcacttgaggccatgagtgcaagaccagcctggccaacatggtgaaactctgtctctacaaaaaatactaaacttggctgggcacagtgactcacgcctgtaatcccagcactttgggaggctgaggcgggcggatcacgaggtcaggagatcgagaccatcctggctaatgcggtgaaaccctgtctctactaaaaatacaaaaattagccgggcgtggtggcaggcgcctgtagtcccagctactcgggaggctaaggcaggagaatggcatgaacccaggaggcggagcttgcagtgagccgagatcacgccactgtactccatcctgggtgacagagtgagactccatctgaaaaaaaaaaaaaaaattctgaagttaatgggatgtggtggcatgcgcctgtagtcccagctaatggagaggcacacgaatcacttgaacccaggagggggaggttgttgtgaaccaagattgtgccactgcactcaagcctggggaacagagcaagaccttgtctccaaaaaaaaaaaaatttcctagggtatacaactctggggttttagtatattcacggagttgtacgatcatcaccacaatctaattttagaacagtttttgcacctcagcaagaaacctgttagcaggcactcccaattcctccttctctccagcacttagaaaccctgtatctaccttctgtctctgtggttttgcatattctggacatttcatataaacagattcatactatatgtgaccttttgtgtctggcttctttaatttagcgcaatgatttcaacactcatccatgttgtaccatatatcaatacttcattcctttttatggctgaataatactctaatgtgtggatatacagcattttgtctattcattcatcatttgatggacattgtttcttttccgcttctcagctagtatgaataccgctatgagcattcatgtacaagtctttatgtagacagatattttcacttctctttggtgtatacgtaggagtagaatttgctagattatatggtaattctatgtttaaaattttgaggaactatcaaactcttttccaaagtggctattcattttacgttcccaccaacaatatataaagggtccagtgtttccacatcctcaccaactcttactatttaaaaaaaaaaaaaaacagccttcctaaccggtatgaagtggtatcctattgtagtttcgatttgcatgtccccaattattagtgatgttgagcatcttttcgtgcttattggccatttgtataacttgtttggagaaatgtctaatcagatcctttaccattttttaactggcttacttttgtcttttgttgagttgtaagagttctttatatattctggatacagatcatttattgaatatacagtttgcaaatattttctcattctgtgcattgtcttttcactttcttaatgtgagttctctaaatttgttcctttttcaagattgttttggctattctttcaacaattgtttctgaattgtactactgtactgcttttgttaaatttattcctaagtattttattccatttgatcctaatgtaaatgaaattgtttacttagttttatttttggattgctcattgctagtttatataaatacatttgtaggttgtatcctacaaccttgctgaatccgtcttttctagtagttttttcttgattccttgaatttctgtatacatgatgtcctctataaacaaaggtagttttatttctaaataaaatgttacaaaaactccaagttacttttgaataggattgtttgttctacttttctgagaaaatgaactggttaaaaaagccagggggagaacaaggaagaaagtcaaacctctccctagtctttggattgactttggcagtatttgttggccagctcaatcaaggctcaccactgctgtgactatgaggatttctctatccagatacacctcctttctaaccagagaaatcaggcaaggatatgtatacatctgtgccttatatatacatacatacatacacacacacacacacacacacacacgtatacatctgtgccttatatacacacacacacacacacacacacacacaccattctctccaccagagcatcctttacttctctaatgtcaaacatcacttactgccttgctaaaagtattgtggcaaaaaaaggaggagaaaatcaaagcaactaatgtgtgatgtgcccaaaggtcatggtgttttgctagaaaaccatcatctctggttaaatgtgaattgcactttcacaacttcatttgtgattttactttcacaatttcaaattagatgtaattttatttttaaacattcagggagttaggttttggtgttctcttggccactcagattctgggcacattgcctgccttcatctaccctctatattaatgccttttcatagcaaagaatagcatagaaacaagtaaaatcagaccgtgaatgagccagaaacatgatgtatgaaaaaccttctctcagattcatcacaactttcaaggtatatgtggatgttaccaaatcacctcccaaattgatctattaatgtcttatttgtcagtctaagaaataacaatatgcaattaatgactactaaggcataacggtttggatccagatgccttaggagaaatttttcctttggggcctatttatatcaagcaacacctgtttcatgtcaactgtaaactgaaagtttgtcagaacaacaaaaacagttcacagttccaaaaacatagagggctctcaaaaattgcttggtatattctgaggtcagtaatgcctatgctgatccactcattggacttctttttcaactagccttttatgataatgactataaacagaaacataaattgggttttgcccattctgtttctacctagggaaaataaaattataacctcagcttccttttacttattttgctatcctaaaaaaaacaggcacaatgctgctgggcaactagatacacatgtcatgcatcacctacccccaacttttgttcattaactgaggttaagtggatcctaaaatctgaacattaacttcagattcctgtaatgagattactcttaacaaaagctctggtttcctcaattccttaggttctgttagggtagcagggaatccaagtgaattagcaatggaattgcctgaaaatattaatagatgttttggacttgacagatcagtcacccttttatatttgtattaatggggagggaacaggggcatagggcataatcaaagccctttgaacttggctttaaaatacagaacaagcaaatacctttgaacttggctttaaaatacagaggactacaatttgtaatagttttacatgagtttgcatcctgagagcaggagatgtaggagtggctctgtattttgggatgggtttgaatgctctatttagttgttctgccaaaagttttctcagactaccttgggagatgtcatgttacctgattgccttgtgttgtgctttagaatggtgctagtttctgaattatccattttatttctgtttttttttcttatcttctatagatgatcacagtagggtgaagttaagacctttaccaggaaaagactctaagcacagcgactacattaatgcaaactatgttgatgtaagtcagaactgttattataaacctgtttctagaaattgaagactgcagcagaaactgtttaatatattttaatactgtacagagctttcactaaaaacaaagcccattcaatatggaaggcatttgaattattgactggtcttctgtgataactgctttcatctcactttgtgctgtgtcattttgaagggttacaacaaagcaaaagcctacattgccacccaaggacctttgaagtctacatttgaagatttctggaggatgatttgggaacaaaacactggaatcattgtgatgattacgaaccttgtggaaaaaggaagagtaagagccttttgactcactatcttaataatgcaccttcattcaaaagatacttgtggagtacctgctttagggtaggaacttgacaaggtataaagagttacggaaatgaaaagtgttctctctgctttatcttgcttatgattcagaaggaaagagagctaaggcattatgagagtaaatgtgatgacagagatgaacagggtatcagtggaatgctgcaaaatgaatcaatgtatcctctgtacattcctctgtacagagattttttaaaggagcaaatacttgagacttgaacaatgattacgaggaattacacaggctaaaaagagaaggaaagggtgttctaagtacaggggacagacaacagtaaacagggaaattgaaagaagcgtggtgtagacaaggaactactaatagttaagattgggggaagcaaaaattgcctaaacagtttaaccatcattaagaggaccttttaaaaaaatgattagtgctgtagaatttattggattatgagtttacattagatgatgctaatttaggctggaataaaagctacacttcaaggaatcaccacactgggttgataggtgcatcaaaccactatggcacatgattccctatgtaacaaacctgcaaatcttgcacatgtaccccaaaactaaaactaaaaattaaaaacaaacaaaaataaaaataaataaaagaacctacgcttcaggttccctgctcaaaatcaccactgcttcatgttgtggagtcactgttttacttttgatgatccaagttacaataagaagagtctcacagttagaagagaaccttccatgaatccaacccggccttccaaatgatacttaagctccctttataacaaaccttacccacatttcttacaggtcagacatagaggtttctttcttagtcccttttaaaaatgcattataatgcaaaaataaaaatgcattatatattgaaaggtgaccataaatactaggcccatttctcacatggtctcacacaaacttatcccaagccatcagccttgtcagaggtcacacctgcctttaagcagttaaactcacgtattcctttttcagtcaactaaatggcaatctcacctgtgttttaacattgtcgtttgaaattacattatcaacagaattgtggcatagattgcagttatactttacaacttttttctttctgcagcgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaaggtatggaaggaattgggtaggctgccagggcatcccctttttatacttgtatgaaaattactgtacaaccaaggccaaatctcataaccaacttggtttttaaaaagtatttttaaaacattttttcataactcttttgattgacatcagtgtatggtgtgaaaggtattggcaaagcatctaatagaatttaactggcctgattgagcctttaatctctacatgaacaggcttcattttttaaaaaatcatcctcttaggttttggtaatactcagcaaatatggcagcatctgtttgatttagcttttttattccaattttctgacagatataaagcattgtttcccaaagtatgttccaaggaatacttgtcctgtaagattcttgtaaacatcagattctgctgttcaagaatgggaaatgaatgctacataatatatatccccccagcattttagaaatttacagtgaacataagtgaccagagcactggtgttaacaataatacccttctctatagaactactaataccctaggaatcacatttttgtggaaatactgttttcaggttatctcagtttctttttcaaaatccactgtcacaacaaatatcctagatcaatcatcacagcagtacacagtctccccttaattgtggaaggtatgtttcaagacccccggtggatgcttgaaacctcaggtagtactgaagcctatttataacaatgtcttttcctatacatacatatctatgataaaatttaatttatcaattaggcacagcaagagagtaacaatactgaaatagaacaataatattctataataaaagttatatgaatatatactgtttctcttaaaatactgtaatatttttggactgtggttgacctcgggaatgtgaaactgcagataaggaggaaatactgtattaagaactgtaaatagacgctcattaaaaaatgtagttattccacagaacttaggtatggcagttgtttgcagcaatgggataattttttttttttcttggtgtcttggacattttggaaaatgtgataaaactgtagcctccttgccccatttatattcacacttactcacatttttatgtaaaatttcagtggctccaaagcccatctgtgatcccaggttaactatcctttctatgtatgtttatttcccaaaatggcagaaataacatgaatatcagtagcatagcaatacatctgtgttctctactatgaaatagagctgctggctggctcaagatgatcaataaccagcaaaaaacttacaaagcccaactgatgagaatatttcaggtatttaaacagggcccacttactcttgttttagaaacagcttaagtcagaggaagaagtcaaataggaactttaggtgttttacatactaataggaaaaagtagaaaaatgagagttaacagaagaattaaattaaagccatcatgggcctttgtacaatagcacaggaccagacacacttcaagcttcagtgttaatgaccctgagtcatccaaaaaaaatttagaaattaggtattgataataagaaatcgtatcatagcaaataatctatttggggaatatttcatctaaagtagttaaaatgtaaaaagttcagacacttaaaggaaaactactctgaaaaagtcatttatgaaagtgacaggtaaatgagacattgcctctgactctaaagacagaagtatttgacatttaaaatcttcccatcacttcctggatagtttacagcagcaacaagcactctggctcctaaaggtccagcctggacagtggagaaggaatgggaatcacagcccacagagacatgaaagcaaagtactaagatctggacttggggcagaaagtcaggaaatggaggccttgcaggaaaagtacaagtgctttggatagttccaaatccaaaaaaaactgatactaaatgttcattcttagtacaatcttaaacagtcttctcttctaagtgatagtgacacttcatatccagcttggtaatgtctccaatttaatggcatgaaagttggctacaagggggaataacctagcctgggaacagtgattagggtgaatgtgatcagtggtcatgtgtcctgacacccttacattatttttttccagaatgtccacccccccgcttaaagacatcttttttcacttttctcacagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcaggtagggtctaggattcaacatgtgaaatagatggggcaggggacttaggcctcagtgaccttggaccacaatgattgctactgctttcacttagaagctgaatcttccactggaaactgggatggataagacctatgatagtcttaaagaggctctattcctgtaacattaagaaatcatctgctgcttctgtgatttttaaaaaactagatcaatccctagtttttataaaatcttcttattaataatatcagccaggcatggaggccaactcctgtaatcccagcactttgggaggctgaggtgggtggatcacttgagcccaggagtttgagaccagcctgggcaacaaagtgacaccccatttctacaaaaattaaaaataaaaaaattagccagcatggtggcacatgcctgtggtcccagctacatgggaggctgagacagaaggatcccttgaacccagtaggtcaaggctgcagtgggctgtgttcacataactgcactccagcctgggtgatgatagagcaagatcatgactcaaaaaaaaaaagaaaaaattacaaaatccccattgtttataggaaaattgtagcctgatcctaataaataaaaatatgacgttaaacacaagaactttccacactagaatagagattgtgtttttgtaaatggcttttctgaaaggttcttctaaataacaatatttatagtatatatgaaaatatttcatttttaaatttttagtttaaatgttccatataaaataccttttcaaaagcactgggaaatccttgtataaagcttgttttttgtcagccacagtaaatgactttagttggttgtttaaaaatgcttttattctgtttcatttgaaaatgcattcttgcctcttttttgtttgttttaaactttggtactcaaatacatgtcgcttgttctgtgatttatgttgcaatgctaagtgaataacgtacgtcatctaaggttatctaagtggggtttaggctgggagtggtggctcacacatgtaattccagcagtttgggaggccaaagtgggcagatcacctgaggtcaggagttcgataccagtctggccaacacggtgaaacctctactaaagataaaaaattagtcgggtgtagtggtacacatctgtaatcccagctactcggtaggctgaggctcgagaattgcttgaactgggaggcggaggttgcagtgaaccgagattgcgccactgcactccagcctgggcaacagagtgaaactccatctcatctcagaaaaataataaaataaatggggtttagattggaatttttcgaatccaaagttaacagtatgataaaacaaaagtgccagttgagtgtcttcatttcttacagtgctggtgtgggcagaacaggcacctatattgtaatagacagcatgctgcaacagataaaagacaaaagcacagttaacgtcctgggattcctgaagcatatcaggacacagcgtaactacctcgtccagactgaggtaaggagtagctgccagcgtcctcacgacattctggcaaatgctgtaactgaaatttgttaaatgataatgaagagacagattcattcttttagggcttgcagtaatttacaggtttgtattagaagatattctgacaatgatcctattctacggatcacagttttccatttctgtatggatcttaacatttggattcctaaataactacacaagtacttacgaaagagatacagttgtttcaagagctgtgttagatggtagggggagttaaacatgttgtctggcctgagaaatacataggagaggatggttctaaaacccttcattgaacacgattttttgtttgcttattgagttgaagcaataagcacagtatagaataccgtgatccaggcacagtatagaatacagagctaaacttaacacagtctctaccgtaaaataagttaagactgataaagtgagtattggagcaaatcacctagctgtaagtgcttgaaggaaatcactgggaggtccctgttagcagcagaattaaactaaggtacacttcatgaatgagtggctaacccttaacactccctcagtgactaccatgtattgtacctcttaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaaggtagtgctttgaaaaagtttctttggcataaagcaagaaaatgttttaaatgccttgagtttgggggttatgtcttctttgcattaatgtatacaccgaaatggattactatttgtactccttgtactccttaaatgtgatgaaaaagaaaatacggttttgacctatgtatgaattgttggtattcaagtagatatacagtgttgtattttcttctgagcaatttatgactttatctgaatataaacatcagcccctggccataatgacatagtactttaaagtaactcgtttagtccaaaaaatgtcctattttttctgaactaatctatcttaccttaattattaagaatgatgacttgtagacatattgtcctaaaaatatgcctatttcaaaaactatttcagaagataatttaggaatttaaaaagaattactaaacaatactagagaaaagttaacttttcctaaatggttgttctttttctttgatagggacatgaagaagcttaaaagcggttaaggtttatatggaattgactgaagtgaaggtgaaaaagagagattataaggactattaaaataattagggctcagtcatctgataataaatcaaaattgcttctaactttcaaacatcgcctgtctctccagttaccaagtgctttcctatttatctttgtcttttaaattctattttgcacattgttctgtatgtaaatagtttctccctttgtatcaagattcaaagaatgagatgaatctacagttttagttttcatggtaaaactttccatagactgaaactttcatttgaatctcagctgaagaaatgagactgccaagcaaattataccaagtgatatgaaatgaaaaatagtttaatttcactgagttcagtcataaaattaaaaatttttagctccccattaacattctactataaaaccatgagataattaataatgaggacacagtgtatcattttaaatgtttaacatgagttcttacaaaatattaagtaccaacatttcttaaattctgcctttttcgtttcttcaatttttttttatacatactttaaaacttcatttaagaaatgcgaccaggtagttggttcttttacaggcactaaccattttagagctcaagatgaagaaaaaaacaagaatcaaacttgaaaatgaaaattatatccagggaccatgagttttactaaagcatctggagaagaacactgatctcatatactccattaggatggatgccagcccccaaaaaataggattgacaaaatggttcaaccaagctacataaacaggaataataatcaaactactgggctggttacttataaaagccttagaacaatgttagttcagttcaacagaaatgtactgagaactagttaagtactcctttatcttcaagaaacttgattagctcgtaatcaatagcattaagcaatcttttttaatgtagactcacgtaggtcttttatgccagtgaggatcacagaaaaaaattcacagcagcagtgacatcacataacagaagaatccacatagttctagaaatatctattgcacacagtacctatttctacctgatagtagaaataagaaagatacaatcaaggtcactgagagaagtaccactaggaaagcacaagagtgttctctggggctgggcatggtagattacacctgtaatcccagagcagcctgggaaacacaggaagaccccaattctataaacaattttaaaaattagctggttgtgctgatgcacctgtggtcctaactactcaggaggctgaggtgggaggatcacagttaactgagctacaatcatgccactgcactccagcctgggcaagagagcaagaccctgtgtcttaaaaggttctttgtggcacagaaatggtcttgtttatcagtaatctgattgggatttttgccaaagcatcaagcaaatgctatcaattatatctttgaatgaagactaaaatgttttttctttttcagctggtcacacagtgtaatgcaaaatatgtggaatgtttcagtgctcagaaagagtgtaacaaagaaaagaacagaaactcttcagttgtgccatgtaagactttaaaacagtttgttagtgatcttttatactggattgtatgttaggtacagaggcagccactactctgatgctattgatagcacccttcaattgtactgtacgtggccgtatggtagaaggttttgaaaatgtccttttagtaacctcattaatgtatgactttataccagcctcttacctggtactaccaaaagggaaaatgttatgcttattcaactaaggtagtttaatgaaactgggagaggtggttgtcagtgtcagcaagtgctccatctatctgacgtagaatacagcttcatttcaccttggaatgcaagaattgggttacttctaccatattataacataaaaaataataataaagctgttattgctgtggcattaacattcctctaaaacttagaatcctggattaatctgtacaactagaactaccttattcagttactgtggctattgagatcaaggcactgttgattggtggtgacctttgtataaatagctaaggacattgcagaggatgctgtctgtgtgctgtaggcatagacatgggtgatcatttgggagatttatctctaatgaaaaaggccactcttttctaagaccatcatgagcagaaagacatggagaaaggggttggtaaaaggacaaagtatatgttggtataattgtaggaataacaaactagagtcaaaagttatctaaaatcctctgttgtgtccatataaagtattctgttattgatctgctgtaaaaatctctcccacagtaaaactgtattcctacaatgcctgtgtccttctgggtatgtgcagcaaaatttcattttacattctgcctcagctgataacactttagcttgtttaaaaatatagataagtcttagaaagggaagccaggaggatatgttattcatcaagcaaatctcagaaagagctgttggttctgtgtgtataataaggcaaatgtggtgtttttgttttttccatatgatagctgagcgtgctcgagtgggtcttgcaccattgcctggaatgaaaggaacagattacattaatgcttcttatatcatggtgagagtcaacagttaattataaataaagtcaactaaactgaaaggtgttaaagagcagataccacctgtgtgactgatgtcatttttgaaataatttctcaatgtgtaatatgaaaagtatagagatttctgtatcttgaaacttttaacaaaagatacctaatcagtgctggtacaaaaatgcttaaattaagcagaatgcttcttaaggaattaattttattgttaatttcacacatctagtctttgaataaatgttgaaatttcccttaagtgaaaacagcagggttaactagaagtgaactgcacatggagagaaaattgtctgcacagtgctagcagaagtacatctaaaaattagccaaatgtaccgaatgcctttctcaattattttagtgtagtcaaaacagtgctatcttatttcatgaatatattttactaccacaaagttagaataaaacactcatattcactgattttttttgtcttcccaactgaagggctattataggagcaatgaatttattataactcagcatcctctgccacatactacgaaagatttctggcgaatgatttgggatcataacgcacagatcattgtcatgctgccagacaaccagagcttggtaagtaaagcacatctgctatatattaatgagcccatgaggctacaagcataaattactttgatactttgccatagggctatagtatccatatatgctagggagggaatttaaaatttttaaattctcatcttgaagtctgtggagattcctttcatagtctcacaatactgtccctatcagttccattacttgagtctctgatgctattgatatcacccttcaattgtactgtctgtggcggtgtggtagaaggttttgaaaatgtttttagtaacctcattaatatatgactacaccaacctcttccctgctgtatgtcacttttgaaaagtaaataattgtagcttacaggtactgagtatgtaactgtgtttacatgcattaacttgtttaattctcaacaattttaagacatacatactattattatctcatgtaatagctgagaaaactgagaacaaacttgctcaagagagcacacacaagtaactggagccaggattttaacctgagtcatctgtctccagagaccatgcttatataatcattttactgtatgtcttaccccaaaatattgtatcaaaagtactaatagtgaatttttttttcccactccataggcaagtcaggtctactgcagggataggctattttgttcccacttaaaggtctttaggactgagctgctactacttttccctcccttagtccttctctatttcagtctctaaactatacagaagggtgagcaagtttataaaacagacttaaatgtttctgcttagatcttgtggatacttaagtttcggaattagctgggtctataaaagttactgtgtggacatgtgaacccatgaggtaaaaacaaaaaacagtgaggatctgcctttatgatagtcagattaatgagttttttaatcaaggaagaacagcatgtgactgaacccccagtcttggtgacatgcatttgactgtgtgcccagtcagtaggaacttcttcactttgtcgcattttgctccagcttcaggataccaagactgcttctgtatgatggaatggcaacaaagttgagaatcttaaactaaaagctggagtgtaaattttcaaattagctggcaatagggtctattctgtttggcatgtggaaattggaggcacttagggttgttaaaacgttcatttgttggatgaatcagtattttgttattgtcacttaacagagggcaatcaccataaagcatctacccagcagctcatttgtatggggaggctggagggagactggaccaaataagtggatacatgttctgcagacactgaggatataggaacatggcatctcagtgtctctctgaggcctcggaaggctagattagaatcatatacaactgacctctcagttctgagatggagagtttcatcattgcacagtttttcctaaagattgatatctctgagttctttttgtttgttgtattattactgctatacctttaccaggtcataattctgtaaggagcccaaaagtcactgcttcctaactcacaaagtacggatatagatgcccagatatctttgacctataaatatacttgtaagcaaaacagtcatgagaccagtgtgcctgctgaattaagaagcagcatttatttttcttagactttcaagatgaaccatttttctacctttcttctaccataactcaaatccctttggtagcctttaagctagttaatttactattcatgttatcatcatagtatttctttaaagtaagtagtttttattcccacttttcagatctggaaattaaggttcagattaatttacccaggatcacatccactcataaatcctatgcttaatctgtgcatatttgttacatttagatgccctgttcattaccttatgtctttaatatctgtgtccttggacaaaacctattaaaacccacgacagttacagacttcttttgtatagactaaacccagttgctaatctgtttccccttatgctgagctttaaaaataaaaatgtacttggcaataagctatattgaaacttgaaagggtgataagtctcattggacgttggctcatttctaatgcaacaatgtaagattaaacaaagccttctttgttttgaacattattcagaattatttctgacttcaatgatagtagctaggcatcctcaggaaaatgcccgtagaaacctatatactacaggaaaactacagtttgccattggagctgattgattaggatacgtggtgtacatcataatcatatttctcacagtctccaacctatgcaacaattaactttctcttaggcatccatagtttttagggatagaattcaaggaccaagcctgcatatctatttttaatcttaaaatggatgaacatttaaagcttgcctgattcaaggctgaaagactttctatgttatcccctcttgaaatataacattgacagatttcttttaaaactgccttgtacatacagccaacctacttactcacacacaatcttccaaaaaagttctatcccttaccatttattagcagagtgattttagataatttatgggccccctccccaaggccttgtgtcctcatctgtaaagacaggtgatacaaaatctcctcagggttaatatacaaaatttgtacagaactcatacaactcagtagtagaatcatgaaatacctgatttaaatatgggcaaaagacctgaatagacatttctccaaggaagacataaagatggccaagaggtatatgaaaagatgctcaatctcattaattttcagggaaatgtaagtcaagataccccacacccattaggatagctattaaaaacaatcaaaagataccaaatgttggtgaggataacaaagaaaactctcacacactgttggtgggaatgtagattgctagagccatgatggaaaactgtctggaggtttctaaataaattaaaaatagaactaccataagacccagcagtccttcttgtgggcatatacccaaaggaagtgaaatcaacacctcgtaaagatatttgcactcccgttcattgcagcattattagcaatcgccaagatacggaaacaacctaagtttccatcaacagataaatggataaagaaatttgtggggtagggaggaaatgggaagatgtaaaataaatcaagaggatacaaaacaacagatgaggaagaacaagtttagagatctcatatccaacatgaggactacaggtaataaaattgcactgtatttgggaatcatgccaatattgagtacattttagctgttcctgccacaaaaatgaaagtgagatgatgggtatgttaatttgctcctaattatagtaacctttttactatctgtatgtatccaacatcatactgaaaatatacaagaaaacttatagtgtttatgaaagtcctttgcaaaatgcagttcaactacagaattattaacataatccacaggaaataattagcatgtcttgattgcttaagcaattgtgaaataacaaaattaactgacctagatcctgctttcttttttactatgtcaatattacagaatacttctcaactgtaataagtcccctatagtgggagtgtttcaggttgctacactaacaggtgagagatgctagaaaatgattatcaaaatatattttacaatagaatacaataaccattcaacttggtgtagttcgatgggaacatataactcttatgaattcagtttaaacgatggcttgagagggatgggaaatgacaaaatccgtatgcaagaaatagaaaacaaatccttgacagaactgcagaggcttttttttttttttttttttttttttttggattccaaaggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggtaacctaaacctcagttcctcactaatagccatacctgggccctggatcatcattctaagtaataatgaaataatttaccaccctcaagccaggctcaggcatttgagtaagacttaattttaaatatgtacattttccgtttttcttccttcaaatatttgctttttccagctggctagatgaaatgtaacagttcctctgattcagcatgcatacaaataggtctgttgacctaattataaaaacaatatactagaactcaatattttctttgccatcagaaatgtaagctttgcaatgtgttgcacagatgataatactaagtttttttaagtaaatattttgctgccttcttgtgggatgagtaagcatgggggggctcttatattagtaatttaaaggatgagccccttccttgttttcctttaattttataaataagaaaatagagtaggatataaggtctttaataatttattgtcacttgaaatttttgactaagccaaatgaattgtttcactagcatgacctacttggttgtttgttttgagacaaggtctcactcacagtggcatcatcaaagctcagtgtaaccccaaactcctgggctcaagcgatcctttcacatcagcctcccgaatagcaaagactataggcatgtaccatatgactggttaatttttttttttttttaatttttttagagacagatctccctgtgttgcccaggtgggtcttgaactcctggcctcaagcaatcctcccaccttggcctcccaaagtactgaattacaggcatgaaccactatgcctagccatgctttttttaaaaaacaaaaaaacaaaaaaaaaaaaccttcctggtatttttcttctttccagctgtggtttggttaacacaacattgttgagagttacctataacacatggctttctcaggagcaagttctagtcattagattgtagatatgtgaaataaaggaagggatttgacccatgttgtattggttacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatgtatctgtttcttaattttaaaatgtagaccgtttttttgtttaatttcttgttgaaagcagtagaaaaggaagccagaattttaaaacctatcaacaacctcagcttgtgacaactccatgttatttctactgtggacatgtacaaagtgttgttgctctgtttacattttaatatgtcaaactcttccaagactccaggttcttctagagtatatgttctagaaaggggaaagtattatatcttagcctacagaggtagatctgcatgcatttagaggtgttatgtgttagtaacaaatgagtaaattaataactgtttaccttaattaaatactttttaaaaatccttacactgaatttcaaacacttgttagggaaataacctttaaaaatatgacttagttgatgagtagagataaaactactagtattaatgataatatttaaagttcatgatgtgttttaaagtcttcagtactgtcttttgggatttaaagaatatgaatctcaaagagaaaaataacttgcacctggtctcaaagcttctaagtgtcacaatggtatcccagcccagcacctttccactttaataagaaggaaagggtcatagatatatcttattgtatatagatatttggagccaaacttcatggcctgtaagtcagttgtataattgaatcgtttcaaatcacaaacctttagccaatatggaatcaattatacattcccatttttatttcagttccaaggtagctcttggtcagcagcattcattatgttcattaaattaccaactagctacccaagtagcataaagtattaataaatttgaaagtgaagcttattgtgaaggctttttttcctggcactaatgctgtatcatgatgtacacaagagctcagcaccttcacctcaaatcatagtactctcctacttgaagtaatgtgtactagctgcttccaaaaaattttacagtctttcaaaatgttggcctgactcttgattagtaaggtgaaaaattaagatttgaaaagcattacagttgaaacattaattaaatagcataagatcaatggaaatgtgacaaccatcaacagtgtttaaatagcacagacagcctcaaaataactggggagttgctactgaactaaaactttgtggtatacagttacagcataaagttagggcattttctagaattcctgggttttaccagctcttatcatctcttgtcatcaaattctaacgttactgcccagttatatgactgattttgctgttacggtagtactccgaggtgttttgtcctgaagtcagtaatgcacctaatcttatattttagggtaaggaaagaggaaaagaaaaataaccaccagttaaatactaaacagaagtgtttgattcacttatcttcattcaacttttcagtatatttgtcttatttagtgatttttatgtcacatgctgaaaatatatcccctccagaattaatcagatgtatacaggcctcattcttaggcctgtatacaaaaagagcaaattaatcctaaaccagtagatctgcaaatatcatataggtgagatgccttaaaagccaccagtagaaatgtattaattcatttatctactatctgtaggggataagttaattccattgaaattattgaagagaaactttaaaatttttgaacagttgctagctctagtgagatactctgaacaccagttccttttcagtttccatcttacctactttctgtacctctaaacatcacttcctgatgggctacaaacacgtcacattcagcatagctaaaaccaaactcatcttcactgcctgcccctaatcaacttaactgtacagaccagaaacatatcagagttatttttgagtctccctcacctccaagtctgattggccaccaagtcttcttggtgccatcgattctttcagtagacttttgaaaatcttttacaatctagtgtaaagtttacatttccagttatcatcccaatctgccactgaagtacttcctgcatgccaccttgcccctgcaaatcctctttcctctgagcaccctttcattcaatacacagttcaaaagtcactctctgagactctaattcatcccagaggtgctaagcaaaatcattaacatgacaaccataccagataaatgtcattcctgcttatcatgtcacaccataattatttgtatacatgactgtcactctcacattgctgaggccagcaatggtaatttattcatcccagtctccaccgggggaaacccaatgcctgggacagcgtgggtactagacaagtatttgcacgaacgggtatgtgttttaaattgtggtaacttacaaactattaagtatatgtacccctataacaaattgtccccagaaagccttgctttttgtctcatttattgttcaaagtcattttggctgcttaaattcttcttttcaaagtgtttttaagctctgtcaaaagcaggagtcaacaggcttggagagaaggcctgcacgcatttgatctgtgaggcagagagttgaacttttagtgtgcaaatgttgtgacatctatttggtcttcatagagatctttttaacacctacttttgggggtggcaggtggttgttggggggggggggtctcaggtgtgtcccaggtggatgacatttctagataagtgagctaagaataaaattcctaaccaaaaagtaaactgcttctatttgaggacaggcacagcttaaagacaaactgcttcattctcagcattctattgtcaactgttcaagattattctgctcagaggctgatctacatcattattgtcaaattttaaaaacagccgggttcccatagatatttagaacataggcatggttctcatatagtcttataagacagctgtagatcagacctcacccaaattactctactcactcacagactgaagaagagttccctttgcaaatacttaattactcactctggagatacatgtatcaccctactggatagcataataatataaaaatactatctgccttattcatacccattctgtcatgagtggacaattaaaaagagttttccagaagtacatgacatgtgataacatcacttttagggctaatcgtattttaacattttctcagttttaatttctaatacagtaaatattgacatatacagcccaaatcccctggaggtcctcaataattttttattttaatttggccctgagatcaaagagtctaaagactgctgagatattctttaagtgacacaaggcatatggactgttttcaatagcaaaggctgcaaagacacccacaaatcataactaattccagtattttcgcttttattgagagccttatggaaggctttcatgttgtcttcttccctaagattgatacttattccagcttcaatttttttgttttcctttctgccctactgatttcaaaaggaagctgcatttcttcacagtgtcagggttataactccggatagcaatcttggttatgattttaaaaacaacgtattaaaagctacaataataagtaaatatatgaaatagtgaaaatggttaaatgctcacaggtattatcctgactatacaaggaatcacaatgtgttttaaaatgaatatagacagagcacttaaaaaaaaaacattactgtacttcaggagcttaaagtactttcatttcttttgtaaaatctttgaagtaaataaaggcagggaaagatgaaaaaaatagggtttttttcttaacatcactagttaaataagcattacttttaatggagcccttagaggaagtggcaaacaaaatatcaaagccagtgaatttatatactactgtcattttacctaggttacagattacttataccacttttgcaccaagtccctgtagttttaaatgcaaatccatgaaactcgatgagcattctttaatcccacttagttcctaaacttttgaaagagaatggccctttttgtctttgctctgtcattatgtttggtatgcagaagatatttaaaagtatctgtgcatttgattgatttgacttgcgagtttcttgtcatgtttaagccatattgtataaatacttttaattttactgcttatttaaccgtggctaaatacaggaaaggcaacccatggaaaggtgagaataatctcacatggagtgcatgcatactccgtaaaaacatacatgttacctgacttttctatatggctggccacagatagctttgaaagagctaagaaaaaaggggagattcttaagtttaaccatttcactagaacagattaaacaaatgttaaattcttcccctcctaaacaaaatcagtacaaatgacttttttttaataccatgctaaaatgaggtcaactcagtacaatttagaatctgagggaagacaacatgctgaacaagaaccaaaaaccacaataaatcagagttaatagagctatcataatagggtattaaaatatatcctcagagatctaaaggaagattttatgaaatgaagaacatttattatgaaataggaacaaattcggcctaagaatgagaaaatacattaattcatgaaactaaaaacttaaaagataggatactagtggagtgtagaactgaaatgaaactagaatgtggaagtcacatacagaagttctaacatatgtctaaaaagttatccatggggcaataaaatacaggttaaagaggaagaaataacagctgaggttttctaaaaacagaataaagtattcagttcttaaactgagcgaccaggatacatttgatcagtagcattcagagagatttgaataccacagttaacaagcgtgatctaatagtgatatagagaagttcgcacccaagagagactgcacagagagacctagagtctcttcaaacacaaatggtttatttatatacataggccataaatggaatttcaatacattcccccaaaacagataccatacaaggctacattcattgattacaacccacttacattagaaaccaccagtgaaataacatcccaaatccttataactagaaacaactagaaactgaaatccttacatctaggattgcttataaataattcatgcatcaaagatgtaaccaaaataagtatttcacagtgtctaaaactaaatgatgatgaaggcactgcatttcaaaacctggtgaaatggagccaaactgtacttaaaaaaaaaaaaaaaaacagcctgtgtaaactctacatattagaaaggttaaaaataaacaaaccaagcattcagctcaagccagaaaaagcaccagagaaatcaacaaaaagtacaaggaattaaaagcaaatagaaggcgatagtaaaatttaagcaataaatagtttagtaagagatacagttttggaaatatgatgaaggaaaaaacctaccgtatatctgtagctacattaaaaacattcaagaattggccgggcacggtgactcacacctataatcccagcactttgggaggccaaggcgggcagatcaccaggtcaggagttcaagaccagcctggccaacatggcgaaaccccgtctctactaaaaatacaaaaattagctggacatggtggcaggcgccagtaatcccagctactcgggaggctgaggcaggagaatcgtttgaacctgggaggcagaggttgcagtgaaccaagattgcaccattgcactccagcctgggcgacagggtgatactccgtcacaaaaaaaaaaaaaaaaattcgaaagttgttaatttgcttaggtgtgatagtgtgttttctttaaatgcttatcttttagagtttgatactaaattatgactaaaacacctgagatttgcttcaatatatattggggacgaaacagaaatgaaatgagaatggccatgagctgttgatcattataactgaatgatgactacatgaatgctactgtactattgggctttggtgtctgtttaacattttctataataaaaagctaaaaataatacatattttaaaagaaagaaaataagcatttaagactttataactctatactaataaatgtttaagcctataaataagcatagtaaaataacatttagtgaacacatggtatgtggtgtgtgccaatctctgttctgagccatttacaagtatcagctcaattttaaactctagtctcactatgcgatcttggccagttacttcacctgaatgtgccttatttattcaacctcagaatgtgccttatttattcaacctgaaatggagataatactggtacccataccatagggttactgtgaggactaagtcagtacatgtaaatacctataagagaacatggcacatgaagtacaacacacgttagtgatcactaagaactgaataaaagaatgagttttccacctgttagggcccacaagtcctggccaaggctacatatgaacagtaacacacagaagatttaatgcaatgttgatttaaacaaacaaggcttagcaccagaatggaaatgtataggccaagtcttgcttatttgaacactgatgcaaaaatgacaataaaaagctgtctaataaaacccagtatattaaaagaattacacatcatgaaaaacttatcctagtaatgtagagctggtgttaagcttttgatatattatcaaaagtttatcagtgaattcaggacattttaagagacatttcaaaaaaaaatcgatattgaaaagcgtacaataaaacaacacccattcatgatcccccccccccaaaaaaaacacttagagtaaaaatagaaagcatcctctttacctttataattgttatttaccagatgtatattagcaaacatttaaatttaatattaaaaacttagaagcttgaacatttaagatacatgatacttgctttcagttctagcacgtaagcctatctaggtgctagccaacacagtaaaagcagaagatagaagaagcgtaaaagataaaaagagggaaagttcgcattattggcagataaagatgtggtcaactacctagagaagccacaaactattaaaacttaagcagggttcttctgtttgaccggatacaatttcaccatgtgaaaatcagtaaccttcccatgcatgaagtgaaaccaaacagaaaatgttatcacaaaaggaggccattaataggggtaataaactctaaagtacctaaaaatttaccaaaaatggaattggcaaagactataaagaaaacaataaaacctagttaaaagctataaaaggcctgaataaatggagaaaagacattgtgttcatgaagagaaaaactcaagattgaaaagatggtaatttcctcagatccatctatatattcagtgcaacctaatcaaaatcccaacaaaaatgtttgtttgtgttccttaacaatctggtttcaaaattactatgaaacacgatggagtcgggtggaaggtcagagttatttggacatcagtgtaccagtaaaaaatgaaaattatatgtttgaatcactaaaaacaatacgaagtaaatgtagagacagccaagactattacagaaacttgctttatcagatatcaagacttattaaggaattgggatacacgtggggaggtacaaaaaatagacaaacagaataaaaggtcaaaacagagttcagaaataggcttgcatatataagaatgtagtacatgataaaaaggaagctgatgtcagtgagaaaagatcacactgtaaaataagaagtgctgggacaactggttatccaatggaaaaataaaataactgtaatcagaccccttccttacatcaaagcaagaataagactcagatgaattagacaattaaacgtaaaaaagtaaaattagaacatgtaggagagtatctttaaaatacaaggttagagaaagcattctcaaacaagattccaataaaagccaaaaataaaagatgtatcaacttgattacatctaaactgtacttccgtataacaaaatgaccacaaacaatgttaagagaaacagatcggggggcaaaaaaactcacaagtactacagacactataaaaataactcctatataaatcattttggaagaggcaaacttagtagaaaagtgttaattaggcgatttcagaagaggaaatatagatggtcagtattcataaaaagacattcagcctccctggtaatcaaggaaatgtaaattaaaaccctagtaagatacagtcttccactcatcagattggcaaaagtgtttcaagtttaaaatgatgaggagaagcaagtgttctcgtgctgggaatagtatgaacaggtaacagccacttgggaaagaaatatggcagtgtctttaaaactaaaaacaggcatacctgtgaccctagcccttctactcagtacctatgctaaagtgcacaaattcaaacaagctaaatgtccatctagaaggtaaacctggtatgcatgtagcagatgaaataatgagttgaactgaaatgtagtgatacacctaaatctggaaggctgtatctacacgtgtaataatttttacctctggagaggttacctctaaagttggggggtggctaagggggactctggtcttatttgtattaaagatataaaacatgtaatattttaattttatgtaacaattcagaaatgacatttaagtttttcaaaaaacaatgggcacagggcatctgaactccagtctcatttctgccaccagccagcaacatcatcttgaacaattcatttaatccatctgttttctcatcactaatgtggaaactgtgtgccatcacagattcttgtgaaaagtggagttgccaacctggcctgatggaaatttactacctttctaagacttttttgtgaggcaaagagaaccacatttatctttccaaggatttcatagaaagtgctctcattaggaaagttccacttcagtgccaaaataattatttcatatgaaattaattttggaaattgtctgttttgagccatataattccatttttaaatttttcatattctgtaagttcaatttaactgtttggaattgttaaaaaaaaattcagagcccttcatcactggctgcttgtccaataacgtctagttaagaggttctctttattgttttttctattgtaccacccaactcatcaccaacaccaaatcatctttagctctcctaagtctacttctgaacctctcatttcctattagatatcaagctaaacgtctcatgaaccaatttgggatactccactttcataaacaaatctcacctttatgctagcttccaaatccctcccccaccagcatttcattcagtcgtgtctttagagtaaatgtcaaaacagtctacttagtttctatgaaaatacatgacagtaatttcatttcaatatatttggtccctttgtacatctgaaatcgtatcttttttttttctcccccaggtatggagcagtttcagcaggaatgttatgtgcccttaccaccctgtcccagcaactggagaatgaaaatgctgtggatgttttccaggttgcaaaaatgatcaatcttatgaggcctggagtattcacagacattgtaagtagtttgcttatgtgtaaaacctgtactacatcagttgaaactcagactcacagtttagagcagtagttctcaattgggggtgattttgccccccaggggacatttggccatgtctggagacttttttgcttgtcacaactgcagatggatggcatctagaggatacaagccagagatgctgctaagcaaactacacagcacaagacagccctcaacaccatagaattatgtggcccaaaatgtcagtagtgctcaggttgagaagccctgctttagaggatagtattctctggttatcttcattaaccagatattaaccagatattggttatcttcattaaccaataatgattgttcattaacaatcagcactgagaattggttccaagctaacagagatcaaaaggacatgaagaaggtataggtcttgactataataaattcaaatgattttttttttagtttttttagataacatttatgctattgctgtttctctaagtgtgtttttcacaaattacccatttgatgaactacaaaaagcnnnnnnnnnnnnnnnnnnnntataggtcttgactataataaattcaaatgattttttttttagtttttttagataacatttatgctattgctgtttctctagtgtgtttttcacaattaccattttaattggtatttccaccttatgtgaaatcactaaactgttctttggctcaaactgtcttcctcttgtttttcaggaacaataccagttcatctataaagcaatgcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcacagtagctatgtggacaatgtgttatttccattttgactctctaaaatagctacatcctaaaatcagggctatctttaacaatagcaagatagcaatattatatacaactcagttatgagaccctttagttattctccattaatgcttcttagtttgtaataccatacctcacagtaggtagaagaatgaaaacttctgcaggtgtgtaattttgaaactagtcctctaaaaattccctattactcctatagcaatctaataaaaactacctacatagttactgttttctttccttctttgccaaatgttttataataaatctcttaattacatacatttttctacttaagattaaattggaaatactgtattagcaaaagtcttgggactatctaaactcccacacatagataaatctgatttggagagagaaatttaaaatatttaattaaaggtgatacccacattttcaagtttttaaaagagggagatggctttgtatgcttttgtgtagtttagaacagatacacattagtaaaagataccaataatcattagagctcaaggaagttattaggtgcagcctctggagccatactcacgctgcagtgcataatgggaaaattaggagcattaataagaaatttcagtagtgtttgtaaggaaaataagctacttactgagatctgtttcttctattgcatgtttgcttttgagggacagcttctgtcaaaagtgaaatcatcaccagaactgggcctgttaggaagaatagggttttatttactttttatgtcaattaacttcaacaaaaaggccacgctggctgctgtcatgccatctgggtatgcattaaacattaatgatgatcagcactgaggttctatttatcttgatttggctttcataaagtttgtcagaatggtgctggaggaccagaagtgctaaggagaaagaagctatgggccaagttaaagaatttgaatgcaaaggccaggtcaatggagttttcataaactacataatttaccagggtttatctcatcttctcaatacatagatttaacaacatggaatactctgcttttcaagagctgcgtaagctagtcctgagataagatgttcaagagagcatgctaagttgcatgtgctagatgagagacacctttacagcccctccgctccaaccagaggtgacacaggaagctctgtaaagttcaagtaaagcttgaacacaggaacactacaactgccagatgctgaggagaatcaggaaagcaatgagctagactctttttttagtcaattaagtgggttgttttagatgtatagagtattgatatgagttaacactttttagtagatggcaaagtgggcttgatgttcaaaagtaatgttcgagttagggttcatggtccctttctcagtaattttttcttaataaaagtaaacactggttcaaagacaaatagcaagtattccctcctgtgctatttatagagggctcaattcgtagaaaggcataccctccaatgcaattctgtggctgtcccttacagtggtttcagaatcacgaaaaaacagctagtaaataggatagaaacaataaaagaaagagtttagaagttccctgtgagcaatctgtgtgtcttcagcgagcttgaaccaaagtcttcatatcctgacccactgaattataagcaattgctacttgcccatcttgccaaagtagtccaaacacacttcaatgaggacagttatatttagcaggtcctcacccctgcaagagacagcatatcctcactattattattcatgtgttattggcaaaaacatagcttgcatctttccagaggcagagtttcaaagacagggttttctttgagacataagcacattgcttaagtacataacaaggttattaacacttgcactcaggggaaaggaaatagctattgcaaattaatgtgtgcaacttaataaaataagctgtttgtgtatatgaatttagctctaggtaagcaaaatgcacacatcatataaaaataaattgcaatgatcagaccaagtggctgtgctggacatcaaagaaaagacatgctgttgccatcaggagaactctttcttatatgcgatagccaagatatcttctttaatatgaaaaaagttaatttctgaatttcaaaaagagtaagattagctaattggtcttcctaatttttatgcctttagagtttttagtctattcaagtagaagagtcca

SEQ ID NO: 13769 - DNA, 58844 bp, Human
ctggtgggacatttctcttcctacagactcagggcttctccccacagtctttcccatgttctctgcagcagtctccgggtagctgaacttaggggtgacttgaggctccaagagcaagaatttgcaaaggccccagcagaagttgcaaggcatttatgatctagcttcagaagttccaggatatggtcatttccactgtattctattggtttaacaaattgctaaaacctgcccaaattcaaagcgagaaagtatagaccccacctctcaacgaaaggagtaacaaataatttgccaccatttttaaaccatcatgctatctcaccaagtcctcaacaaagcctcctaactgatttgctgtcctcagattctcattagtgacagatcgggatgcagcaatgcgcagagtagaaaaagtgagggttttggaagccaacagccagccctacatcctggttcaagcaggatccaccactcagcaaccagttgagcttgttaggttacttaactcagagccccagtgttcttgagtgtaaaatgaggataatacactatagttgccaagaaaatgtacttcttggatcttgcagtgtagatagcataactgaccaatggctccgcctcaactgctgagctctgctgaaatccataccctgatatttatccctaggttgctgcaaaggccagcttcctaaggctgctcccagctcatgactgagcacagcagggatactaaggcaggcctctttctgggagatgccagacttctgggacaagcccatttggctaaaggattccccaccccaatggccttgctgaactttttatacatggactgtatatatatcaaatgcttccttccacccaaccttccttccttgcttgcctctttccttcacaaggatcacacctgcatcccaggtccagctccctgttttccctcaaaactctcttgcatagtacccccatctgggactgtttctggaggactgggacaaacacaacctcctattcataggactgccaagggtattaaatgagtagaactgtgcaaagaaactagtaaagggctggcgtagaagaaacactcatttaacgaacacttcttgagtcctggctgtgtgcaggtcttggtcctgggtgtctgggacaccacagtgagcaaagcaggcaagaacaccagcgatgcctgctttaagctccttcccaacttccacatctttaacaggataccaagagcccttcaaagtctgacctcttggggcctcaacacctccgactccaccccctgaacacctgagcctacagtcaaaaggaacttccttcttgcttcctacaggttttgctctttcacccccaatgcctttgctcaccgtttccttctccgtgaaatgcctcctcctcccttttttgcacatcttccattcttgcacatgccccttacgtgacaaacttatgcatcccccaggccccagttcaatgtggggccctaggtcatccaggcagaacatgcttgctggcatgatctcagcaggcacctggtagaagcacttgctacattgtgttgtaattgcggtaacggtgtccccgctaacttgcgagcgcctctagagcaggggaatgtcccagccaccttgaatccccagcgcgtggcccatgggaggccctcagacctatctgcggaatgagtaaatgagtgtgtgaaccaggttcggcaatttcggtggggcgagcgctgggcctgcggtgcagggcgctgggagcggccaggccgggcctggctcaggcgccgcagccactcagggccaccggggaccggccggggagggcgcgggccgaatcactgccgccgccgcagggcacatgactgcggcctccgcccccgcccgcctccccgcgcagtcgccggcggttgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgagtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaaggtgaggcggggcgggctgtgtgtgtgttgtggagtcgtccagctcaccctcccatccctgctgctacatcttgtatgggaaagaccagcactcaggcagaccctccgcgctagagctcttcttgcgtccctgtcttccagggcttggtaggcgagggttaaagaaggatgaggaaggatggagccgactctgttccctttacagtgataagtaaggctatggatcctgacttttaaaaaggccttcggttgtgttctgtcgtttgcatctctccccactccttccgtctacaccccaatctcaggtgggcccaaacttgtttccttcccacttcatgaagaaacagaactgaatgaaagacaccgcagaagaggcaggttatgttgtctgcttgctgtagcctttgaagtggtgtgcgcctggggatgagacgtgggtgtgcggtctattgtgttcttgccctcttgggctgggcaggggcagttggtagctgggccagtcctttaggctgggtgacaattcatccatcagtctttgctgaacgctgacttagtggctttgtatcttgtaccaacagtctgtgttgctttgtctcaccatgaattcttgtttttctcaaacggccataattttcaggcacagatgcatttagataccctacaagaatctgaacttgtctcttcctctagatgattgggctggagagccagtcctttaagaagacttcatcttttgatttcactggtcatttcatctgccctttcccccacatccaccaagctgtgtcaaaagaggaacaaaagagaattactgggatcattttttccttaaaaaagaaaaataatcactggagcagcagcctttcttgttagcatccataactgcacgcttcatttctcccactggtctgcacttgctgcggccagataaaaaagcccaggcctagtctactttgaatcactgcactctccagtcagtaaagctattttattccaggtggcaatggatatcttcctttaactgagtttccaaaagtaattaagtgagtacctgaaatctggcagttaaaggcagtttttcaaaaagcaccatggcaaagcataatgtaatttttaaagttcacattgccaagggaagacaaggcccactgtctgagcgtctcgagggtcagtttcctttgagcaatcatgttcaaggaaaaaagaaactgaatcctttctccactcctgtccatgtccaaatccatggtgagctgtgtttgaggatgtaaactcttgctttgggtgactagagtaaagcaatccaattatagtaaatatgtgagttttcttatatggccttgaaaggctgtttcaaggagccctataggatgagtgatcttccccgtggttcccatatagccagcccttagattctctgtgtgtctccatttctctgggtgagggggtggctgtaaggcaacttggctggggcctgagtttgtgttgatatttccaagtggttttctccatgaggaatggactctgttctgataagtaatagtacagggaagtggactttcagagctgctcaatcccagctaaggaggactgcacggtgtattgtatgaaactaaaggacagggctagtttcagtgggcaggtgtggaaatactgttgtcattagaggtaagtcacacatcgctattctgctttttcctggattacctgtagggtggtaggtagcatgggacagtgggaaagattgaggatgttacactcctgggcatgaaacctagcttccactatgtcccagctcggtgaccgtgggctgtttaatcttacttgattcatgttttccccatctgtaaatagggataataaggactaacgatcacatctgctttgtcaaataattcttataaccttaaggtgtgatctttctgggatatagttagtgcttaataggtgatagcaactttatttttattagaagccacacaaagaaaatacgtgagatttggagtcagattccatatgttcaaatcctatccttgccagtataagctttatgacttacgtcaaattacttaacttacttggtcctcaatttcattgcttgtaaaactggggatatgagctgttagctaacttgggcacagtgatgcatttaccatgaaactcgcaaagttaagctttgggtctctcacttgcacagacccttgcgaagccctgtacctcattctgtatcccaaattttcttttttcttaagaaggacccttcaaattgtataagcttcaggacccacaaaacctggatttgtctctgcatgtgtattattgtaggaccaagtataaagcacttagcatagtatcaggcacagaataggtaatcaatatgtggcagtcatctttattgccactagtattactatgggagaattcattcataacttgattctaatgtagttataatataatctactctgatatttccagttctttgttttttcatttgaagattgtctatgccccgacttgtctatgtcaaaaagggaagagggaaaagggatgaaattcaaatgagtaggtgtgggaagcttagtaagagaattcctatccaaaaagttgtctcaaatgataattgtccttgaaccctgcagtgaccagaggtaactgaagagagacttttaattttggccagtgaatatcgtggaaggaaccaagacaattttgtttcatttttggcctcagtggtgactgcctcgtattgggcaaggcctgtaattgtttctgcttcaattttctcatttgcaagagaggcataatagtacttctctttttcccacaccctcttcctaggggatattgtgagcattaataaggcatttccttacaagcgtttgggccttcatgaagagagagctttgcagagacccagcagttccttttcctcccttaggcctggaaaggcaggagtttacgttacatttcatctggtatcccagtgaactgccttgacacctagcacagtgcctgagatacatattaaatgcctcttcactcgcctgtgatcattttaatagaaagaagagtgtcctgagaatcagcagaactgaatcaaacattttttttctgtccctaaggatttcttggactaagctgaacaagcacagtggcaagttatttaatccctcaaatcctaaggatcctcattttgaaaataggaacaataaggataagaatacttaactcagagttgtcacaagaatgaaataatatgatatctataaagcacccagcacaatgcctcgcacaatgccctgaacgttaacagttgttatgtctttagctatatttgtcatctgtgaattgaaacttattatacaagctatggttcctcttagctccaaacttctgagatcccatgacctttaagagcagctatgcagttcagaatattaagtttgcgctcctaatctctgcagacgtgctggcaggttgactgtctcccagtaatagggatgcagaactggccacagtcagggctggccaacaagggatgggatggcaagggaaccagtgggagactgtttacacctttgacttcctcttcacaggtcaaggcaggactgtagcattaggtctcagagatgcaatgaacaggacaaatacacttccccttcatctggacctgaggctctgggcaagtcagtaccagctggtttcttttgggagccatagaaactctggagctgttctaccgattcctcaagaagtaaaatataggccaggcgtggtggctcacgcctgttatcctaacactttgggaggctgaatcgggtggatcacaaggtcgggagttcgagaccagcctggccaatatggtgaaaccctgtctctactaaaaatacagaaattagctaggcatggtggcaggtgcctgtagtcccagctactcgggaggctgaggcaggagaatcgcttgaatccgggaggcggaggttgcagtgagccaagatggctcccttgaactccagcctgggcgacagagcaagactctgtctcaaaaaaaataaaaataaaaataaaaaaagaagtaaaatgtaatcactgataaccagattgctttgattggtgactatgggatcttgttttttaaagtcaaatcagcaaaacatctttattgatgtgtatgtaaaggcattcagctatatatcattttaaaaggctccttcttgcatatctacctcatctcctgagttgcctctattcaaagaagacttatcttagtctgagatttttcttgatcagaaaaaaacctgtaaagatatcttaaatctgttatcttacggtcaaggaaattgaggctcttggaatagaagtgacttatctaaagtcaaatggagagggaaggagagagcgtgccagctagccttctgatcctgaacccacttttcccatctcaaggatgaccatacatcccatttgcctggaatagtcctacatggtttctgtgtacctgttgtgctggtgtaatcactaacaccccctttcctccaaaagatttctgctttggacaataaattctatggccatccctcacctctcatgctacattgtccttacagaccacaatgtatcccgcttcttggctctcttaaggagttgaggcctactcaaactagctctggcaagataggattcttttttttgtttctgtaaatctggaaggggaagctcatagaaatcaaagggcaagaaccacggcacagtaaggcctcctgagaggacaaccgaaagtggaaagtcagcaggaagcaggcacactctgcctcccactttttcctctgctttctccaccaacaggcttcctctgtttactcagcctggctctgtactcatccgggcttgctcagccccgcctcagtgtgactttccagctgttgacctctcatagacatgcttcatctcctagtttctcttttccaagtttataacggagcaatgtgattggctcagcacaggaagaaactatagcactgtaaacggaggcagtgtcgttaatttccttgcaagattctctaactcctaagcaaaattatccaaattctttcctggcttttagaaacacgatcttgtgatatcaaaatcatattaagtttattttagtgtcttactaattcatgttgactatgagtgcattccttattaatgattaagacaatatagtaggctaacagttgtcagcatagcccctagactctaggagatgcatctaaatcacttacaaagatttagaaaataccagaccccatcccagacttgctgaatcagactcattaggaacagaactcaggttaaagtgcttatcataaaatccattactggaggcaggttgctgtgggatcgtaatctgcaattttgggaatatgcatttttaaaaaaggtgtttatatttgtatagtgattattttagaccatgtcttcattccttaagatggtaattctgactgaggagattactacttataattactattaatctgcaagtttacattaaaggaaatattatttggtgaggaggggaagattcctgcctgtggaaactactttgctttattgttaaataaatccaagatttcattctgtcaggccacagcagaggggccatctgttctgccagacatttgcttatttcccaggaagaatcaggaggtggaattataagctcattgatgaaaacataggatgttggccaagttactagacattcctggccatatcatcaagatatgcactatctatacactatacactaaggaagggaccatttttaatccaagctggtaactggaaaaaacaaccaaggaaaaataaagaccactttaggtgtttgctttctatatctaaatgcacttttgggtacatgctttggcagtcattctttcatttgacaaatatttactgagtgtgtaccatttgcaaggcagtgtgctaagagctatggatataacactaaacaagaggcagtctctacccttgcagattttataatccaatttaaactcctgggcccctcatattcttaaaaattattgaggaccccaaagaacttatgtttccatacctattgatagttacaatattagaaattgaaactgatatgtatttttgagaaatgtttaaaacagaagactacacaagcacatattccaatatgacatcattatatatcacgtaacctctggaagactccactctacactcagagaaataatagaattaaaaacgcaaatgataccttagtattaaaatagttttgaccttgtgggcgcctcctaagaaggtcttcgggctccccaggggtcctgagatcacactttgagaactgttgatctagttttcatttaattatttttttagaatatttttaaaaatacataatatccctgttttatattcctgtaaggccagtttggaagctatcttgttaatgttttcaaacaaccaggattttgcttggtgtgtctttgatttactgtgtccttttggctttcctgtgagtccagtgttaaaaacaggagtttgggccatcagtaattccagttccacaatctcttgtctttccccgagtgctgatcaaagtagacaagagcattcatatctccataattgaattactcagtaattcccttctggcctcagccctgcggggattttcaacccatatgacgtaatttggtattttaatctagtatgaaagctctctttgaaggtagatgtcctgtcgtatttagttttgtgtcttttcttactgccaaatgcaatgtcttattcaaaatagatggtcagtaagtgttacttggatgaatagagaaaataatttctttggaaatgattttgtttgcattttgttgtttagtctcacattttgcctcactctgtaggccagtggtcacatgtttgtctcatgaatgatttatacctttaaaatctggaaacttcacgtattggtccagatttccagcttctcttgaaacatgtggatgttctttggtactcgtcataccaagttctgtgtggtagctgtctcggcagaaaagaggctgacccttagaagagacctgccttccctgtttcccactgtcttagtccattcaggctgctgtcacaaaatagcatagactgggtggcttataaacaacagaaatttatttcttacagttctggaggctaggaagtccaagatcaaggccccggcagatttggggtatggtgagggtccactgcctcatagattatggtcttctcactctaacctcacatggcaaatgagctctctggggtaccttttatgagaactaatcccattcgagagggttctacgctcgtgacctaatcacctccaaaggccccacctcctaatctcaccaccttgggggtaaggatatcaacaaaggagttttgaggggacataaacattcagaccacagcacccaccgtcctttgcgcccttattggctcccaaggcccagtgaaggtatccgttgttgtgcatgtgctgttgtgtttcttagagtagagaaatgtttctctatatctgacactccttaccaaaagaaggaaaatgaaagatagcttgagaggatcatgtgtttaacagaaatgggggagggcatgtttctctgtagaaatgaatattgctgctggggtttgacatgcaaacaaatgtacaaacccatggcctgtgtcactcatttgccctagccatctggccccttcagcatctgaattttacacactttccagagacagtgtgaggcagagtgccattgttacactaatgtaatcactcatcacaagtcccattttttaaaattcattttttaattgacaagtcaaaattgtacatatttagggcatgcaacatgatgttttgagagagatatacatatagatatacatagtgaaatggctaaatcaagctgtttaacatacaccttacctcaattacttatctttgttttgtggtaagaacacaaaatctaatctcagcatttttcaaatatacaatattttggggttttattttattttatttttgtttttgtttttgtttttgttttgagatagggcttctctctgtcacccaggctggagtacagtgccactaccatggctcactgcagccttgacctcctgggttcaagccatcctcctgccttaaactctaaagttgctggaactacaggtgtgcaccatgccaggctaatttttaaatatttttttgtagagatggggtcttgctgtgttgcccaggctggtctcaaattcctgagcttaagcaatcctcccacctttgcctcctaaagtgctgggattacaggcgtgagccactgtgcctggcccaatatattgttatccactgtgatcaccatgatgtacattagatctcttgaatttgtttatatcaaactgaaattttgtgtcctttgactaacatctcaccagtcctcccagcgcccacaattcccattttaaggatattttcttttaacactgtacttctgataatcaacagtagtggaagaggagacatagaaataggtaggtaatgaaaatattacttatttcaattttgagagatataatcacaaccaaacaggttgcaaaataatgagactggctgtgcaagttacacacagaatgtgggccttgtttccgtgtccttatttcttatttattcacatctgaaactcctctttctcacccgcctccccactccccatatatgtatatatatattcccctcccgctcccaattttcacctggttctatgtttaagtttctatcggtagctgctttttttccctttaggtcatcagttctcaaacttggctgtacatttgtaatcacctagaaactttcaaaaataagttagtgggtattttgtagcaggaggttttttgggattgtcattccaccatattgtcctgtatgtaatttataaacaaagtacagttcacccatgagctacatttgaatctgaactatcagagctcattagttaaaattatgacagttgcaaaatgaaaatgagttaagcaacagtgacataaataaatgaatgccaatacatttttactgagttaaaataaggtcagggaataagagtagaatgttaatggcagtttctttcttttatgtaaacagtggaaattacttaaattactgcatgagtctgggttgggtttgcttcgtttcagggagcaattttaaaaaacaaagcaaatcaattggtgttttgccatttgatgagttttattaatctggagtccagtatacaattaggccaatataccatccatacacaattagggcaagttctccaagttggtctgcattatctctggatgaatttagactgtgcagatggcaacatggatgcttaagttgtgtttaattatgaagtagcactttactgaccttaaagaacaaccagtagtgctctcgaatcccgaaactttccttaaaggtattactgattcccgtgaaagcctaatggattccctgagtgcttatttttatcacttggaagtggcttacatcaggacagctggtttcaccactctcatggtgttgccttcccaaaagattgctgttaggctgacttgggttgtggctgtattaagtcatgtcagtgttcagcagtcaagctaatccagcctgcatctgttccttcatctgcaggtcaggtgtcagcctggccagcgactccatgttcactacacacagctcagagaggttgttctcagttctgtctctgaccagccttctgtgtacccaaatggaagcttatgctggttgaagattcttttacttttgttttaaaacagtctcacttcatacatggtaaaaactgttatgcttctccagtaattcaagaaatgcaagttcaaacaagaagatgctattttgccactactgaggaagcaaagatttctgaaaaccttaaacaccaatattgggatggatatgctgaaatggttgctcatacactgctttctggagcaacttgttgatatttaaaggctgatgagttcatgaaaactttttgtctctagacccaataatcccaatctaggagtctattctaagaaattattcactgatttgggccaggtgtggtgcctcatgcctgtagtcccagcactttgggaggccgaggtaggtggatcacttgaggccaggagttagagaccagcctggcccacatggttaaaccccatctctactaaaaatacaaaaagtagctgggtgtagtggtgtgcacctgtaatcccagctactccagtggctgaggcatgacagtcaaaagttgcagtgagccaagattgcaccactgcactccagcctgagtgacaaaagcaagactctgtctcaaaaaaagaaaacaaaattattcactaatttggacaaatatattcaagaacatttacttcagcatgaaagcaacacaaatgtcctatagtaaaagaatgattaaataaactgatttagtatatttttttaaatatactaatacagtggattagtatacagacattaaaataacagtttcaaaacctatttaataacaaggataatcgtttataaaagatgagtcaaaaaatgatacaatacatatgatctcaattttgtttaaaatacacatatatatgactagaccagagggaaataaacccatatgttaacagcgatagtgtggattacaggggatttaaattttgttccttttactttcttcattgtccaaattttctgtgacaaatataatggaatgggtagggaatggatggagtagcatttacctgatttaaagtaacaacaggctgggcacggtggctcacacctgtaatctcaacactttgggaggctgaggtgggcagatcacctgagatcaggagttcaagatcagcctgactaacatggtgaagccctttctctactaaaaatacaaaattagccaggtgtggtcatgtgtgcctgtaatcccagctactcgagaggctgaggcaggagaatcgcttgaacccgggaggcggaggttgtggtgagccgagtcatgccactgcactccagcctgggcaacagaatgagactccctctcaaaaaataaataagtaactgaataaataaaaaataaagtaacaacaatcagtagcatcatttgtgaatagaaattggaggcaacacatgactttttctgcacatttgtagtaatgttatctgctactttaaacatctcttctaatatgaatatagaaatttctgtagattgataatttatcataatatctaggtatttttcccttagataaatgtgatgttttattgcttacaagtctagtttgttccttgttatatcaaggagtttttagaattcaccaataaaatgagaaggtaggagatcttgtctaccattatatctccaatacctagaacagtggcttagcacaaaggaattgctaagttaatatttgtggaaagaatgaaagagtttcatcagttttaaggttgtgaaaatcctatgctatacttgctatgaaaaaggatgttataaaaaattcattaaaaccaaaattgctaaagacagatctaacagacttagaactaatgtttgtgtgcctttggcatattaattatgcataaaaatagaccctgctaattccaaactagtcttaaccatttatgaaaggaggccaaaatgtctccttgaaaaataatatttgcagctaagaaagttactgtctcttcttgattctgcagtactgaaattcagactttttatttattcagatcacctttcttacatattatttagaatatgcggcattttgccacattgaagattttaccaagaagaactgggtaaacagcagaagatgaatgcctggcacagcgttgtgctctacgctgcggtatcatctgtttcttcattaattatttattgtgtcccttctgtgccagaaaccatgttatgtgctggggatccatgaaaaagatacagttcttagtatcagacccaatctgacactaaagactaatgaacacattttccttataaaacttgtgaagtttcatgaaagcagagagaaaacacatagttcagaggggccttctgagagatggcacttctgaattgagccctgaagcccaagtagaagtgaaccaggtgataagggccctgcagagacttctgggtgaagggcggtgagtgactcaggccaaggcactggctgagaacttgtgtggtgggtgctaggtaacagtagatggttgcgtgttactggtgcataaagtgcctaccaggaaaagacagcgacaggtgacgcagttgcatcagatcacaacaggtcaaggactgtggactttatcctttgagcaggggtggagtatctgttcccttaggcacttttgacaggcttctctgaagcctgagatggatgaagcatttgaaaggaaaaaggctggagagagggagaccagttaggagcctacatacagtattgtcacagtccaagccaatgatgaaatgtgccttggggtagaaatggggaagaggaggaggtgaaatcagcaggacttagtgatcaactaggggagaaaatcatgagtccattttggtcatgttgtcttggagcagcctgtgagatgtttagatgggggaattttatcacagatccatgctactggaaggatctaaataatttcaggcataagctgtttgttaggctgaattactgagtcttgcacataatttttcactccctgttacatgcatgttggttttgtgtccttagctaaatttcttcttacagacagggcctatgcctgtttgcagggcatagtccgggcacatagaaagctctcagtaggtacatattgggtgattaactgaaaagtatgttttttagtccaattattaatttagctgttgacactgtgaattcaccatagaacttgataattttccagtattttgttttagtggtagtgccacagtattgtgcgtggaaaaattcattatgttcgtcttggttaaaactaataagcaacagttatattgtgactccacagtgccactcttaatatccagagtcacactgtaaaactgatttaaggccttatgttgctttttcatttagtgtaactaagaagactcagctgattacaaggtttgtctggtggctgtcaccaccacagcagaaccctcggtgaggaagatcagttgttcccaagccatggctttctgttcagactggcaaagggcgcctttgagggggacactagctcgttgtatctggcggaatgaataacttcctgtgccagacagtccgcggtcttgaggctgaggttattatttgttagtttctcaggccttcctttgccgagcaagctcctgggagtgcacacttgaatgccctgaggatcagaaatagaaggggcagaaattaaaagtttaagtcaaaacagagccctctctgggccatcttgtggcaggaggttgaggtgctttctttggacccattagcatactggggctgcgcggctgcctggaaactctagagttgaactctccctttttcggttcctcacctgtgggctccttactaggagctgacagtgacctcacgcagctgccctagtttcctttcctccagatggcacgggtaacactcgaggaaaccctgagagttcagagtccaacttatggcttctccatagtttcactgtccctctgggctagagttgccaaataaaataaaatacaggacaaccagttaaatttgaatttcagataacaaataacattttagtatgagtctgtctcgtgtgatatttcggttcagtccgatgtatcagttgttaatgtcctgccatatttatctctctgatgcactttttcttgaattatttgaagtaagttgtagatatcacacactttgttcctaaatccttcagcatgcatctcctatgaataaaaacatttttgatgtagcccatgcaatatttgggacataattatattataaaattatttgttgtttatctgaaatacaaatttaactgggtatcccaggttttatttgctaaatctggcaactctaccctcagggtgccatggggtggcagctgctggatgggtgagtaaatctgcactcctggacttggtcagatttgatttcatttactggctttgtgacttgggacagccagtgccaccatttctttgtctgcaaaatggggatttttattttgtagtgtcagtgtaaaactcagagataaggtacattataaagcccctagcatagcacctgactttagcagactcacagtagattgcagctggcgtggcagtaatggtaactgaatagtaactgccattctctgagctgaaagtgagaaaataaaaataaagacacactgttttagaaatgttagcagctgtatttacaacttccctctgttctctcattccccatctctcttcctacttagtgcattcgcatgagcacacacacacacacacacacacacacacacactcactcactctccagcacgtgatctactctgggattgacagagggtttcctgacaaacatccaacttgtaaggtggaggaaaagagacatatgaaagcagcaggaaaagccaccactcttgagggcaagatttgaagggagtaaaaggggctatgaggatttgtctgagtgctggtgactcaactaagaagtggccaggcagagaagggctgtgggggtggagggagacagaggagaagccccagctgtaacatggtctgggttggttatgactctggcatgctgccaaggacagtttttattgttcttgtttttcatttgctttgtttcattaagaagtcaaatgtactaaatgtttatttctatcctgaaagttggaggaacaagttcaagtcacactgtttacgcatgtcagaacagccaggtttacccttctttctggtaaccccttctttctggaaacccttccacttgtctttggatttatggttgcctaaaagctggatgccagcccagcaagataaaccagggaggttagccatctgttcatttatgtttgctgattctttcagggttcctaattctgaggtgattttcttcacatgaacaaataaatgagatctcaagtcctttctcactggaaacttcacacactatgatgcttgtcaggaaaaattaggcaggaatacagagtgctcactcaactgtcctgacagtaataggaagagaagtgcggtggagtcgagagtgggggcggctgctcctgggcctttgcagcagagcagaccgcagctgaggcagcatcaggctcgcctttgttttgctagaacagaggaaagccaagatgaagtgagttctctttgtgtccattccttctccttgccttagggtctatccataacatgctacagaatctgagtttcttagattttcacttaaaaaaaaagataagggaacatttttttttctgcttacagaagtaatttatttctggtgtaaaaatccaaacaaaagcaacagtgagtggaagactcctcctaatccggacctgaattataactgatacaaattctcgacactcaaagttcacattttggtttgtttatttgcagtctgtgcttttatattatttttgtatttcagccgtttttacagtaaaaatacaaggcttttctccattaacagatagaggactgttgggaataccaggtgttaggtttctgttaacctcaggcgctgtatttatcaggcctctactgccacggtgagtaacaagtaactccccagtctcgttgcttataacaataatatgtgggtgtgcagccagctcagctggctcagtggaacgaggctggactccaggcttctggtccgctttaggactagtctacacatctccgttttagaacctaggctgaaggatcagcagctacctgtggcctgctcttctcttttccaagggtggcaacttcaaggtggcagatagaaacttgccatgcatcttaaggccttagctccaaattgatacattgccattccacccacatcctgttggtcaaatctagtcacttggcctagcctgaagtcagtgaggcagggagaatacttcacccttaggggagtcatggtgtattaatttgctagggcttcccgaatgaatacaacagactgggtggcttaagcaacagaaatttgtctcatagttctggatgctagaagtctgagatcaaggtattggcagagttggtttcttctgaggcctgtcttcttggcttgtagagggctgtcagttctgcgtgttttcacgtggccttccctctgtgcttgtctgtgtcccagtttcctcctccagttaggacaccggtcctattagcagggcctaccctcatgacctcatttaaccttcatcagctctttaaagaccccgactccaaatacaggcacattgtgaggtattgggggttaggacttcagcttaggaatttagagtatggggggcattattcatcctgtaacacagaacaggggtggaaagtgcaggagggattgtgtgcagagtgcagtctccattgtcagctaacctcagtgaggctaggcctcctggtttttgaaacggggataggcagttccattttagggtttttggggatccaataagaaaatacatttaaagcccctggtggtggaggcggtagggatggatgtggtttgacttgaaaaaggaccaaaactggccttcttgggcccttccccttgttattctctcatctgggcaaactgggagtgtatggtgcttttcagaattgcttaacttctacagaagatacaccatccatggaatcttcaaaaataacaaagccagcaggccctttaggcactcaatctgtgccctaggttttggaaacactatgcttcatgctgctgcccaagtgctgtctttagtacccttcctttacaattattaattaattaactagttaatttattttgagacagagtcttgctctgtaacccaggctggagtgcagtggcacgatcttggctcactgcaacctccacctcccaggttcaagcaagtctactgcctcagcctcccgactagccaggattacaggcacgcaccaccacacctggctgatttttgtatttttagtagagacggggtttcaccatgttgaccaagcacgaactcttgacctcaagtgatctgcccgccttggcctcccagagtgttgggccactgggcccggcccctttacaaatatttatcgaaggccttctctgacttattagaactgtgggctctattggtgtaagatatggccctgttctcaggagactgcagttgaatgcctgtgaaatgattaaaatagtgatctaggaggtcagaatagggggcgtcccttcctctgcttcttgggtttaaagccaactattgccttacatttttgtaaatctccttttggttttttcctagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacaggtaagtcttgaccacctcctgtcttgaaagaaatacagagtgaccccaatatggcctgagtccttgcctcttcccaggagcaaggctccagggctgtgtgggagcacactttctgatttcattgtctgaaacgctgctgatgttttgtatgtgtgtgtgaaacctcagcagagaatggctttgtagactgggccaagtctcagcgtgttgtgttttgaagtgcagcggtttcctcctgagttggcagactgtgattattaaaccatgaagggttactccttaccctgacccttttaaggttgccccttgatattcttattttattttattttatttttttaagagacaaggtctggctttgttgcccaggctggagtgcagtagagcagtcatagctcactgccacctccaactcctgggctcaagtgatcctcctgcctcaacctccctagtagctgggattgcaagtgttcaccaccacacccagataattttttttgtagagatgaggtcttgctatattgcccaggctggtcttgaactcctgggctcaggtgattctcccgcctcagcctcccacagtgttgggattacaggcgtgagcaccaccatgcctggctactgcttgatattcttaagtgacttttagggcctccctccatttccattccccacataactagttttaaagcagttccagaatttacttttgtctgagacagatctttctgtttcttacccgctccttttctccacctatcctgcgtataagcaataagcaagtagcagaggctgttagagtctttgctggtgaccaccaattccaaacactggggaatcaggatccctttaatcatttttaaacgattagtagagggagacgcttgaatcagagcattttctctgttgcaatgttccccttttccctattacaatacctcctccctctcccatacaataatctttccaataaagtctctccttaccaggttagaaaacaaattaatagaggaagcagacaacaagatctttctttttcaaaactgctgaatgataaaaatgcctgacaattctgttgtaatcgattgctcaataaattattgctgactgattcatgtgctatgaatcagtactattctcagtggtgggaattcagagataaaaatcctagttcctgccttgggtgctcatgctctgactctggagtcagatgacccattttgattcccgcctctgcaacttactagttctctgtgcttccatttccttatctataaaatggggataaaaataggacctcctccacatggtttttacaaagattgagtcaatgagtcatgtataaagtgcttagactagtgcctagcacataattagtgatacttaagtgtttgctcttactattagttggattaggctatttttgcattgctatgaagaaatacctgagactgggtaatttataaagaaaagaggtttaattggctcatggttctgcaggctgtacacacatggcacactggctctgctcggcttctggggaagcctcaaggagcttttactcatggcagaaggcaaagcaggagcaggcacgttacatggtgaaagcaggagcaaggggtgaggaggtgccacacttttacaacaacaagatctcgtgagaagtcacccactgttgtgaggacagcaccaaaccttgagggatcctcccctatgacccaaacagctcccacctggccctacctccaacactgaagattacagttcaacatgagatttggaggggacatccaaactatatcattccacccctggcctccaaatttcatgtccttctcacatgttaaaatataatcatcccttctcaatagtcccccaaagtcttaactcattccagcattaactcaaaagtcctaagtcccaagtctcatctagaaatgaattccttctacctataagcctgtaaaatcaaacaagttatttcctttcaagatacaatgggtgtatcagcattgggcaaacattcccatttgagaagggagaaattggccataagaaaggggctacaggccccaagcaagtctgaaacccaacagggcagttattaaatcataaagctccaaaatcatcttctttgactccgtgtctcacatccagagcacactggtgcaaggggtgggctcccaaggccttaggcagctccgcctcagtagcttttttatgctgagattgcaagctgatggtggctctaccattctggtgtctcaaggacggtggccttcttcccacagctccactaggcagtgcctcagtggggactctttgtggagccttcagctccgcatttcccctcctcactgccctagtagagtttctcttgagggctctgcccttggagcaggcttctgctggggcacttaggctttctcatacatcatctgaaatctaggtggaggatgccaagcttccttcactcttgcactctgtgttcctgcaggcttaacatcacatggaagctgccaaagcttatggcttgcaccctccagaggagtggcctgaactgtacctgagcccctttgagccatgtctggagctggagtggctgggatgtgggaaacagcacagggaagtagtgcccctggcctggtccctgaaaccactcagtcctcttaggtctcagggcctgtgatggaaggggctgtctcagagatctctgaaatgttttcaaggccttttacccattgtcttgactctcagcacttggcttctttttagttatgcaaatcgttttagcaatggttgctctacagcctgcttgaatttatctccccacaaaaatattttgttttgttttgtttttgagacagggtctctgttgccaggctagagtgcggtggcatgatcatggctcactgcagccttgacctcctgggctcaagggttccccctgcctcagcctcccaagtatctaggactacaggcaagtgccaccatgcctggctaatttttaactttttttttttttgagacagagtctccctatgttgcccagactgcggaaatgcttttctttctctgccacatggccaggttgcaaattttccaaacctctatgttctgcttcccttttaaaaataaggtccaactttaagtcatttttttactcccacatctgagtgtaggctgttagaagcagccaggcgacatcttgaatgctttgctgcctagaaatctctgccagatatcctaaatcatcactctcaagttcaaacttccacagatccctggggtgtgaacacaatgcagccaagatctttgctaaggcataacacatgtgaactttgctccagtcccaataagttcctcatttccatctgagaccttttcagcctgaacttcactgtccatgtcactgtcagcaatttggtcacgatcatttaatcagtctttaagacattgcaaactttccctcatcttcttgtcttcttctgagccctccaaactcttcccttctctgcccattacccagtttcaaagctgcttccacattttccagctatctttatagcaatatttgactctcagtaccaattttctaaattaggttgttcttacattgctataaagaaataaccttcctgggcatggtggctcatacctgtaatcctagcactttgggaggccaaggtgggtggatcacttgaggtcaggagtttgggaccagtctggctaacacagcaaaaccccacctctactaaacatacaaagattagcctggcatggtggtgcccacctgtattcccagctagtcaggaggctaaggcaggagaattgcttgaacctgggaggcagaggttgcagtgagccgagaacatgccactatactccagcctgggtgacagagcaaggccctgtctcaaaaaaaaagaagaaagaaagaaagacagagagggagggagggagggaggggagagagagagaaagagagagaagaaagaaaagaaagagagagagacctgagactgggtaatttacttaaaaaagaggtttaattggcctatagttccacaggttctacaggaagcatgatgctggcatctgcttggcttctggggaggcctcaggaaacttataatcatggtggaagtaagagagggggagcaggcatgtcacatggccagagcaggagcaagagaggggagaggtgccacactttacaacagccagatctcgtgagaactcactatctcgaggacagcactaagccatgaggaatccttcccatgacccaaacacctaccaggccccacctacaacattggggatcatatttcaacatgagattttgaggggacaccaaaactatattattggtcttcgtagattaattgttttagtctgtacaagtcaatatgtagaattataaagatgaaccctgttgctatatgaagaaatctaagaaaatacttgggtcctcattttaaaaagccattttgtatgtgttctatgcctgatgaaacactgtgtactgggtagagaaagtttgtattttaagctctcccactggcaataattagaagttgaaccaggatcagtatctaagtgtcccattgtttgttgttgttgttatttttaaatgaaattccttaagatgtgatggagactctgcaaactatccaaaatagtgtcattccaacatgttagcaatatttagaattattaatgagatactttacaatctttttttatactgtctttgaaatcctgtgtgcattttacacttatagaacatttcatttcagactagccacattttgaatgtgcaatagccacatgtgtctagtggctaccctattagacagcataattccaaccatactcccatgattttttgtttgtttgtttgtttgtttgtttgtttttgagacagagtctcattctgtctcccaggctggagtgcagtggcgcaatcttggctcactgcaacctttgtctcccaggttcaagtgattcttctgcctcagcctcccccgtagctgggattacaggcacggccaccacgcctggctaattttttgtatttttagtagagacaaggtttcaccatgttgaccaggctggtctcgaactcctggtctcaagtgatccacccgccttggcctcccaaagtgctgggactacaggcgtgagccaccatgcttggccactcccatgatttataagctccccagacacactgccttgccagtattcatgctgttgcttcagtcaagaatgaattcctcagcgctacctctcttgaccttcacatcttacttagtgcaaatgctgtctcctcctgagacttgcctgacttcggatactctccctgttacatcttatttaaaatgtcaagtagactgggcacggtggctcacacctataatcccagcattttggggggttgaggcgggcagatcacttgagcttaggagttcgagactaggctgggcaacatagcaaaactccgtctttaacaaaaatacaaaaaattagccaggcgtggtggcatgtgcctgtggccccagctacgtgggaggctgaggtgggagcatcgcttgaacctgggaggtggaggttgcagtgagctgagattgcaccactgcactccagcctgggtaacagggtaagacccccatctcaaaaaaaaaaaaaaaagtgtcaagtataccactttatagcacttgtaaagtggtatgttgatgtggtttggttgtgtccccaccagccaaatctcagcttgaattgtagtttccataatccccacatgtcatgggagggacccaggagggtaatttaatcacgggggcagctaccctcatgctgttctcttgatactgagttagttctcacgagatctgatggttttataagggactttttaaaaaacccttttggttgggtgtggtggctgatgcctatattcccagtgctttgggaagtcaaggtaggcagatcacttgaggtcaggagtttaagaccaatgtggccaacataatgaaaccctgtctctactaaaaatacaaaaagaaaaaaaaattagctgggtgtggtggcacacaccggctaaggcaggagaatcacttgaaccccggaggcagaggttgcagtgagctgagatcacgccaccgaatgccagcctgggcgaccgagcaagactttgtctcaaacaacaacaacaacaacaacaacaacaacaacagacaaacaaaaacccttttgctgggcacttctccttgctgctgccacgtgaaaaaggacgtgtttgtgtccccttctgccatgactgtaagtttcctgaggcctccccagccatgctgagctgtgagtcaattaaacctctttcctttataaatgactcagtctcaggtatgtccttattagcagcatgagaacagactaataaatatgtgcatccattatgacagtgactaattgcattttaataattggcttaggtatctgtctttcttcccaatgtactggaagctccatggggtgcagtgaccaagtcctttcgtctctgactgtctactatttaatgaatatttgtggaatatgtaaattaaacatcttcaactgtggtttaaattcataggacacatggaaaaactaacactataggacacaattattaaaaagtatttaaaagtaatgacaaaaaacgcagttactttgcacccacctaatagccggaaccataggacttagttcaggaaacccaaatataggttcaagaaaggggaatcaggccctgaaaatgaatggctttgttaggaatatgcatatgtgcagtgcaggctgctaagagctccttacagggctgagtgggtcgtgagatctgggatttgtagaaaaacatggctttttagggagctgtccaaaccttctatggggcctgttagtctctacatgtgccttttgcggtcattcactggatttgatttctgtcacttgtggctttatgatgctattgtttaggctggataagacagaacattccagaagcttctgctccagtgttttctcccaactgagtcagctgactccatcaattgtatgccagggggcctggggcaaaggaaggggagggcatgtagcccctttcgccagttagtatggattggtatggtggtgggaaacctctgagatggggaagggccaagcaagactgtggactcatctgacacaggatttacagtggcacatttcccaaacctttcacatactggggagttcagcatagtaatgtttttggaaaaagatgatgggcattccaaatgttgataacagccagtctggtttaaggaatgaagtgtattatttacatttttgtaaagctgcagattgagcagccctggaatgggtctgtgaatacaaggctcattggcctcatgatccttttgctcagggacatatttgtataaaatttgtatcaaagttgtggtatcccatggcttctgcagcctttttgaggtttattttttatcttgtcagatacctttttctattttgcctaccatttaacatttcaagcattaaaaaagaaaacaatttgtctaagggcacttccaattaatttgcgtatttctaagaagtatttactaaatttacagtatcccgtgaaatatcttattttggggtttcttagttttgctgtttggattattcatttctattttaggcttgtattatttaaaaagatgtaagggctagatcttaagttattttattattcattgataacaagtaatactggattttcaaatataatcaacatatataatatatacagcattatctttaagagtgtaaactatattttatattataaaaattacacatatatatgtgttccatatatataatcactaaagatcaacttgaaaatgcagtaaagttttgaacaaaaactactaatccatggcttcactgtctcaaaaataaccaatgctaactaacattttagtggatatcttcttggccatttttccatggatgagttttagatggttatcatactttgtacatatgcatgtacatatacaaaatatacatattttttattcacctaatgttatagcataggatttttcaatgttatattttggtcttcatacaaatgaattttaatgatgattatatttaatagagtaaatgtattactacacttaactgttcctttcctgaacatgtagatccgttttcattttctcctctggttacctcgtgggttgaatgttctcctcatgtttgccagccagttgtgtttccacacttttagttcttgtcctttgtccatttgcttatctgggttctggagtgttcatggcactctgtgaaccttttatgtttcatttggggcaactgcttttccattgtttaccttgtcaatttttaaaatgtgttgtagtcaagtctattctttttcaacatttctatcaggtctgagctttaaaagtcttactcccttcaatggtttgatgttcaagtcgattttcttatagttctatttttccacatttaatttcttcaggatctaagtgtcttccttgcaatttagcaaaggcaggaattttgtttatactgtctaattctgtcctattaaccctttagttctttaaccgtgtctgagccaagctgtataagaaatttttttaacataaagagacaacaaaaaatttaggaacaccgtgatcattgtttccattattataggagaatgctttctccttttttctaaacttgcctcgcttttctctgatagtgtttttagattggtagctaaaactgtatttgttttgccaaaatagaaacagattttgaaaaaaaaaatccttaaactgctcagaagtaaaaaaaaatagaaaaagatctctcacaccatcttatcatgcacaaaaggttgtgaccaggtatgtgtgagttttaaatgcacgtggtacattaggtgaattgcctacgtgagcctatgggtcactgcctggggacagggagaccagggagatatttccatcttaaggagtgaaactgtttcttgcacactgtcaacaagcgggtgagtcttctcccgaccctgctcttaccacttcttctcagtatcctgctttgtatctacaggttgctgccttcagttacctgagcgggcagcgtactcaaagttaagggtagaggctcctcagcctgtgcctttggctggctccccttgctttccctcttctctgtggtcaccctaggacttcagtactcctttcacgttgatgtgttcatcaccccagcctcgcctggatctgtgatggtcttttaaagcgtgtcctcctcctccaggaccacagctttctcactccccacatgggaatgctttcatgcttgctgcccaccttcgccccaccgctgcctctgttggaacacccccttcaccctcccacctgcagaagcccactctttccagaatcaagcaaaagtgtcttttgcaggagtccccttccagttgccatccctccctcctctgtatgcccacagtgcgtttactgtgaaggaggtggcctctgaaggcagtctcccatgctctactgtggattcttggaggaccagaaccaggacttaatgtcacaccatctcaagagcttagcacaagccgttgcacatggtatcagtagctaatccctcctaagcagcaggtgtgccaggtagtgttgtaactggatttatgtggatttcattctcacaacaaccctacaaggtgagtacgttattacctccattttacagatgaggaaactgaggcacagaagcagtgagtaagatgaaaccagggttgaatgttaaccctaccagccagatctcagtctagtttgtatccagtgtatgcccaatcacttcttaatagtaattctcaacagaggattaggtgaatgaaggaaccaatatgactgaaagataacgattctatgatagtattatacgcatccaatttatcaaacacctctgaggaattagatataccgatgttaattttccacctaattaaaattattccttttgatttccactccttatctcagtctattgtttctaaaattatttctaaaaccaaccatgaattttcctgcctgattaaatagttcatggagcataactgaaccttgtcttaatgacaaggaccgtcatagtaatgcacaaatgttatactatagtctgagattcattagcatctactaaataccagggaccatgccgggcacttttaagtatagttccttgattaattgcctaggctgaaaatttgatttgttttttgttgttgtttttgttttgttttttcaaactcttgtttgtatttctgaaagttcatttggtcttctttgatcttgtaggacagtaactgatcaatatgcccctctctgcaggcaccagccttggcttacacaaaagtttggctttgaaatttcctctcctcctccatattccaataaattactgtgaattaacctctgtgtaaaatcaaggaataccctgaatgagaggtgaggtcaccaggattctaaacctggccctgacactttcgattggtcctgaatccacatatccttatctataaaaaggtggagttaatgatttctaagtgaagggtctttggttataagcaaaataaactacctctggctaatttaagtaaaacgggaatctatttgaaggctataaagtaggttaacagaatcaaggaaagcagcttggaagacaaaagcaggatgcagggcagctttaaagatccaggtcacgagagtgtattgatcatcacatcatgtgtctgccactgggaggaatcctgtcttttactgagttttcttgtttttaaattaaaattttttttttttttggtagagacaaagtcttgctctgttgctcatgctggaatgcagtggcatgatcatagctcactgtaacgtcaaactcctgggctcaagccatcctcccaccttagcctcccaagtagctgacactacaggtacatgtcaccacgcctggttcttttactgtgttttctatcttgaggcactgtgctcaggattcagaggccagaggaaaggaattggttgagctcaggtcccatagcacccttgactgatggtcttacacagctgtacaatacaagagaggaaagcaaatcagggctattaccagcagaaagcggaatggttgtctaacaaatgaaaagtccactgcaaacactgaacttcaagctgtgtaagtggtttaacacggaagtgtctatcaaatttttaaatatattctttgtaaactggaagggcatgtaatttatcattagatttggctttggttagaggcatttgttagaggcattagctggtttcatcctacaggcgtttcttagatacctgttaggagaggttgtctcatacagagagaggagcaccttgtgctaatgagaaagacttgggatcaagttctcactcttctgcctgtgctctgtgtccccaactgtgaagtggggcaatactacatgctgtatttgtactacatacttgtaaggattaaataaaataaaataatgtgggttaaactctttgaagagctatgcaagggtcagctatttataggattagtgggcatagcttggtgtttagtgtgatatgatgtgtgatatgtgtatatgtgataggaagtatgcttccttctatacacttgacagagtataggatatagacatgtgatatgatgaaatatatatttagtcttcctccatttcctggcatacagctcctaagatccttggaatcgcttaagtgataagtgtctttttgtatgctagtgaattgactgatgactggcagcctctatggctcctggatgggagctggtcctgaaagaagaggacaggattagagggttgggactttcagccccaccccccaacctcccaggaggggagaggggctgaaagttgggttgatcacaaatggccagtgatttaatcaatcatgcctatgtaatgtagcttccataaaaaaccaaaaggactgaatttggagagtttccagagaaccaaacatggggaggttcctggagagtagcgagcctgcagagggcatggaagttctgagctccttcccctacaccttgcccagtgcatctcttcatctgtatactttgtaatatcctttataataaaatgtaagtgtttccctgagtactctgggctgttctagcaaattaattgagcccaagcacagggggatgggaaccccaatttatagccattagttcggaagcacaggtaaaacagcctggggcttttgattggcataggaggtggaaggcagtctcaacctgtagaatctgatgctatgtccaagtagaaagtatcagaattgaattgaattggaggacactgcagaattattggtgcagagaaaacgccacacacttcttggtgaccagaagtctcagaagtcttagaagtcttctgtgtaagttgttacagtatgagagcacagaaaaaaatggtttgttttttctactggagaagatacaaagactcatctatttgtatgcatctatatgaatgcatttattttctcatctgtttttattttaaagtctagaagggatttaagaggtataaagagatacaatatacagacggtccttgacttatgatggttcaacttgaatgatgttttgacttcgcgattgtgtgaaagtgatatgtatttggcatgcccctccaatgacgatagagttacatccagataaacccattgtaaattggaaagatactaagttgttgaatcaaaaacaaactttcaacttacgatgttttcaacttatgatgggtttactgggacataactccatcatcaccgaggagcatttttacgtaccagtttcagccttcagcttgcttgcagtctacctgaggctacatgataatttcacaatctaaatgatgtcactcagaagtttctaattgaatgctaaagacatgtacggacatccacaggtgggtgagaaaaatccctgtgctgctatggttgggaaaggcctcagaggaggtgtgggtagcccagctggccaatgccttcctaacctgtgctcttaaattagctctgttcaatagaaatattacatgaaccacatgtgtaatttaagattttaagattttctagtagccacattttttaaaaagtagaaggaagcaggtaaaattaattttgataatatattttaattttacccattataactgaaatagcatcatttcaatatataatcaatataaaaaaaggttggcactgtttttgaaattctgtatatattttacacttacagcaaatctcaattccagttagccacagtttaagtactcagtagtcacatgtgactagtggctaccatgtcagacataataaccctagctggtttaggaagaaggaaagataagcaaagggaaagaaacaaaagtcactggaatttattgaacacctactatgtaccaggcagggctagggctagggctagtgtgaggcatttgatgaacaaaagatcagattctgtttttatttaaaattttgttcatcataaatttttggcataaattttggttttaataaatagtgcattaaactatttatcttgattactacttgtttaggcacctcttacatcactcacactgactctaggcccagccctggcaccaggcgctttctaagaactttctaatgcttcatttgggggctctaacttgaaccaaactgtgctgtatatcagaaacagagaccgggtgtggtagctcatgcctgtaatgccagcattttggaaggtcgaggcaggaggatcacttgagtccaggagttcaagaccagcctgggtagcatagtaagacctcatctctacaaaaaaataaaacaattagctgggtgtggtggcatgcttctgtacttctagctacttgggaggctgaggtgggaggattgtttgagcccaggaggctgaggctgcagtgagctgtagtcatgccactgcactccagcctgggcaacagagcgagaccctatctcaaaaaaagaaacaggagtgaactcctgtaatttactaagccttgggcattattttttaaaataaaatttcaatttaattcaatgtagaaacaagaagacattggtaaacaaattgaaattcaaactaaatctgtgaaccaaactgaaaattttgaaaatacttcaggaccaaaccataacccaggagagagttcatcggctttgattcccggtcaaggtgaccctcaactattgcacctccctaatcagggaagaaaagaaggaaaacaaagtttttgagaagactctatcctaggcctcgtttccttcccacattatagcttcgatctccagctttttaaggcttagtagctgcagtctctatataatgttatattgggaatgttatattgaaaatataacttggatgctgaaagaaaggaaaagtcttgcttattaaagtggtgtctattttcaaataaaacccttttctttcttttagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattggtaagtaggcattttaataccattaagttggattttggaagaaaggaaaaagctaagttaatgctctttatgattttacatttaggagccattaagttatcttgaaatatacatatataaaaagaaaaatactttttttcttttctttaaagtacatcttggacttttttctaagatgtatcaaataaggtcttttcaaatgatgacaaaattcagattttaggatttgttttcataatttcttcctgggtgttcaggattagcaattgtgcaaataaatatgcccctaggattttttggtagctaataattttaaaaatgtttatttgccccttgttttcattcagaaattctagcagtgaaatttgtataccatttcttacttcagatttttatgttggattttatactctcaaaattcataaattgacaccagaaatcaatagactggcagcctactgtgatttcagtgggctctgtttataatggtaattctacctaataacgacacctattctacatctattctatactgagacccatgagactttctttttttttaaattaaattaatttatttattattaattttttttgagacagggtcttgctctgtcgcccaggctggagtgcagtcagtggctccatcacagctcactgaagcttctacctcctgggctccagggatcctcctgtgtcggccagggactccaggcgtgaaccactgtgcctgggctggcccagtaaacattctaattcacctacaccaacccctgccgactctcccaccctaacccctaggtgaccgctccatatgcagctggacactgatgatggacccaggacctagacagtatgaggtccctgccgcctagtcccaggggtgtaggtcgggtttataatgagcctctggccctgcttaggcggaaggtagcgccaccttgtggccaaagatgcccacatgtttacaagagcttttccccttttgtggtgtctggataactcagagcctgcaaatggtctctttgtaaatattacacttacaaaatgcagtactgggaaaggacagagaagaggctttgtcttccatatgcagccagaaaggagctcactgcctgatttttcagctatttaatctcaacctttacatttatatttccaaccccctttgctatggggtagtaggagagagtggatggaggtgctttggaggggatgctgctgtcttaatatacctctgctccgcagactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgaggtaagtagatttttcttttcagaacctctttttttagctgacagtgggttggggcaccccaagccagattaactttgagtttcttctagaaattgcctagagttaagttatcttatagagtgtgtgaaaaatggagtgttttttggaaagaaaaaaaacttgaggccgggtgcggtggctaatgcctgtaattccaggactttgggagaccgaggtgggtggatcatttgaggttaagactttgagaccagcctggccaacatggcaaaactctatctctactaaaaatacaaaaattagccagctgtggtgatgtacacctgtaatctcacctactcaggagactgaggcaggtaagttgcatgaacccaggaggcagaggttgcagtgagctgaagttacaccactgtactccagccagggtgacagagcaagactctgtctaaaaaagccaaaaaaaacaaaaacaaaaacaaaaaccctggagtgcagtggatagttgggaagttggtaaaagataaaataaccccaggaagaggattagattaggggtgtgctctgggattgtgatgggtctcctcagctttaaatttgtagctgttttctggctctgcctgttcaagagtcttaccctcttcatgtaatcctgtagcattccagtttttatggcaaacagcaataattgtgtccctgggccttcaaggttatataaaacgtagaaattgttaaaatagaattgtgagcaagttttaaaaaattatatgtgtgagagacaggagtcctaaaagtagggcctcaccaactctgaatgcatcattcgggagaagcagaccaggcaggagttccctagagggtcctgtctcagaggaatacagcttcacaggaccagaggaagcacagatttcctgtcaagcccttactgaacctcccttctagaaataatttcaggagagcctcctactgagagatattatgcaaaggttccctcaaggcccttttggtcccagtggcttcaatccatcagccaagtagatcttgttgctaatatctcactgtttctcagataatttgcattatataactcactttttttgtttttacatcattgaattcaccagactgatagccacactatcttatgtggttgtgaggatttcatgagatgattcatgcaaaaattttagaacagagccaggaatattatactcaacaattgttcactcctattattatagaggagctactacctgtgctatttctgagaaatcatagctacatgcccaaataaagaattttaggaatgtagtgtctgtatgtgcccttaagaagtataacttggagagaatatacaattgaagaaaccttaattgaaaatagggctatattaataccgtcttcttccagtgtagctattctggtataattggtcctagtcctggacttaggcttttaaatttgttattattgagaaataattcacttactataaaatttaccattttaaaatgtacaattcagtagtccttagtatagtcacaaggttgtgcaaccattactgctaattccagaacattttcattatcccaaaaaagaaactgcatactctcttagcagtcactcctattcctgtcttactctcccaggccctggcaaccactaatctactttctggctctgtgaatttgcatattctggacatctcatataaatggagtcatataatgtatgcccttctgtgtctgctttttaaatttagtgtaatgttgtcagggttcatccatgttgtagcatgtatcagtgttccattcctttttataactgaggaatattccgttgtgtagatataccacattttgcttatccatttatcagttgatggacatttgggttgtgttccttcttggctattattagaagtgctgctatgaatatttgttcatacaagcttttatatgaacattgggtatataccttgaagtggaattctcttgagtatatacataggtgtggaattttggagtcctatgaattctgtttaactttgttaagaactgacaaactgttttctgcagtgactgcaacatttttatattcctgctagcaatgtataaaggttccaatttctccacatcctcaccaacgcttactatttttcttttttttttttttaattgccctcctagtgggtgtgaagtggtatctcattgtggttttgatttgcatttccctaatgactaatgatgctgaacatgtttttatgtgctctctggccattagtatattttcttttcagaaatgtctcttcaaatcctttgcccattttaaaattgagctcctactttttaaaaccataaaataataatatggttaatatagtatttagcaaaatagtcactattttctggtcctggttcagtcttgtgtagcagttaggccctagtaggacagttagatgaagattaaattttttagttactgtatcagttagggttgccagagaaactgaatcaagagggtgtatatgtagagatgagaaagagggagagaaagaaatttatattatggaattggcttatgtgattatgggagctggtaagtctgaaatccatagagcaggccagcagctggaaactcaggtaaaagttgatgatgtggtcttgagtttgaaatctgtagggtgggctgcaacctggaaatccaggcagaatttcgatgttgcagtcttgaggagaattcctcctctaagaaacctctgtttttgcttgtaaggctttgaacagattggagggggcccagccactcattattgagggtaacctcccttaaagttaacggattgtagatattaatcacacctacaaaataccttcaccacaccatctgggctagtgtttgaccaaacaactgggcaccatagtctagccaagttgtcataaaattatcacagttactttaaatgatcatattcacatattttcagaaaaatgggactaatgatggagactatgtttttctaactggagaagacagttaccttaactttacaaaaattgtggaatggaatgggaaaacgtaagtcaaatgatttatcagtggaattattttttcagttttcatttaaactacatgtctacttctacattgcttaaaaatgtgtttagccttttttggatgaaaaatataaaaacatgtaaatagtcttgtaattattattctacaaatcaagatggtggtaaaacatcttacagattaaatattagtgatttgtagatttatcatggccaggcatgaattacaggccagtgaaaagtcccactcttgcttaatagtcattgagtgatgtgtagtagctacagcacaaatacttttcaaaccaccacatgttttgggctatttggccattgcctctatgaaagctgatttgggccagggacctactttttctcccccttgatctaattaaaactgttgtgtctgtgtatgaataagatactgtggatagacagctccagttaaatcttgcaaagtcctgaccatttaagagaatctaaactcaaatgtgatcatctttactctttcttgtgcttatcaattataggtcacttgactggtggataacagacaagtgcaatatgattaatggaacagatggagattcttttcacccactaataaccaaagatgaggtcctttatgtcttcccatctgacttttgcaggtaaaagctttaaagataagttctttttcaaaaataaggtctttcactgcaagaccaccaaaagcatgaggaatatatgcagacacacttattatgcatggatatttatgcataatcagtgataaatgctgatggcacatcgagacagtatagtgtactggttcacagcacagacttctgactgttggtttgaatcttggctctaccacttatagctgtgtgaccttgggcaaattacttaaccactctgtacctcactttccttatttgtaaaacaaagatagaaattgttaactatgttagaggttgttatgaggacaaatgagttagtattagtaaaatacttagcccagggcccatcacacagtaaccaatattaagtgttggctcttagttactatgatatgctctgtcaagcatcaactgacctggtctacttccagtcaataggtagtctctacatggaagccaaataaaagatactgttgtccatatttcagcagagtggtttcctcaggggaggcagagaaggaatggaatcaagagcattacgtagacaggttcagttatatccataatataatttttatttgtctaagtggcagatacaaaggtatttgttagagtattttatctctttctggtgcctaaaatttttcattaaaaaatgctgtaggggtggtttggtttgtgcagtgaaaccacctatgttattcacaaccttgcgagagatgtatcaacagctctggttcagagatgaaaaagtgaggcccagaaggctcttccggccagccttcaaaggaagggctgaaggctcagtggtgactgtgtacatcaaagtggttaggcactatgcagtgtaagcagtggtcatattacatgggactatgtttgaaatcagtaagaatgaaaggcagaataacgttgaactccatttaaataaatgactggggcaaaatatggaatctgatttttcttggagggggggattgagtatcaaagtgtgtattccaataaagtatctgtccaatgtgacacttttcaagtgcctaagaccctacgaggccacggccatcgctgcctgttctaccttagctttggctctgccgtgccctggcttccctggctttgccggtggcccgtccacactggcatatgtccatgcaggtctagagaggcctcttatttcttttttatgtgagtctccattctaaatgttatcatcttaattttgtaccacatattgttttttcttgtttggatgatatcaccgttgctacaataaacaccttccactacaattcatcttctgctttattacacgttgagttgacagaatgccttccaaacattcctttctacttaccctgtgagcttttggccatgttgtacctgagaactgttgctaacttgcggatttcgggcagattacactgaccagagtccacattcactttttattcttacatcctaacaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtaagaactcagagaggggacatgataggggtgtcaagaatgcagaaggattggagttcaacaaagaatatgtagctgggcgtagtggcgcacacctacagtcccagctactaaggatgctgaggtgggatgatcacttgagcccaggagttcccaagtccatcctgggcaacatggcgagaccactgtctctaaaaaacaaaacaaacaaaaaagaatatattgtcagcccaatagaaagatcagtttctttcaagaacaatgtttcataacatggctattgaatggtaaaaaaaaatcatggcttttctgtgatgctttttatttctagaatgccatgttgtgtttttttttctggacagtggtttagaagtcttaacagtaataatagctcatgtttactaagcacctgatgtatgccagtcactgtcctaagtgctttacatatttacatgtagttaatgcctgcaaaacattaactgatttcatgttcaaaacaatgctaaggctgggcacggtggctcatgcttgtattcccagcactttgagaggccgagatgtgaggattgcttgaggccaggggttcaagatcagcctgggcaacatagcaagaccctgtctctacaaaaaaaaaaaaattaaaaaattagctgggtgtggcggcacacacctgtagttacagctgctcaggaggctgaggcagagagattgcttgaacccaggagttcgaggttgcactgtgctatgattgtgctactgcactccagcctgggcaatagagtgattccgcacctccccaccaaaaaaaaaaaaaagctaaaagaaaaagtggacaactcagttttaagaaagtacgtatcatggcaaagattctcagtgattttgaagcagagttagttttaaaccctgacacaaatgtcccagtgtttcttaatgtcagagctactctgctcctttccatgaatgaggcagaattatcagtggcacaactgacaaaactattttcttcatcttgaagagtagttttaacagccacatgttgcagaattattcacaatgaacttactagatagtagacattcagcggcctgtttttataattggggaaactagggctcagagagggaacgtgattttgatgcgactcctccctctgagcagatccctggcggaactcagggtcttctcatatttgccctgtgattccctcttgggctgtaattcctctttaaaatttccctggagagctctctgtgtagtccctttctcctgaatagtaatgtgctcacttttgctcccttatctatctcattttaaaatctcctttcaggcctggcatggtggcgtgtgcctgtagacccagctactcaggaggctatggtggaagggtcgtttgagcccagtttgattctagcctgggcaacatagcgagactccatcttttaaaaaagaaaaaaaaaaaagaataagatatcattttggaataagtctgaagtcagcagtatacctcctgatccttgtctgacagggcagtgacccccacacctggctttacatcagaattatctggagagttattaaaaatatattggtgaggcatggtggatcatgcctgtaatcctaacactttaggaggctgaagcaggaggctcacttgaggccaagaatttagacctgcatgggcaacagggagaccccatctgaacaaaaaatttaaaaattagctgggcatagtagcatacacctatagttccagatacccaggaggctgaggctggagcgtaggaattcaaggctgcagtgagctatgattgcaacactgcactccagcctgggcaacagagtgagacctggtctcaaaaaacaaaaaaattatatatatataaaaaattgtttatatatacgtatatcatatatatgtgtatatatacatatatatatacaactgacaaaagtatttttcatcttgaagactagttttaacagccacatgtatatatttatgtatgtatatgttaatatatttgttaatatatgagtatattaacaaattttatagttatatataaatatgcatatatttgcatatacttatatttgctatattttaatatatatgtatatagtatatatatataggtatacacacacacgtgcgcaagtgtgcacacacactcatggtgcacacacatgcatgtatgtcccagggtcccatgttggatataccagggccccagaatctacacttttaacaagtactccagctgatttccataaagatggcgtctaggtatttggggaccattgtgcaagggaacatggtaccctttacctggagataaagaccaagggtgaatgggaacaagttcctggttgtgatctcccccattgccttactggtaatagtcctgaaacagtgtccctgccccctcatctggtgtgcatctggctcaaagcaaaaatgtagatatattttctcttgctgtttttattaaattctgtttccttaagaagctgatgccagaatcaacagaagtattctactttacacatttaaacttcttgctacaatccttttcctcttccctcttaacgtattcccgaatttggactgaagtgaaactccccaggattatcctccagtgttttgaattctccagggaaacattttggatagcaggatgagtgttctggagtcaggcagattgggtttgagtcctattctatttgttggtaaattggccaaagtttattaaggagggttccagacatcagttttctcattaataaaatggaggtggttatagcttcttgaggttgtgtgagagttagaaataatatatataaaacactcaggacagtagcccctattaagccctcaacagatttaaaaaatacattttcaaggtcattataggtcacaaagaaggaagtcatgcctttgtggaactattcagcagtaaacagcaaaatgcatgtgcatgtgagagatgagggatgagttccttaagccatgggctggtgaatatgtaagcaaatttaaataacttgccgacaagctcctttctccaaaaatgtatttccctggcagcaattgttgggtccctctcttcttttcaatagccagatctagaataggtttcctttagtaacttgtttccctatttggttatatatatatatatatatttaaatttacataagcacttatttggttcttaaaatgaataggaaaggaaaaaccccagaatctttgtgatctggttagaggctgggtgtatagcacaaccaggctaactcttaaaaaattatgtaggccaggtgtggtggctcaagcctgtaatctcagcactttgggaggctgaggcgggcagatcacttgaggtaaggagttcaagaccagccttgccaacatggtgaaacgctgtctctactaaaaatacaaaaaaattatccgggtgtggtggtgcatgcctgtagtcccagctacttgggaggctgaggcaggagaattgcttgaacctgggaggcggaggctgcagtgagctgagattatgcctgtctttggtaaaaacaaaacaaaacaaaacaaaaaaccaccaaaaatttttttttaattttaaaaaggacaagaaataaaaagtcagtccacttactgatagagaattgtagttgaaactagtgctttgaggtacaacacccttcattcacttagtattctgccttcatagcctgatggctagctgtccctgggtaaattttgtaacttctatgaacctcactttcttcaaatgcaaagtgaggctaatagttctgactttactgggctgttgggagcattaaataaaataatgtgtatgaagcacttatactttaacttcagtaaatatttgttgaagaataaataatttagcctgaacttcaatatataatgtggaataaaaaattgggggtaaatgagatgtcagaaaatgaagtataaatcctgaactaggaggtaaaggatggtgttttagcctacccaagttaatttatatgtagcttttttgtttttctttaggaaccaggctgtggccaggaacttttatattcagctcagcttagattttaaaaacagcatcattcatttctgttttccttcaaatgcaggtgcacccatcattatgtctttcccacacttttaccaagcagatgagaggtttgtttctgccatagaaggcatgcacccaaatcaggaagaccatgagacatttgtggacattaatcctgtgagtacatacttcctcctggtaaaagagcatatgttttattctgtctatacattgttcaccagtttagtcctgagccttctttaaaaatatccttactttcatatacatattcaagtgggagaaattcagctcagtgctgatggaggcattgtctcatagccctgtaattagaaggctgaattttgtggattgaatagcagaaatacgagcaaacctgcctttaacaaaaagcaacagtgaaaactcagttattggaaactactgatgtacccatataacctggtcaatcttctgatgctagccttggacctcaacatatatttatttctccccttgggacacagatcgataaggttaaagatgtccctttgcttcctcactgccaggaatattttggttgaaatatgaatatgtatattaacctcagtcacttttggcaaacttctttctacaggttatttgagagtttattatattattaattgtaaaggtatcagatatacatagaggagacatacacacgtgtgtatgtgtgtgtgtgtgtgtataatacacatttactcctgtattcatagacgagaaaaacaaaaaccatgctaaccatgtcttcatttttggaatttgaacattatggaccaataaaaaaaaaaaacaagaacattcttttagcacagtattttatgggtacttcacactcttagctgcatacattgcatttgtatctgagaaaccagtgatcttatgctctggtgaataaaatcgtgtgtggttttctcccttttctcttagccatcagctgatcagttcccttggatcagccaaactgttagcagtgcttgtcaccaagggacgaacacagtcttataaccttagtgcaaagatggagctgccctaaggatgacaagtgctgcagctgtgccccatggctacgctaggcgggccctatactaggatgccactctctggcagtgaccaccaccctcttcttagctctctggacaactgcctggaaatccagacctgacaggctatcttttaggcctccttcctgttggatcccttctaaggctgtgctattcagagtggcagcatcctgggagcttgttagaaatggccagtctactgaatcagagcctgcattttaacaggattcccaaggacctacattcatactcatgtttgagacacactggtctatcagccacctaatacaacccatggttctcattctgttctggggatcacttttacttgtttccactctgcctgtcacacatggtaatggtcaccttgtttatgaggactacacagaaatggtgctctattgaaaaagttgtttgcagtttaataaatcctaatgtttccttttcacttctctgatttgcagttgactggaataatcctaaaagcagccaagaggttccaaatcaacatttatgtcaaaaaattagatgactttgtgtaagttttgcttctttctatggaggggacagcagttttgctccattgcccgtctggtggggttgatgtcaggaggagtacagcctacttcatctaagcctgctcacccctgcccttcagggatggggcatgatcagcattttcatgggtgccttggtcttggaatttacttgttttatttaatcatacacttacagagtacttcccatggatcaggtattgttctcagcaccttatgtggattcacatataaccttgtattatccccattttacagatgaggaaacagaagcagagtgtttaggtaacttggctaagccttactatctagtcaacttttatccactccactaagcctttccctcatgcaccttgactctcttggtgtattagactgttcttgtgttgctataaagaaatacctggctgggtacagtggctcatgcctgtaatccagcactttgggaggccaaggtgggtggatcacaaggtcaggagatcaagaccatcctggccaacatggtgaaacctcgtctctactaaaaatacaaaaattagctgggcatggtggtgggtgcctataatcccagctattcgggaggctgaggcaagagaatcgcttgaaccagggagtcggaggtcacagtgagccaagatggtggcactgcactccagtctggcgacagagcaagactgtgtctcaggaaaaaaaaaaaaagcgggggggggagggagggagggaaaggaaaggaaatacctgagattggttaatttataaagagatttaattggcttacagttctgtaggctgtacaggaagcatggtgctggcatctgctcagtttctagggatgcctcagggagcttttgctcatggcagaaggagaagcaggaataaagcacgtcacatggggtgagcaggagcaagagagagaggaggggaggtgccacacacttttaaataacagatctcatgataactcactatcacaaggacagcaccaagcgaatggtgctaaaccattcatgagaaatccacccccatgatccagtcactgcctaccaagccccacctccaacactggggattacatttcaccctgagatttgggggaacaagtatccaaactatatcactcagagacttgagacagagtctcttcctcttcctctctctctattcccactgatcccacttggggccagccatagctctcatttgtatagttataatctcttgagtctagccttacttccccatgctgcagcttaatttggattccaaagtataatctcctgctcagacttttcaatgggaattttttagatatgagaaaattatgatataatgttgagtgaaataaacaggatgcaaaactatgcataatatatttatctataaaacttggcttgtttacctcattgaatttgccagatttaataccaggtgtcatggctctttctaagaagtaggtggtttacaagaatgcattttgtcatctgcatatctatttccgaggcagtataatttagtagttaagagctggaatcttagaagcaaagtggaattacatttgtggctccatcacttacttgtggtgatcctaggcctctctgagtcataattttctcatctgtaaacctgggacagtaatacctactgtaggtgactactctaggaattgaatgagataatatcccaaaaacacccagcacagagctggcacgtggtacatgctcagttggctcttgttgcaaagacagtacttcagtggcctagttacaaaacactctgaggagtgacagttttgttctgtcgactggagccttccctgatgactctaaggagactagtcatcattttaaggaatctgccttcagtatcttgtgttttgataaacgtacagcacatggaattgctagacagactggaatctaacttttggggtacatgtttgcaaagataactaagaaatcagcaaattctgggtaatttaagaaataagtgtactagaatcttcatataaatgtgtctgtccgggaaagtgtgccattgtgatgaggatgtttctgaaacaatctcatcctttgtctttgtagtgaaacgggagacattagaaccatggttttcccagtgatgtacctcaatgaggtaagtcctgagacggagggagccacgggtgttttcagactcagaaaaaatccattatgatgtctactgttgtagttacatgtaagttatgacagaagggcaaaagatttttaaaacctgttattcctcagaaaatttcacttaaatgttcacatgaatctgcctgtgtctgagagctgatttggagaaatgatggaaagaaattttccttctcaagaacactatttgggcaaaactcccttctggggagctgctcacgtaggaaacagaaacaggtaaaaggagccattggcagacattgttgaagcagggaaatagctcacactcagatagatgccagctagccctttgtctcccccttctttgaaaccatgctggtttaagacacctatgataaattcttttctgaatcacatatcacgtttactgtagttatatctcctcagtttctcctgcttccgcccagtttgagggaaaaaaaaaaaacgcaggtttttttcttcaataaattcttgattggcaaacttctcctttttattatttttgtgtttcctaaaaatacttgctgtttgtagaatattgaataacagagattagcaagaaaaagaaaaattaaaatcactattcacaaaatctgtgtcagcctgataatatttttattttattttactcaatgtgttgtacaattttttccaataacaactttaaaaggtaatctaatgttttacattttataaaacatgtgctctttataaaattcttagaaatttttttaaaaattgatttaaaaagtaaattactgataagtccctctctatcagaggcaggtgcagttcagatgtcaactcctgatattttctggtcttgatattacatagttgaaatcatacgatagatacaattttatatcttttttctccatttagcattatattggtattcacatttacaaacttttaagggtttgttattacaattctaagatgaggtttttatcgtttcataggaaaaattcaagcaatatttaccaatttataggatctctttgcaattgctcctgatcatccatgttcctgtttgtgggcaggggcatgaaagatctttttgaaaatgcagaagggcccttttctgccaacttctgttcagtagtggcatatttgaagtccctccacccccaacttctaatttgcttttttgtgaaagactagattaagtccaggtgtgtggagtggaaccttgtatttttgctgcctcctaggaagagcgtgattattctcttctctagaaaaataaaatattagacctggaagtctggaagtgacattggagactgttgccacaccacctttttaccgaggaggaaactctatccagttattggaaaaaatgtcttagaacccaatccactgactcggtccaatgaaaaaaaatgctttcttttcttttttttttttttttgagacaaggtctcactctcaccctctacagtggtgcgattttggctcactgcagcctcgacttcccgggctcaagtgatcctcccacctctgccttccaagtagctggaactacaggtgtgtgccaccatgcccggctaattttttttttttttcctgagatggagtcttgctctgttgcccaggctggagtgcagtggcccaatctcagctcactgcaacctctgcctcctgggttcaagcaattctcgtgcctcggcctcccaagtagctgggactacaggcgcccgccaccacccctggctaatttttgtatttttagcagagatgaggtttcaccatgttgaaactcatgacctcaagtgatctgcccatctcggcctcccaaagtgctgggattacagtcatgagccaccatgcccagccccagctaatttttgtattttttgtagagaggtggtttcaccacattgctcaggctggtctcaaacttttgagctcaagcaatccgcctgccttggcctcccaaagtgctgggattacaggcgtgtgcaactatgccaggcctccagtgcaaattaagcctaaactaggccagaattgttgctcattatttctatggaattaagctcttcagatacctcactcattacactaggtggtaattcctctgctctgcatacactaagtgttattctagtacatttccttctatcagcagtctctggaattctagttagcccacaactttgctgagcactttctgtagagggctgtggtcctgattactatagatgtaaccaagaaagaaattatactttccacataccatttttgcagtgtttcatttatttattcatttaatcagccagcattaatcaagcacctactgtgtgctgggtgctatacccagtgtggaggtgactgaggttaagtcttgccttcagggacttcacagccattgcaagacaaacagttacaatgcagagtgcaaggacaatgatggaagtagagagtgagatggaaacttagggaggaggcctttgactaggcctgaggtagccagagaaaacttttggaaggaagtgatgctgagctggatttttaaggatgaattggaattatctgacataaaacaaaaggtgatactgtctcaatatttctgaatacattttacctcctttttccaatctattttaagagtaaaaaaaatgtcttcaggagaagacaagatattaatgaataaatgtcccttctgattactctgacttataaatggattttcagtatgtttggtttgctaacaggaggacattcccaaattgtattaaacaaaggaaagatatagcaaaaaacagttacacactggatgtttagtcatcaagaatactattttcttgcctctccagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgaggtgagaactggctgaaggaacttcttccttactggataactttacctgaggaattcaactgtacttcactgaagggctgtcagctggcttattaggataaattctgggattttatgctgggcatagtgatttcgtgcttattttactgctggaccaaatgggaagcaaaggaagtgtgtcaaagaaggtggagggttagaaggtaccatctaatatttggggaatagaatctctttggatgtatcccctgggagttaactttatgtctttgaaaacaataacctgaaagaaaaggaagaatatataacagttacacatctgatctttggtgtcagactgcctgagttcaaatcccagttctgccacttaacagctatacgaccctagaaactgtgcttcagtttcttcatctgtaaaatgggataataaaagcctcccttatgagtttttcatgaggattagatgatatagtagacttaaaggacttggcccagtgttagcatatagtaagagctcaataaaggtttaagtattattaaatatgataaaacagctccaagattatagagcaagacagccagggtcctgcttggaaagaatccctgatgtatccgaagatacctgtgatttaggtatcactgcataataaatgattggaacatgggtgtagttactttcctggaaggctaggataaagagttgggttcgcctttccaagtgaccagcagcccagccaggaacctgaatacctgcaatgagccttttctgtagaagcccttcttaaattttctgcagcttccttttttttacaacagtggccttttttcctccagtttcctcaactaagtgtccaaggcaaatgtgaagtagaaaataaatacgtgaaaccatctgagtaaaattagctgaatttccctgacttccatattcttccattatttctcttatcccctgccagtcactttagcctgaattagctgtgaggcaaactattttgccatttctatgtgtggatcttccagtgtgactttatgcagtcattgaaattgtcttaagcacaaatgaaacctcatggaaatgttaattactgctcctacaattaaccttcctcatatattcaacaagcaaggaattattgagaactaatacctctgagacactactccttagtaggtttcaaaccaggaaggaggcaagttgaatagagtctaagttttataatccagatcaacacagagaagggtactgctctggtattgagggtgggagtggtcagagaaggcctcctggaaaggttaggcctggaatcttcaagaacaagcagcagcccaagaggggaggtgagtgagatgagccaccttcctataggtctctcctccttccatgcccccactccccacccaaacttttcacactggggagaagtttctgacatgaacatctaacttgttttctctcttctgtgtttcagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaattgctctagaagtcatatgtcattggatgtcctgttgtttatggagtttccctggaaagatgttccttgacagatgcagccctgagtcacacacttgggccatgtctgatttcagcttcgctgtagtggacagttacaatcagcctgacaagtttcactccaagcagtcccacattctgcttttctgtcttaagtctttctcaagagccctcaaagcaccataggagtatcagggagttaataacccaaggcaaccctcaactaaatggggcaggagtcagtcagctgatagatgtttcaatcctcagaggaccagttctcaggcttattccacatgggtcctcaattagggttgcccacagtggtaactactttctatcagtgtttctttattccctgtcttaatcgcccagcccttcaatgctgcttcccaaatcatccacctgtcctaacatccttatcttaggtctgcttccaggtaaacccaaccaaaatgcagataagtccacccaaaagggctcagtaggatccaagagctattggagaggcactggttttttttgttttttgttttttctttttttgagagagtcttgctctgtcgcccaggctggagtgcagtcgtgcaatcacggctcactgcagtctcgacctcttggactcaagttattatcctacctcagcctccctagtggctgggactacaggtgtgcaccaccacacctggataatttttgtatattttgttgagacaaggttttgccatgttgcccaggctggtcttgaactcctgggctcaagcaatctgcccacctcagcctcccaaagtgctgaggcttttgtttctagggatatttatctatggtactatctagggtactaaagttattagttctaaaattcagattacctttaaaacctttctcatcccaatattgcaacttatttttgaaatcagcaaatctagatcagtcttaaaatatctggctcagtgttacaaatgtcatgtatcaaggacacttgatccctaagatacatacttcctaggaatcctaactctgcagctggtttatgtcacagggaagctccttgtacctatttcttcttactcaaggtagttagagacacctggaactttgtaacatgccaagcctagttatttcaaatcagggagtaagaaaaatccagaaaaaaaaatttaaaacaataaggtatgttaaaacatatatccattagcaataagaaaatagtataggatgagtggtatagaatacaaagtataaaaagatgtatacacattcagcacaagataaagatctcatttccaataactatattttttcatttagtcaagtttttaaacacctttattgaggtataatttacataccataaaagtcacccattttaaatgtacaatgatttttagtaaatttactgagttgtgcagttttagaacatttccataacctcaataaaattcctcatgccagtttatagccactcagcgttgccaaccctagcccctggcaaaccactaatcatctgtcggtctttatagatttgccttctcgagacattttatataatcatacagtatgtggtatttggatcctggcttctttctacattatacctaaaaatgtgttcaactaatttcattaagcactcactttatgctaggcactttgaatataaactaggctactggtttaaaagagatctatggatcttatggtctagtgtggaaaacagtaaccaaataatcatacagataaatgtaaaatttcaactgagt

SEQ ID NO: 13770 - DNA, 36731 bp, Human
ttgatggcatcacaccctcatgcctccaaaggttccagttctcttgggattgaaaccctaatctttaacacagtccacaagcccttgcgtggcctggccctgctcacccttgcaggctccctccccacccctgcaggctccctccccacccctgcaggctccctccccacttcagccttcccccttcccctcccctctcctatcctttaacctcagctcctccatcacttctccaaggactctcagacctggccaggcctccgttttctaataaaaatcgctgacacttaggtgccaggcatgaatctaccctctccatattttcatgcagccagcctccacgacagctttatcaggtggaagctgtaattatccccattttatggatgaggaaactgaaggactgagaaggagatttgctcaaagtcacaagctaggaagcagcagggctgagagtcaaagccagaaatttcccaggagttcgaggctgcagtgagccatgatcatgccactgcactccagcctgggtgatagagtgagaccctgtctcaaacaaacaaacaaaaagccagaaaatttggttacagaatccttattctaaaccaccagcctttaatgcctctagcatctcagggcatggggtcccaatctttcctgtcatgtttcatagctctgcttttttgatggattcttcgcttaacatctgtcttacccaccgacagctagtgacaatggaaactggcatactgaggacctggcctgtgctaggctcagtccatagcactttttgtgcatcgccgaatttcctcctctcagcaatcctgtaagttagatgtaattgttacagtaagtcttcacttaacattgttgatatgttcttggaaactgcaactctaggctaaacgatgtctaatgaaatcaatttcaccataggctaattgatatcaacaagagttaagctcctatggcctatttctggtcacaaaaaaagtcaccaaatttctaagtaaagaccaaaatgcttctaatattaaacattgaaataaatatgagctatacatacatttaagaaagattaagaccaggtgcggtggttcatgcctgtaatgccagcactttgggatgctgaggtgggtggatcacttgagctcaggagtttgagaccagcctgggcaacacggtgaaaccccgtctccactaaaaatacaaaaattcactgatatggtggtgtgcatgcctataatcccagctacttaggaggctgaggtgggaggatctcttgagcctgggaggtagagattgcagtgagccatgactgcgccactgcgctctaggctgggtaagagagtgagaccctatctgaaaaaagaaaaagaaaaagaaagattaataaaaacaagtaagatcattatttacccacttattcagttcaaggtcacagtggccagagcctatctctgcagctgaggccacaggcgggaacccaccctacacaggacacattccattgcagagcactcacacacagtcacactcactcacctgggaccatgcagacacatcatggggaggacatgtaaactccatatagacagtggccctggctgggaatctactttcttttctcatcaatgttacaatgaaacattgaacaaaacgacgtcgtttgaggacttgctataccacattttatgcacagagaacctgagttgagagtttaagtcacttgttcactaggttatgaattcccaaagggcaaaaaaccttgtccattttgctcattgagtccagaaggaccatttgagtgcctggcatatagtaggcattcaataaatgcattttggttgattagatggatggatggattgatgacagatagccaaaggaaggaagaaaagaaggaaaaaagggagggagggaggggggagggtaaagagggaggaagaacggggacgtaccgccgcccagttcctggacgtgactgggacatcctcgcaggcaaggctggtgtcccagctgatgtgcgtccccatgcctctctgcaggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccccgccgtcaccatctgcaatgctagccccttcaagtaggtggccccggagtgcacagctggcctcagcagacaggcggttctctttctctcttttcttcccttctacctttcctttccttcctttccttccttctcctttctctccttctctttatttctcccctttcttccttcctttctccctttattacttttccttccttcttcttccctttcttttttcttttctttctttccttccttctttctctttctcctcctctctgtctttccatttgccttcatccttttgcagcaactaagattcaaacttcataaacttttggccaggtgcagtggcctgtaataacagcactttgagaggcaaagacagaaggatcccttgaggccaggagttggagaacagcctgggcaacatagcaagatcccacttctaaaaaaagtaaataattttttttaattagccagacgtggtggcacatgtctgtggtctgagctgcataggaagcagaggtgggagaactgcttgagcccaggagctcgaggctgcagtgggctgagatggcgccacttgagtttcaagtcaaggctaagaaaaaataattaattaaaaataaaaacaagaagatgccactgcattccagcctgggtaacagatgctatctcttaaaaataaaaaaatcataagtttcctaggcttagagagaaccttgggcaccctctgtcttcaggcaggccagtgcctatttatcgattccacgcgtgtttacggagcacctactatgtgccaggcactgtcctaggcaacacaaatacaacagtgaacaaaacagagtccctgtcctcttcacagcctgccagagcaaacatgccccacaaagttgtccccacaaatatcgaattcatcatcattatgatgataaaaaataaaacaactcagccgggcaccatggctcatacctgtaatcccagcattttgagaggctgaggtgggcagattactcgaggtcaggagtttgagaccagtctggccaacatggtgaaacctcaactctactaaaaatacaggcaatgcctgtaatctcagctacttaggaggctgaggcacgagaattgcttgaccccgagaggcagaggttatagtgagctgagattgcatcactgcactccagcctgggcaacagaacaagatcctgtctcaaaaattaaaaaataaataaataaaaccactcttcaacaaatgcttatgatatgctaggcactgtgttcagtgttctttggataattggtgtcattctaatccacacaaccaccctaggattgggaactcctgtcgcagccccagtttacaggtgaggagatggaggttcagagaagtaagtgagcttgcctggagatgcacagtggaagactgtgggatttgaatctaggcctgatgtgatcccagaactgctactttttaaccattcttccggattgcccgttctccattctccgcttgatagcaagacctgtgaaggggacacaagaggagacccaacctagtcagggttatggagagacagggagtcagtccaaaaacaaaaaataaaaaaaagtgccctaaggaatgagtagaagttggccagatatggtgaagagagtgcccccagtcttggatacagcaggtgcagctggtgagatgcttggtgcattcaaggaactgaaagaagggctgagtcacagaaaacatttttatccaaaagagagtcctgaccgggcacagtggctcacgcctgtaatcccagcattttgagaggccaaagcgagtggattacttgaggtcaggagtttgagaccagcctgcccaacatggtgaaaccccatctctactaaaaatacaaaaattagccgggtgtgctggcacatgcctgtaaacccagctactcaggaggctgaggcaggaaaatcacttgaacgcaggaggtggaggttgcagtgagccgagatctcgccactgcactccagcctgggtgacagagcaagaccttgtctcaattaaaaaaaagaaaagaaagaaagcaaaagaaagtcctgactgggcacgggcacagtggctcaggcttgaaatcagagcatgttgggaggccgaggcttaaggatcacttgaagccaggagttcaaggtcagcatggccaacatggtgagacagcatctctgtttttaaaagtcctagaagggaattctcacatagtgattactttcccaattatcagaaagtcccttctttctattaatagggttcttcctgccttggtgggttcttagagctgctcaagagaatctttaataataataggaacgacagcactccttctgggcactgatccatgcattttataagcagcacctcattgaatcttcccaacgattctctgggttacttatttttatccccctgttttgtagatgagagaacagagcctcagggaggttaagtcgcccaagatattaagtggcatgccaggattcaaacctggagcccatacagtgacccatcaagcttcccagaagctgtgaacatctaggctgtaataacaccaccacctgcacagacgccacccttccccatcctcctgttcctgtgtacacagatttaatggtcagggaactggcatcgaaggccaacgttagctctggctgctgtacacctttgtaccaggaccttggcctctgtccagcatttaatgctcctgcaggaagttctccagccagagttggcatttgtggcctcaattaccccactttgaggcagggtcttgggtaaattggacatgaagtgactggggtgcagggcccggccccgcagagatacttcttgatagatccatctctcactggccaccatgtccaacatgggagcgccacagggctgagggaagacattggagccagcctcacagtcccattcattttctctctcttgaaactggctcctgttcccaaagttgctcccccctgggagggagatctcagaacccccataaacatacccactggagcccaccaaacccagattctaaactcacctctgccctttatcagtggagtgagcttgcaaaatcacaccaactcctggagcctcagtttcctgagctatatatggggacggtaacagacttgtggcaaacaagacctggaaagcacctagcacctggcacatggtaagctatcaataaccatgagccattacaattcttcctcactcgaatgtgaatttcataaggaaagagaccaggtccctcttgtttgctactgtatcgtctgtgccttgcacagtgcctggcacatagtaggtgctcattaaaagttggtgaatgaatgagtgcatgggtggtggaaagatggatgcatgggtgggtggacggagaggtgggtgcttaggtggggtgttcttcttatacatagtggcagccatgctggagtagcagtgtgatatggttggctcagtgtcaccacccaaatatcatattgaattgtaacccccatgtgtcgagggagggacctggtgtgggtgattagatcatacgggcggctttccgcatgctgtgttcgtgatagtgagtgagttctcacaagatctgatggttttaaagtggcagtctcccctgtgcactctctttctctctctctcctgctgccatgtaagacatgccttgcttcccccttcaccttccgccatgattgtaagtttcctgagacctctctccagccatgtagaactgtgagtcaattatacctcttctgtttataaattacccagtctcaggtagtatctttatagcagtgtgaaaacagactactatggagtgggtcccagatttcatttgctctgctttacagctatgcattccttccccctaaccagccctctccccatccaggtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactagtaagtggtccctgggcacatatcaagcaatgggccccacccagtgaggctgatgggtgtttcttttctgtagtaatttgagtctcgctgggggaaagacaagatggaagccagagcctgttttgcttgtttgcagagattttttaaaaatagaaatttttggcatgttagtcaagactcctttggtataagtgatccagctcacactagcttaagcaaaacaggcgattcattggctcacatgactaagaaatccagaggtatactgcattcaggcaaggctggatccaggtattctaatgaggtcatcaggaatctttctccgtcttggttcaacttttctctcaggcgacttcactctcaggcaagatctctccatgtggagggatcccctcagtgcccttgcttagcagtggtcccagaaaaagagctctttccctatagtcccagcaaaggtcctaagaagactcattagatcacatgctcacccctaaaccaatcactgtgggctacagcaggggctctcatgattggccagtcctgggccatgtgccctggagttgggagtgatgtcagcctctgtgagaccacatggactgagcaagggggaaggtggttccctgagggaggaactaagtcttgttatcaaaagataggggcataaatattgggcaggtgaaaagccacagctgtgcagtacagtcacatgccaagaaacaactgccctgcactgggaggctggtatgccattagttcttaagcctagaagtggggagaaggtcccctgcccgtgtctcaggatctcctgggagctctgtcacaatacacatccctaggccccactcctggagaatctgagtgagcagttctgggcccaggcccaggaatctgtattgacaacaggctccctggtgattctgataatcaatcttggatggggatccaggaggggaccatacactccccagatggggagccactgccttgctgctcacactcatggcgttatgacttccacaactgctttatccccacctctccacacaaactagccgacgtcatatgggggatctgctgtggtcacaccttccttaacctcctgggcctcaatttcctcatgatgatggggataacaatgatacttacctcctagctttgctgtgaagcttcaatgggattatagatgtaagacactgggaacaaagcccggaacagggtaaggattaagggctgccattacttccccaaggggaggcagggaggcccccaggagtgggctggccgggcgtgttgggaagggtggtgtaagaatgccaggggaagcttctctatccggcctcccgggttccagcagggagaaccagcagcagcctcgtggccaaggccagagtcccagggccaagtctgtcacgtgtctgtgcgatgacttggatgtcatgagaagccggatgtgaccagatggaagggtgctctgcaccctgtggtgggctcagtgtgactgggtctgtgtctttcccaggacagataagaggcagcatttcctgtgtgttgagtttcttcttggtcttcatggcctccaggggagctgcatctggaagtctctggcagaggctggaaaaggaatcagaactgtgtgtgtgcgtgcgtgtgtgtgtgagcataagtgttgcggccacttgtgtgaatctatgtatatggggttcggggctaggatggatgtgtgttacaatgacatgaggctgtggaggtcagagagagggcatcttctgtgcatgcctctgcacacatgaccgtgtgtgtgtttttgcccatgcataatggtacaagtaggggtgaggctggtggctgtaaactgagccactgagtcaccctcccttgaacgaggggaccagcctctgtgcatgcccatgagttggtcactggctgtgggtcacttccaagaggttgctgaggggtctcctaacctcccaggcctcaccctcagcagctgggggtgggtgcaccagcctgatgaggggatcttgtgatcagcacacagctgtgtatgaggcagtagcccttgagcatgtgtgagcatgagtgtgaacgtttcccaccaccaagttgcagccagaaaggtggctggcaaagcacagctcttgccctgctagggccctcgagcagtggctggggtcctgctagcagctcccacgccacccacaaaaacccctcttggcctccacagtgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggtgagagccaccccaagcccacccggccaggccctggcaccgagagacagtggcatgttacggttgggagcacagcctgccagggttccaatcctgcccagccacttaccggctatctgcagcacagttttctgtgcctcggtgtcttttaggtcctgtttcctggaggcagagcctgaggcagggatgtattgaagagctcgcgaagcattgagagaactgtgttaggaaaagtctgcagggaaagtgggataaggaaggaggatttggaacatgtaggaaaaggagaaaatagaaaaagaaaaaggaaaggctgggcgtggtgggtgggtggcttacccctgtagtcccagcactttgtgaggtggagacgggaggatcgcttgagaccaggagttcaagaccagcctgggtaatatagtgagactccagctctagaaaatagtaaaataaattaaattttaaaaggaaggaggaaaaagttaaacaaggatgtggtcttaggtaaagtctaggctcagcttgatctgtgggaggatctggagcataaactgaaccagagtggtcctcccttgaaggaggggaccagcctttctgcgtgccccgtgagctggtcactggctgtgggtcattcccaacaggttgatgaggtgtctcctaacctcccagacctcacttctagcagctgggggtgggtgcaccagcccgatgaggggatcagggtgggcacccaggcatctgttgcctcggttttctcatctctgaagcaggaacaataatcgtagcttcttcatagggtcattgaaaagagtaaatgagtaagttcatggcagcacctagaacaaggctatgaggctgggcgtggtggctcatgcctggaatcccagcactttgggaggctaaggcaggaggatcgcttgaggccaggagttcaagaccagcctgagcaacatagcgagacctcatctctacaaaaaatcaaaaaccagccagatatagtcatgctcacctgtaatcccaactactcaggaggctgaggagggaggatcacttgagtccaggaggtcgaagctacagtgagccatgatcacgtcactgcactccagtctgggtgacagaatgagaccctgtctctaaaaaaaaaaaacaaaaaacaaaaaaacacgaggttataaaagtgtttcctgtaaatattctttttccctaacaacctttaatatgagagactggcagaatgagggtaatggtaaccctggaggtctaggtcttcttgcaattgacccacagattcccacctccttggcctcccagctcctggcaaaccaaccctgggcctaagcatcaggtgttgtcccagtctctaggacaaccagaaacgggggcaatctccattctatcccctcctaacagcctccagagagctcagctggcagaagcacgtgggaaggaggcctgaggatgggcaggaacactgctgaggcctcagagccccttgtcggcctcctgacccagcctccaggtgtggggtatgccacacccacctcggccccaccccaggtttcagccagtcctgtttctgagattcgatggtatcctccttgatctggggcctccaatgctcacacttcaggcctctgtggaaaggagcttttagctgaatcttaatgctatgggcacgtgacaggcttccaagctcacctccgagggactggggttgcaggcagctctctgaactcagaaccttccagaacctctaatgagaattcttcagaaagctctggggcctctgtcccctcaaaatgcacaggtgcaaccggacatgtggctcacgcctgtaagcccaacactttgggaggccaaggcgggtggatcacctgaggtcaggagttcgagactagcctggccaacatggcgaaaccttgtctctactaaaaatacaaaaattaactgggagtggtggtgcacatctataatcccagctacttgggaggctgaggaaggagaatcgcttgaaccccaggggcggaggttgtagtgagcagagatcgcgccactacacttcagcctgggcagcagagtgagactctgtattaaaaaggaaaaaacaaatgcacaggcacacatgggcagggttcttgcacacaatgtcaaataattcaaggccactaagcaggacagagcagcacatatgtcccattgtacagattagcaaaaggtggttcccataggtggaagatttgactgatggcgccctgctgatgggataccctcttccttgtgggccaccccatggctagctggtcacagtctgtgtttcagcctcactgtcttggccagggtcctttgctcagggcacacccgccaaccacacctgccataaggctagggataccaaacagactactgtaatgtccacaagcacattcatctcacccgctcagctgaaagagagctgtaacactgcaacttcaagtgcatggcccatctgctcagtgagaacacgcccaggagcgagagtggggcaggaaagtgaacctgctgtcaactccctacccatccaacgggatcccagtgttcaagggcctgtgttccactcacagcccagccccgaaagctgtgccggccacctcatgggtagctgggctgggctgggtatagctggcctgttgtcaacatagcaccctccaaaaggagccccatttgagtcatatgggctgagggtgagggacgggtggtcccccaagggaagctaaagaactgttagcagaaacagggaaaatagctggctgatgggccactaaaacccccaaatattggccacataacttctgccatgtgcgaggggtagggggtaagtgtaatgaaagggtcaaggcttggggtctggggttagaccacctagactcaaatcctggctccatcttacaagctgtgtgaccttgaacaagtttcttagccttgctgtgcctcagtttccctcctctgtaaaataggggagagaacaatacctaccctacatggttactttgaatattaagtgaattaatatgcatgagtaactgaccctactactgggcttaataaataatagttataactattacttttataatagttttataacccacattttaggctgggctcagtggctcatgcctataatcccagcactttgggaggccgaagctggcagatcgcttgagaccaggggttcgagaccagcctggacaacaaggcaaaaccccatctctactaaatatacaaaaattagccaggtgtggtggcgcatgcctgtaatcccggctactcaggtgaccgaggcacgagaatcacttgaacccggaaggcagaggttgcagtgagccgaggttgtgccactgcactcccgcctgggcgacagggggagactctcttaaaaaacagcaacaaaaacaaaaaccccaatttgacaaggaatgcaaattcaataattatgccaacatttactgggcctttctcgtccctgtaggtgtcaggcactattctaagcactttgtgtgttaaaattgctttcactctggcaacaaagtcatgagaaaggagctgttattttccccttattttatttttttaagagacagggtatcactctgttgcccaggctggtctcaaactcctggcctcgagtgatcctcccacctcagcctcccaaagtgctggaattacaggcatgagccaccgcgcccagccttccccatcattttatagttgctgtaacctgcccagagaggttaagtaacatctctgaagtcacacagttggtgagtggcagagctagcagtctgggccaggcccaccccgcatcactctattgcctcatcagaaagggtgatcgtcatcttccctccctacccacctctcccaagcctatttccccagccctcggcaggtcccagtgaaaggtaccatccaggcaccttagcatagagatctcagccaactgctctctgagctcttcctcactcccacagttgactggtcatctgccttcctgagtcagccttggacacagctgtgggaatgtgcctctctgctctcccggtgctgggccacagacactgtggcccctgcttcctccctctctctctgactccatcctgtccccctcctaacatgacaaacactctagaagcagcagctgcagaattaggaaaatgtgagccgcatgtggaccccaacaccaaactgcctggacttgaatgtcagctcagtatgtgactgggcatgctacttagcctttctgtgcctcagtttcctcatctggaaagtggggacagtgaaataaccacatagcattattgggggattaaatgagaacatatgcaaagtacctggtgcaatgcctggcacatagtaaacattataggagcatttttttaaaaaggcttttgggccgggcatggtggctcacgcctataatcccagcactttgggaagccgaggcaggcagatcacctgaggtcaggagtttgagaccagcctggcaaacatagtgaaaccccatctctactaaaaatacaaaaattagctgggtgcagtggctcacgcctataatcccagctactcgggaggctgaggtaggaggctgaacccaggaggcagaggttgcagtgagctgagatcatgccactgcactccagcctgggagagagagcgagactccatctcaaaaaaataaaaaaataaataaataaataaacaaataaataaataaataaaaaggcttttggccaggtgcagtggctcacttaatcccagcactttgggaggccaaggagggagaatcgcttgaggccaggagtttaagaccaacctgagcaacatagtgagaccccccatctctacaaaaaacaattttaaaataacaaaattagcccggcgtggtggtacacacctgtagactcagctactctggaggctgagggggaaggatcacttgagcctcggagtttgaggctgcagtgaaccaagatcacaccactgcattccagcattccagcctgggtgacagagtgagagtaaaatatagagagagagactttgttgttggtggtggtggtggttttttttttttttttttttttgagacggagttttgttcttgcccccaggctggaatacaatggcataatctccactcactgcaacctctgcctcccgggttcaagtgattatcgtgtctcagccccccgagtagctgggatgacaggcatgcaccaccacacctggctaatttttggtttttggtttttggtttttggttttgttttgttttgtttttttgagacagagtctcactctgtcgcccaggctggagtacagtggcgctatctcggctcaccacaagctccgcctcccgggttcataccattctcctgcctcagcctcccgagtagctgggactacaggcagccgccaccacaaccggctaattttttgtatttttagtagagacagggtttcactgtgttagccaggatggtcttgatctcctgacctcatgatccacccgcctcagccttccaaagtgctgggattacaggcatgagccactgtgcccagcgtaaattttgtatttttagtagagacagggtttcaccatgtttgccaggctggtctcaaacttctgacctcaggttatctgctgccatagcctcccaaagtgctgggattacaggcatgagccactgcgcctggcctagagagactttttatcgaggaatagttttagatttacagaaaaaccacagcctccaactcctggactcaagtgatcctccctcctcagcctccaaaagtactaggattacagatgtgagccactgtgctggcctttgctctgtactttggaaaggagtcactaaattcagactacgctcaggggaaggggaagggagtggccagtgggaaaggagcattgagctccacccctcctagagagaagaatatatattatttggaattcttctgtaaaggaagatttgtctcatctcctccatttatttatttattccatcatttattgacacagtatggactcctgtagatttaggttgtaatccaattccttgttatctattctcttgcttaaattcttctagctttggccactctgtcagttagcacctgtgtgcctttgatatgtcctcacctgggtgggttttttaacttttgcctactttctggcactacaggatgcccccgccctagaatcagccatttctctaaagagctctgtttggttttttggttgttttgtttgtttgtttgtttttgtttttgttttttttgagatgggatctcactctgttgtccatactggagtgcagtgacacaatcgcgtgcccgattaatttttttattttgtagagatggggtctccctatgttgcccaagctggtctcaaactcctggctcaagcaatcttcccacttcagccccctaaagtgctgggattacaggagagagccaacaagacttgcccaagctctggttttttaaattgaagaatggtatttagaaaccaagatctgggccaagcatggtggcttatgtatgtaatcccagcactttgggaggccgaggtggaaggattgcctaagcccaggagtttgacaccggtctggccaacatggcaaaaccccatctctactaaaaatacaaaaattagccgggtgtgttggcatgcacctgtaatcccagctactagggaggctgaggcaggagagtcacttgaacctgggaggcagaggttgtatagagccaagatcatgccactgcactccagcctgagcaatctcaaaaaaaaaaaaaataaagttaaataaaatttaaaaataaagaaaccaagatctgggcatatataagcattattattactatggttgttgttgtttcagggattatccaactagtttctgccctggaaagtctttcctgacctctgaccacacaacagtggttatactgcttcctgctaggatgctctatttcccagtcttttctggaggctcactggtctctgtctgcatgcctggctcccagcccagcagagatttctgtagggaaacacctggctctggaatcagaggcagccagtcctgggagcagcctctctgggtgaagagtattatcaacaagcaaatagttggcacgcacgtggagaccaagagcatggcgcgggcaggaggggacctggccacaccccatgcagcctcctgctcctgggctgcatctgaccaagacagttccttgggaacactgtgtccccatgccctggggcgaggtctctccttcaagagcagggcctggattgagctggtttgctctgctctgttcttttcctgtggccacagccctgatcccacagtttatagactccatggtgcccgcccagagctatttcttccctctggggctttgcctgtgttgtgtccctgcctggtgagccctttctcctccctaccctgtagacttagccatcgcttacttgttcataaagtctcagctcaggcctcccctcctccaggaaaccttccctgactcgctccccactctccactgggacttgggtgtcacttctccatacttatctctgtcgatgctcttatcgcctattgtaatttattcatcaaatatttactgagtgtctgtgtgctctgtaccagaccctgggcatggagctgtgaacagtagcagccaagattttttgagtattacagtatgctaggcatccaccccttgccgcagtcatgtaggtagtattatctggtgttacaaatggggaaagtgaggcacgaagacgtgatgtaaccatcccaaagctcaccagctgctaagggacacagccagaattgaaatcaagcaggctggctctgtggcctgtgctcttgacctctgagctcttctccttccagacagacaaggtcatgctccctccccgggcttatgttctaagcaggagacagctaagtgagcaattaaatcaagaagataatttcaggccaggcacagtggtggatgcctataatcccagcatttagggaggctgaggccagaagatcacttgaggccaggagttcaagaccagcctgggcaacatagcaagaccccatctccacaaaaaattttacaaattagctgggtgtggtggcacatgcctgtagtcccagctactcaggaggctgaggcaggagaatatcttaaggccaggagtttgaggctgcagtaagctatgatcacgccattgcactccagcctgggcaacagagtgacaccctgtctctaccaaaaaaaaaaaggaagctgatttcagattctgatgtatctgataaagaagataatcaactggttgaagggccaggtgcagtgactcaccctgtaatcctagcactttgggaggccaaggcaggtggatcacctgaggtcaggagttcaagaccagcctgactaacatggtgaaaccctgtctctactaataatacaaaaattagccaggcgtggtggcgcatacctgtaatcccagctactcaggaggctgaggcaggagaatcacttgaacggggaggcagaggctgtagtgagctgagatcatgccactacactccagcctgggcaacaagagtgaaactccatctcaaaataaataaataaataaatataaataaactggtggaaaagatctagagtaactaggtagaaaattctattactattagtaataaagtactattaactaatagttctagtccatcactttgcataggggttcagggaggcctcagagcagataaaagctgaaggatggggagaagccagtatctgaagagctggttagagaatattccaggcacaaaggacaacagaggcaaaagccttgagcttggaaacatctagagtgtcgctggagtgtagggaatgagacatagaaggccagcatagggactttgcactttattctgtgagtgacaagaagcctttggagggttctcagaaagggagtaccgtgctctgactcacaaatttaaacaatcaccctgactgctgtgcagaaggaagactttaaggatgaacagaggcagaggctccagcaagaatccagacatgagatgctggtgacttgggccagggtgggagcgtctgaggtggagacaggtggacagactaaagtcacatcttggagcctggcgtggtggctcacacatgtaatctcagcactttgggaggctgaggtgggagatcacctgaggtcaggagttcaagaccagcctggccaacatagtgaaacaccatctctactaaaaatacaaaaattaggccaggcatggtggctcacgcctgtaatcctagcactttgggaggctgaggtgggtggattgcctgaggtcaggagttcgagaccagcctggccaacatggtgaaaccccatatctactgaaaatacaaaaattagctggttgtggtggcaggcacctataatcccagctactcgggaggctgaggcaggagaatcgcttgaacacagagggcagaggttgcagtgagctgagatggcaccacttcactccagcctggggtgaaagagcaaaactccatctcaaaaacaaaaaaaaaaatagttgggcgtgatggtgcctgcctgtaatcccagctactcaggaggctgaggcaggagaattgcttgaatccaggaggcagaggttacagtgaaccaatatcacgccattgcactccagcctgggcaacagagcaagactttgtcaagaaagagagaaagagagaaaaagagagaaagagagaaaaagggaggaagggaggaaaagaaaagagagaaagagagaaagggaagaagggaggaaggaaggaaaaggaaagaaaagagagaaagaaagagaaagaaaggaaggaagaaagaaagaaagagaaggagaaagagaaagaaaagagagaaagaaaaagaagaaaagaaagaaaaagaaagaaagaaaagaaaaagagagaaagagagaaggaaagagaaagaaggaaagagaaagaaagaaagaaagaaagaaagagaaagaaagaaagaaagaaagaaagaagtcacatcttggaaggagaggggggttgataggattccactctctgtcctctgccacactggaagctgcaaaaggcagccctgtcttgttttgctcagtgtccctagcctagcacccacctcaacaaacatttattgggtggaaaaatgtggtttcttcctgcttccccttgcaccgttgaggaaacccaagctcagaggttgagtaagcagctcaaatctgttgacagtggcagagcttgggtcggcccccatatcccatttcacagcctgtcctggacccaagtcattctgcaagtcaactagctgagacaaaagatacaggaaatggctttcttatctgaaaacacgggaaaataacacctgcccttgtggggttattttgagaattaaatgagatcacgaatacagaaagattcagcacaggcctggcccataaaagtcactcagtgaatgtttgctgtggagcataaggcttcaaagacaatactgcatggcaggtgacgttttatgtgtgtgcattatttgatgtacttactctcattccttcctgtttttatttttaattttttacaaattattattgtttttttgatacagagtctcactctgttgcccaggcaggagtacagtggtgcaatcacagctcactacagcctcaacctccccaggctcaggtgatcaatccacatcagcctcccaagtagctgggactacagacactcaccactactcctggctttttattttattttattttttattttttgtagagatagggtctcaattcgttggccaggctgatctcaaactcctgggctcagttgggtgcagtggctcacgcctgtaatcgcagcactttgggaagccaaggtgtggggatcacccgaggtcaagagttcaagagcagcctggccaacatgatgaaaccccatctgcactaaaaatacacaaattagccgggtgtggtggcgggtgcctgtaatcccagctactcaggaggctgaggcaggagaatcgctgagattctcctcagcctggagtgagatcacaccactgtactccagcctgagcaacatagtgagactctgtctcaaaaacaaacaaacaaacaaaactcctgggctcaagtgatcctcccgctttggcctcccaaagtgctggaattacaggcataagccaccgctcccaacctcctcttatttttaataaataaaaaaagaacaacatagaaacatcaagagatattttttaaagctgcttactttggagacttgagaacatgcacttcgactgaacagagtttgatgaactccagcacaccagtcatcagaagaggcaaggaggaattctcccctgagccttctggtgggcccaggagttcctcggcttgtgtctgaaggcccctgcctcagtcttcaatgagcttctcctctgtatctgtctctcttctgtgtcttctaaggatgcttgtcatttgatttcgggcccacctggataatccaagatgacctcatctcgagatccttagcacatctgcaaggaccctttctccaaataaggtcacactcataggttccggggctgaggacatggatgtgcctcttttgaggtgtatacgagacagatgaaaacatctgagaaagttctttttcatttttgttgttgttgtttgttgttgttttagagacagggtctcactctgtcacccaggctggagtgcagtggcacaatcatagctcaagcagcctcgaactcctgggctcaagcgatcctcccacctcagcctcccaagtaactgggactgcaggcatgcaccaccacacctggctaatttttgtattttttgtagagatgagggtctcaccatgttgcccaacctggtctcaaactcctggcctcaagcggtcctcccgcctcagccttccaaagtgctaggattacaggcgtgagccaccacgcccggccagaaagttctttttcataactcatggccaaaccagagagcctgagccccaactccagagaaactctcttcccctgctttcccaagggagcctgggaatctcccctctggtttggaccagaggatggacagaatgacctgttgctcgcctctccctttcggagcccctccaaggaggaaatgaaaggtggacggcagacagtcgggggaggcattgcctgtggtggaacctgccctgcagctgatgctgtttcttttaggaacttcacgtccatcttctaccctcactatggcaactgttacatcttcaactggggcatgacagagaaggcacttccttcggccaaccctggaactgaattcggtgagttttggtttatcgtggggccagagccatgaggctttaaccacccccacaatgtgggactgaaagaccatcagctgttgcagggtgggactgaggggggaccaaggcatcaagaggagtggctgctaccgaggctctactgtgtgccaggggaggccaggccaggcgcttcctcagccattcccgcccacaatgctcagaatccgtggggtagcaactggtgttcccattttactgatgagcaaagtgaggacttggaagcagcacagcttcgtggtcaagagctcaagcttcagccaggcgtggtggctcatgcctgtaatcccaacactttgggaggccgaggcaggaggattgttcaagcccaagagttcgagaccagcctgggcaacaaggtgaaaccccatctcttaaaaaaaaaatacaaaaattagcgaggcatgatggcacgtacctgtagtcccagctactcaggaggctgaggcaggaagatcgcttgagctgggaaggtcaaggcagcagtgagccatgatcacaccactgcagctccaccatttacttgggtggtgttcctgagctccagagcaaccttctcaaagccttagtttccccaatcatagattagtatatagtagcagagcagagcatttagtatagtaaatcgtatctaccgtgtgagccatgatgatgagtaaatagtataagccttgtgagtcattacgatgtaatgtggtaaatcgtttcacctgcctaggaagtagggaatgctccatatatgctgagtattctgagcagtttttaaacaacttgtccaggatcatgcagttaatacatggaccaaaagacattgcatgttcttacctgtaagtgggagctaaatgatgtgcacacgtggatatagagtgtggaaggagagacatcagagacttagagggtgggagggtaggaggcaggtgagggacaagaaattaatgagtacagtatatatgattccagtgaaggttacactaaaagcctagacttcaccactgtataataattccatgtaacaaaactgcgcttgaaccccttacatttatacaaattagaaaaagaaaagaaatacataacagtctcttagtctctctgcctctctggtgtacagtttgtttgtttgttttcttgagacagggtctcactctgtcacccaaactggagtgcagtggcacggtcatggctcactgcagcctcaacctcctgggctcaggtgatcctcccacctcagcctcctgaggagctaggattgcaggtggctaattttttgtagagataaggtttcatcctgttgcccaggttggtcttgacctcctgggctcaagcaatctgccctccttggcctctcaaagtactgggattacagatgtgatccactgcgcccagctgtacagttcttaaagaaagacagagacacacagagagaagctgaaggagtccatggaagtgaggaagtggggcatggtggatgacggatccccctccctcggggctcatgtgttgcactgacccctagagaggggctggtggactcaggctggctgtggttttgcggcttgtgagccgggcacaggtgggagtggatccctcctcccatctctaggttctgacctctgcaaccaccaagaggcaggctctcattcagcgaccatcggggccgctggccaagagggcaggtgagctgagtgcctttcacttagcccccatgctgctgagagcactgccacagaggtgccagtcaacttactcccagaggcagatggttatagtcagggagccagctgctgtatcagaagcccagcaaaagcacttcctcactggaagacctcagacaagtcccttcacttctctgtgcctcagtttctccatctgtaaaatggggacaatactagtacctccatcatgcagcccttgtgagcatccgaggagctcatgtttattttattttatttttggagatggagtctcactctcgctcaggctggagtgcagtggcgcaatcttggctcactgcaacctccgcctcctgggttcaagcgattctcctgcctcagcttcccaagtagctgggactacaggcatgcgccacaatgcccaactaatttttgtatttttttttctctattttgatatggagttttgctctgtcgtcctggctgcagtgcagtggcgcaatctcggctcactacaacctctgtctcccaggttcaagcaattctcctgcctcagcctcccgagtagttgggattacaggtggccgccaccatgcctggctaatttttgtatttttagtagagacgaggtttcaccatgttagccaggttggtcttgaactcctgacctcaagtgatctgcccgcttcagcctcccaaagtgctgagattacaggtgtgagccactgtgcccggccaaggagctcatgtttaatgaggcccttagcacatcaccccgcaggtagcaagtgctcaactagcccttattgtcctaaccagagggactcaactccacgtagctcaggaccgtggtgcgtgggagactgggtccagtcccttcccttgagaacagtcaagaggggaaggaagacagacaataaaagagcaatcacacaaatgaggcaggtactcagaaggaaagttccggggctaggaaagtgtacaaccaagaccctgacacctcgtctgagccatcagagaacgtttctggaggaagtgatgctggttgagatctgagggaagagcatgtgtttctaggggaagggaaggggcagagacagcattccagagctagggaatagcactccagattgaggaacagcattccaggtgagagaacagaattccagagcaaggaacagcactccaggtgagggaacagcactccagagtgaggaacagcattccagagtgagggaacagcatttgcaaaggcatagcaggaggaaggcgtgcagaagctcggaggcattgaacggggacagcgagggcacctgtggtgtgaggtggggtggcatgggtgggccgtggccatgctatgcctccttgatctacctcctgatcagaaaagagatcacgggaggcaagagacacctagggaggaggctacgtaagagcctgccttagagatgatgggggctttgcagaaggcaagcagtatttgaggactgagtttttgcaaagtggagccagcctccttggcggtccctggaggtcccctggccggagggagcttggagaagtgggtagtggggtctcctttctgcctcaggagaaagttcaggcagccctcaccccaccctccccacaggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggtatggccggagcccaagggcagtcctagagggtctgagggtgggagcccacctgtccagggccaactgcccttggcctgggaggaggggatctgggccccccagccctggccttccttccttttggctggaatccccccagggtggcccaagctttaggggaaggtgagccctctggcgccccctctggcgccccccctggcacctgcaggggtccacagccctctgtccccaaatgcttgatagaagggaggtgcagaaagggcttcctggggtgaccagtgtccccctcaagcaacccctctaaacacaggacaagcttcagcgcatgggggagccctacagcccgtgcaccgtgaatggttctgaggtccccgtccaaaacttctacagtgactacaacacgacctactccatccaggtgggaaggtggtgcacgcctcatgccccggggcccctgtccgggtttatggggccaaggcctcagtactccgggagagctggccccagcaagtctggctctgctgggcctttgtaggttgccacggggcaccccgggcctgtgggaccagtcactttcctgggctctctcaccagggcctagggttggccacttctcatccccacattggcaggtgtacccctggggaagcccaggggattatggggatcttactctggggtttcccaagatgaaaacaaaaaatagcagctaacaccatcaagcttccattgtgtgtgaaatgctgtgcgaagggctggaacacattccatcgtcatttaatctttcaactgcctcctgccatgaatctacaatatagtaatgacagcagcatttattgataaactaataatagcagggttaccatgtgttaggcagtcactgttgtaagtaatttacatgtatattacatcatttaactttcacaacaaccctaagatgtagatactattatcattcccattctgggaatgaggaaattgggattgacagaccccagttcaaatgcatcatcaatttacctgagaagtccctttttttttttttttgagatggagtctcactctgtcacccaggctggagtgcggtggcgtgatattggctcactgcaacctccgcctcccaggttcaagcaattctctgcctcagcctcccgtgtagctgggactacaggtgcccaccgctacaccggctaatttttttgtatttttagtagagacggggtttcaccaagttggccaggctggtcttgaactcctgacctcgtgatccaccgcctcggcctcccaaagtgctgggataacaggcatgagccaccgcacccggactttattattatttttttaataagagattgctgggcatggtggctcacgcctgtaatcccagcactttgggagtgcgaagcgggtacatcacttgaggtcagaagttcaagaccagcctggccaacatggtgaaaccccgtctctactaaaaatacaaaaaaaaaaaattagccaggcgtcgtggcacacgcctgtagtcccagctgtgcagggggctgaggcaagagaattgcttgaacccgggaggcggaggttgcagtgagctgatatcacgccactgcactccagcctgagtgacagagtgagactcttgtctcaaaaaagtaaaataataaaataaaaaagagagacagggtcttgctctgttacccaggctgaagtgctgtggtgccatcatagttcactgcagcctcgaactcttggattcaagcaatccgcctgcctcagcctccctagtagccaggaccacaggcatgagccactgtccctggctaatttcttaatttttaaaattttttgcagagacagagtcttgctatgttgcccaggttggtcttgaactcctgggctcaagcaatcctcccactctggcctcccaaagtgctgggattataggcatgagccactgcgcccactggaagtccctctttgcatctgccttcaatcccccttgctgtagctggaggcttccttctcatcctgatctccagagttaacccagacctgccactagtcctggcccccttggagagggcagactgaatccttgcaaaggtgacaaaaatgaccactcgctgatacttcctctccagcccagtctgccttgccatatcagtgcactgagtcataacaagagggcagcccagtgcctgcctcagtgtctgggtgcccgagcatggcatggtttgccctttccccgtaggaaatgaccctcctggtgcccacctgcccacccattgcctggctggtttggccacctcgcgtctggagggacttctgcccattatggagaactctagccgtcatctgagcctctggagggacagacagacagacaggacagtacagggaggtgggaaacacggagaagaaggtaccagccccagaaacctcattccaggaaaactgcatctctcgtttcttccggtgtggtagccacccaggccagaaaacagccaagagccaggccctgatcgggagctctgcccatccccatggacaccccaaccaggagcaggcttgagcccaccccagcctccatcacagggcctggaaggactcccactttccagatgagacagagaggtctacaagaatataagacgccttggtggggcgtggtggtgcatgcctatagtcccagctattcagaggctgaggcgggaggatcacttgagcccaagagtttgaggatgcagagagttatgagcgtgccactgcaccccagcctgggcaacagagtgagaccctgtctcaggaaaaaaaaaaaaaaaaaaaaagaggccgggcgcgatggctcacacctgtaatcccagcactttgggaggtcaaggtgggtggatcacttgaggtcaggagttcgagaccagcctggccaacatagtgaaacctggtctctactaaaaatacaaaaatcagccgggggtggtggtgcatgcctgtaatcccagctactcaggaggctaaggcaggagaatcacttgaacccaggaggttgaggttgcagtgagccgagatcatgccactgcactacagcctgagcaacagagcaagactccatctcaaaaaaaaaaaaaaaaaaaaaaaaagaatgtaaaacacttgcccgaaaccgagctctggctcctcctggccatgccgtttaatctgccttccagccctgatttcctgccctcagagagccacagactcgttaggggtaatagaaaggcaggacatagggacctgagacggagcccgggctgcaggaggaacagaagaggactcaggagcgcaggtgtggaggggcggggccgagtggagagaggtagggaggagctggccagggctgtgtccaggagcccggggtagtcaggacctaggaaactggataggcaatgaaacaccaagaaccactgcctccatccgtgcagcgcttcctgagcacctgatgtggccctgaatcctccctcccaacctcaggagacaggtgtcctcagcaccctgtttcacctatgagtaaaccaagccccagagggtcatgactcgccctaggacacatagctggtctctgagtggactgaaaccaggtcagaatgacctgaaagcccagtatgttggggccgagtgagtggagactcatcacgtccagcctcctggaggctgcctgggagccctcctcttcctcgccccaccaggagacattctgcagaccagtgggccactcacttcctctgtcatcagctgtgcattaagacgcccagagatcatccttctcctggctttccctgggcaattccctctgggaggaaggagcacagagccagcctgcctagcttcctcggtggcctgtcagggtgcatctgtgtcaggtgcttggacggaggctggcatcctcataatgagagctctctgagcattggctttattattaggggcaagccgctcttccccatgttgaagggtgaggaccccagctctgaatggtgggacctgggatactgcggtctggcctgggtccctctgtggggtccagagacctgctgggaagcccaaaagcgtccaggactgtggggtctgtagctgcagccagtcatctcaccacagcttctcagccctggagcacctccaccagctcacctacctcccttaacttgggcatcacttctctggacacccctggtgctggaatggggacatcactgaccatgcctgtgttctctccttatgaaccccctaccctccccaggcctgtcttcgctcctgcttccaagaccacatgatccgtaactgcaactgtggccactacctgtacccactgccccgtggggagaaatactgcaacaaccgggacttcccagactggggtgagcgggggcacgggggatcggcactccagccatctggggccacagaggctctgaccatagaggaggaggcagagctcagtgccctcagcagagtccagagatgtgcccagggtggctcctccacagtctgaggtccctcctatgatcccctcccaggcctcctttctgcaggagcccagccttctctctgctcctcaatttcatgaagcatgggcttgaaacacataggcatagaatgcacgtgtccttgtgggcctgtgtctgtgtgccacacaaatgctcacacatgtgcaaccctgggcatgtggctgctggcgagtgtgtgcctgcactcatgtttccaagtgcacaagtgcaaaggcatttccatgcttgcgtccaaatgcacaggagctgttcgtgactgcagtgggttgctgtatgtagtttatgcacaggcacaaatcacttccagggtctgcatttgtgcactctggcttttgtgcacgtgtgtgtgtgtgtgtgtgtgtgtgtgtgcacgtgcatgtatgtataaggccacgtgtccatcttcagcatgtgtgttcatgtctatgtgggctcattgggtctctctgcaaggcgctgggtggaaggggagtgtgaggaagccattagcatgatggtagcctccaaggactcgaaacctggagtcacagcaggaagaagagccctgctgggctcacaaccaattggagctggggcctgggagccctggcggtctggagtccaaccaccgaagaattttgtcagcagggtgcagtggctcgtgcctgtaatcccaacactttgggaggccgcggtgagcagatcacttgatgccaggagttcgagaccagcctggccaacatggcaaaaccccgtctataaaaaaaaaaaaaaaagaaagaaagaaaaaaaaaagtaaaagagagagagaataaaaagaatgctgtcagccggagactcaccacttacaaccaacacaaactaaatgggaaaacgttattccttccagtcacccaccctttgttcatgaccccataaccctgtccaccaggcagggatggggatggccggcaaagggaaagctgctgggacccccctgagctgggccccaggccaggctggggtgaaatggctggaggtcgggggctgggtggggagcggtgatttttcatgacacctcctcctgccacctaaccacagggccaggagagcagaggggccagccagaggctcagcagggaacaggggcacctaaaaagcccccttaaacctcttggccgcctttctgtctcctgcgcagcccattgctactcagatctacagatgagcgtggcgcagagagagacctgcattggcatgtgcaaggagtcctgcaagtgagtgcgggtgggcgggcacagcagcgggcaggcatggaggggcatcactggcagggaccacaacaggcctggccttctctttcagtgacacccagtacaagatgaccatctccatggctgactggccttctgaggcctccgaggtgagacagttgggggccaagctcctggctcccacctttggctggggacaagtctgggcataagatgtgggctatttggaaatttgaagggggtgcctttttccctccctccttccttccttctctgtttccctccttccttccttctttctctgctttattccttccttccttccttcctcctctcttttcccttcctccctcccttctcccttccttccttccttctttcttccttccttcattccttctcccttccttcctccctcccttcttctttccttccttcctttctccctcccttctcatttccttccttctttcctttcctccttccccctccctccccacttctgtttccttctttctttccttccttcctcctttcttcctccctcccttccttctttccttccttccttctttccttccaccaatattctcccaggcactgtgctgtgtacacagcacagaattagacagacataatccttttaataggagagggccaagatcacaagcagaaataaaatcgtttcaaagtgtgattatggctgtgaaataaataaacaggttatgggagagagtaactgcgggaaactactttatttttgtatttttactttattttttatttttggagacaggggcttcctctgtcgcccaggctggagtgcagtggtacgatcacagctcactgaagcctcgaactcctgggcttaagtgatgctcctgcctcagctgtgatcctcagctgggaccacaggcacatgccaccaggcctggctaattgttaaactttttgtagagatggagtctcgctatgttgcccaggctggtcttgaactcctggccttaagcgatcctcccacctcagcctcccaaaatgctgggattacaggcatgagccaccatgcccagcttctgggaaagcatgttagaccgagtggtcagggaaggcctctctgaaaaggtgacattggagctgacacctggaggcagaggctgagccatcatgggcagagctggggaggattccgggcagagggagcaggaagtgtgaggaccagaggtgggagagagccgggcagggtggccaggcccgccgaggaagagtctggaggcccgagtccttcctcccctagaacagcagccacagcttccactacgaccttcctcctgctcctcatccaaattgtgattcccccgggggcctcaggaagggacagggctgtggtctacctcccccagggaacagagccatgactgggagggatgctgcagatggcaacttttgcaaccaccttcttgggttccaggactggattttccacgtcttgtctcaggagcgggaccaaagcaccaatatcaccctgagcaggtgagcctgagcctgggcggggctggggaagacagggaaggggtccagaaactcggggcaggagtttggacacaggacagctcctcagacacattctcacatgggtcagaccgaggagcaagtcttgaggaggaggcactaggagtgagagagaggaaaggcagccaaggggactctgagtctaccacctgctaaggagaagcctgtgcttccctctgtcactgtgcatccaaccagccatccattcatcctccatcatccacccacgcgcccagccatcctccactcattcatcctccattctcccacccagccatcctccacccattcatccctccatcatccacccacacacccagccatcctccactcattcatcctccattctcccacccacgcagccagccatcctccacccattcatccctccatcatccacctctccattctcccacccacgcacccagccatcctccgtttattcatggatctctccatccattcaacacaaacactagttgagcacaagaaagacacacagtccaagctagcaggagtctagggggcaaacatatgtaaaaagggctcaaggagaggagggtctgtacaagccccctactctaggagtacagcagggaaggagcctcagtctgcctgagagataagggaggtctgcgtagggaggtggctttgagtgaactctccaaggaggagtaagtgctgttcagataagaagaggtaccaatgtccaggcagaagacaaagctggaaagcctggaggcacgagacagcacagcctgaggacgatcaggtgggaggggatgcccacacagccacccttctctgtcccaggtgcagtgaaggcgctcaaggctcagtgaagagctctgtgcggagtcactccgtatagcccaggccaccctgatggcacaaagtggggagctcagagcagatctttggggctgtcccaggccagagtgtcctgtagggaactggtagtcaggggatggagaaagggggccataggatgggtgctgggcagagatgcccagaagggccgggaagggctgcacttgcagttctcgtttggacctccccactcacgggggcacgcatgagagaagctcaggacagaggagggctggggcggccatccctggctgccttcctgtgtgcatgtgtgcacgggtgtgtgggtacatgtgtgtgcatacatgtgggtgtgtgcacgtgcatgtgtgtgcatgtgtctatgtgcgtgtgtgtgtgtctgtctgtttggaagggggatacattagtcccggcccttctcgctgcctcctgcaggaagggaattgtcaagctcaacatctacttccaagaatttaactatcgcaccattgaagaatcagcagccaataacgtgagtttaggagtctcccaataccccagccctgccctgccctgacccctgcaccctgagggtgggggaagggttctgagccctatgaaggaattaggaagatccctaagacagtcccaagttattcccctgggccaagatggtcaccccctcccgttcccacccaagaatcacctcccaggaagctgtgaggctgggctagaggcaagaatgtgtggcctgagctcaccccagctccctgttccccacagatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctgcccctgcccaccccgggcggctgaaactcactgagcagccaagactgttgcccgaggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactgagtccagctgtgttgtttgtttgactgggcagccgaggtgccctgatggcggaagggcatccatagtggcttgagacccaaactggtttaagggaaaggctctcaagcccctccttccactgccagctcccaggctgacactcactgatccctgcctgggttgtgtacccatctctgacccagtcagtgtggccagttagataagctgctctgactggtcacacctgaattcatctgcccagacctgaagccagtttggcccccaggagaatcacatggtccaagggcggtgggggcacagtacccacggttgccagataacaatcaggctgcttggttgaatttgaatttcagatagacaaactgattttttttttttttgagatggagtctcactgtcattgcccaggctggagtgcagtggcacgatcttggctcactgtaacctctgcctcctgggttcaagtgattctcatgccttggcctcgcgagtagctggaattacaggtgcatgccaccacgcccagctaattttcatatttttaatagagacggggtttcaccatgttggccgggctggtctcaagctcctggcctcaggcgatccacctgcctcagcctctcaaagtggtgggattacaggcatgagtcaccgaccccagccgaaaaactgatttttttagtatatgtacatccatgcaatactagagacacatacaaataaatcatttgttgttttttttgagcattttatacatatatatttttatagagatggggtgtcactgtgttgcccaggtgggagtgcaatggcatgatcatagctcaccgtagcctcaaactcctgggctcaagccatcctcccacttcagcctcccaagcagctggaattacaggtgtgcactaccatgcctggctaattttttttaattaaaatttaattttaatttttttcattctgtatttttaattgctaaataccgtcccccaaaagcttaaggtacccaaagagagatcagggagctgtcaccagagtacggtctggcaggtgcacacacagcactgcagcaccctgctgtcacctaccgggcccctggtgatgaaggagaggctggcttagagcctgagcctctgagggcccagccttcctggcctaggtcacctgtgtcccttggtctggaaggtaaacaagctggcctcccatcaagtgctcaggatggcacctgtggaagaaggaggtgccacagagtcggtgccacttcagtcaaaggcaacgttgctaggggctgagtagggagggctgagtaggaaaccgggtttcccagcttggggcctggctagctcgcaggctgggcccacaactcttggtggttaccacccttactacttactgtgtgattaccgctgtgattacttactactgtgattaccgcttttattactagcagtagtagttgtggccacaatcactgttaccatttgttgttattaaacaaggactacattggatcaagtacttatcatatgccaggcactatgccagtaactttttaaattttatttcattctcataaccactgagaaatagtataatagcatcccattgcacaggtaagaacactgaggcttaagaggtgaagtaaggtactcgaggtttttaagtgacaaagctgagaccccagcctcaccctctgggtgccaatggtcataacaataccagtcccttacgggagcccagagctttcatatttattatcttatttgaagctatggggcattattatctagcccgcgtgacagctcttcagttacatgtcaatttgaacaggcttaagctacaaagggaattcattagctcttgtagtaaaagggtttcaggcatggctgtatgcaggggctcgcctaggtctggggtttcttttttctttttttttgagatggagttttgctcattgcccaggctggcatgcaatggcgctatctcggctcactgcaacctcccc

SEQ ID NO: 13771 - DNA, 6644 bp, Human
cggttcactacaagctccgcctcccgggttcacgccattctcctgcctcagcctcccgagtagctgggactacaggcgcccaccaccacgcccatctaattttttgtatttttagtagagacggggtttcaccgtgttagccaggatggtctcgatctcctgacctcgtgatccgcccgcctcggccttccaaagtgctgggattacagaagtaagccaccacgcccggccagaattttggatattttagctaaaatatattttagctgaagggggcaagacaaagaaaaataaataaatacacgctcacacatacacacagagaataactgaggggatgggattttaaaaatttatttcatttttcccatgggatctattaatagactagcgaggggatgggatcttgaacactggttgaaggaaccgacttaagagcgaagacatgctgctattagcgaagacagggaggtgagggtaagttcatttattcactcaacaatcactagttgagtgtggattaaaaaaaacagtccttgaccacataaggaattaggtctagtagggaagacaaacgtaggtcaataaattacataagggttatactagattgtgtggtggtacaggtggggaagcgagcaactgtctgcattgtgtccaggaaagggtcacaggcgtgttatgtagattctggagaaaattcaaaaatagcatttatttttacttatttacttttgtatgtggagacgagggtctcactatgttgcccaggctggtgttgaactactcgcctcaagaaatcctcccgcctcgacctcccaaagtgttgggactacaggtgtgagccaccgcgcctggcctaaatgtggcatttagaaaaagtatttacaacatctgcattaaaaggaccataaagcaaccaggcatctaagtccctgaagcaatttaagttgctcaaacttgagaggacaaccaaatgatagcaaaagggcaaaagagaaaggaagctgcagtgcccactcagaagtgtgagagcgggagaaggcatttcgggagccgcccgagcttcaggaaaccgagcgagacaccaggtgggcacactgaggattaaagagggcctcgcggttccgcactgcggccgggagacaaaccagtagccactatcaccagccccgggcagaccactaagaactgtggaggtgcgcggggcggctcagggctggcgcatttggtgaggagctcagacaacgaggcccttagggtcggcttaggcggttccctgaccaaggcgccagaaaagggcctggctcaagcaagcacgggcggcgtgcagtacagcacacctagccccgattcttcaacagttctcgccctccgagcctagcacaacgagcctcaccgaaaccgtacaccgccaccaggacactccgtgatgggggatcaccaccctcagaaagaggaagcgactagcaggcgcgcaatcccgcgagaccaggaggccccgcccgaagcccggcctctgtgaccggaagtgaggcgttttgccccgcccccgtggccgatacctcgcgagacttggcgaaggccttcctttttcgtctgggctgccaacatggtaggtgtttcgtttcttgcctcctcttccttgccggcggagacccctaagctgtattcccattgcccctagtcatccactccctaccatggtcggggcttccaggctgcgcatggccgcctgcggggcagggtggccggcgcgggcccggggcggggctcccggagccgtgtgttaggcccgcggttcggatctctaggacacgcgggcccctgcgctaccgtggtgagacctcacggccctgagcggatcggtaccctcagctttcccaaacgctccagaagttaggtctttgacccacaggcttacaggaccatctcggctggcgggcatcgccccctgcccctaattccttaggccttaccaccaagctttttccacacagccatccagactgaggaagacccggaaacttaggggccacgtgagccacggccacggccgcataggtaagtgccggcttcccctcggggtgggccttgggctctcttcgggtgcttagctagtctggagatcggtagcctataagtgggttagaataagacctttttgtggtcaagttgcacagctgttgatttttttctgacgatcctctagtattccagttctaaggaatttcacatcagtggggtaataggaattgagcaggcacggtattgggttagttgaagacatggagtactgtgggaatgctgtgatgtggaacctgaaaagatgtttcacccggaatcctaaagtaatcgcattgctgaaaaccggcatcggtagggtgggaacagcgtaagcgggacacagaagtctgggaaacactctgcttttgtgcgaggaagtattgagatgcatgagaaggctgtgtggtgcatgtagcttttttgtgtgtgtgtgagactgatcactgtcgcccaggctggagtgcagtggcgaaatctcggctcactgcaacccctgcctgccgggctcaagcgattctcctgcctcagcctcccgagtagctgatattacaggtgtgcgccacgacgcccggctaattctttttctatttttagtagagtcgggggtttctccgtgttggccaggctggtctcgaactcctgacctcaggtgatctaccccccctcgtcctcctaaaatgctgggattacaggcatgagccatcacaccggccccacgtagctttgtattcctgcaggcaagcaccggaagcaccccggcggccgcggtaatgctggtggtctgcatcaccaccggatcaacttcgacaaatagtaagtgtccttggactgcttttattgacacagcttgggaggtaggggcagagagagggctggcttaaacaaaaagtttagaagcaagccttgcctattgctgttttttaccaagttaacacttggtgtgaactgagaacctgtcatcgaggctagagtcacgcttgggtatcggctattgcctgagtgtgctagagtcctcgaagagtaactgctgaccttattcactggctgtgggccttatggcacagtcagtcaccaggttagagacatgcttcacattcacctacccacaaactagtggatgataaattttggctattcagaagacgtttattataggagtatgtagattttccatagagtgctgttatgtgacttgaattttagtctcggccctgcctctgacattgtcggtggtttatcctggttccaggaaataagactagccttttcctcatgatagtctttggtggtttttaaaacagttgtttaagtcaacagatgtatcatatgcctgacactgctctacaccagtgaataatttacactctaatagggggtggtaactataaagatgataaacatagcatcttaattggagtgtgtatgaaggtggttgttacctcttcctagccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcggtaagttaattggatgtttttctgtacttccataccttcccttacaaaactctggcttaatctaatccacttatataatctgtacttcccagttacctaccagacattgatattcttcctgtggtagaattatcataggtagttccctatccgtagcagtgcctactgtcactgcccaggttgtatcaggtttgcatttcgtgcttgaactatagctggttttcactgagcacagctcttggcccttcatgttctccagataatagaatcctaatatgttccattgatactcagtgccatgcattatctgaagagattttcccccaaaacagatgtattatgtctgtccttgcgggggttctggtccctgtgtcagtcttaactctcatgaatatagaggtagtgttaagaggccagaaccctagggacgctttaaattcacttcccagcctatttaatgtccattgagtagttctggtggtcaggaaggtggttgtcttcttttgcttagcagggggtatttgagcaggaggaggcttatgctttgccgagactagagtcacatcctgacacaactcttgtcctggtgtgctagagtactcgaagagaatctactggtcttgattcactggtgggggcagtcagtgcccccgttagtgcccagatcagaaacatacataccctgcctagggatttagaaagtgggttggcagtctttcctcacgcccatcacgcagttggtacctactacagtgtattgtaaacttttttctctgttcttctagggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaacacagacgttggccagttaaacatttctgtttataaagtcagaataatacctgttgatcactgaaaggcctgcatgtattgtactctgaattttacagtgaatgagagaatgtaccctaattgttcaacagggctcaaaaggaaagattccattttgatgggtcacattctaaagaggggcagtgtgataggaatgagatggtcctttaggacttaagttctcagcccaaggtttttccacgtggccccctcatcttttttttttttttaaacggagtctctcttgccaggctggagtgcagtggcacgatctcggctcactgcagcctccgcctcccaggttaagcgattctcctgcctcagcttcctgactaactgggattacaggcgcccaccaccatgcccagctaatttttgtattttcagtagagatggggtttcaccatgttggccatgctggtctctaactcctaacctcaagtgatctgcccacatcggcctccaaaagttctgggattatagtgtgagccactgcgcccggccatggctccttaatcttgatccaaattattgttacatccagaatgtgatgaatcaaaatctcgagatgggggtccagcaatctgaaatttcagtatgccagggcttttctgtatgtcaaagtgggtttgaaatagttaatttttcttctagtctgaaatgtatcgggaaaatttggaaatcctgaaggctggaaattgaaataagtttttctaggatttgtgtctcttgctattggaaaactgatggtgaccaattcatgtttacaaataagatcctcatagatctcggtaaattataatttgctacagttttatggttcttcctgtgattttgagctttttttgacccaaaataatacagtctaaaactatagacaaataagatggcacttagactcctgggttttagttagtggaggtttccttagtgcactgtggggtcataataagccgagaaccatggctgtctatgggacacatctgtcaggacaacctttagaggatgttggggatcaaatagaaggcacagagaagcactgaattggcttacataagaataggctagaattacaagtagtgaaacctcgattcagctggacaattttaaacaaatgtatcatttggcttgtatcttctgttgtgctggagaagttagaaataagggctctccagaccagcctgaccaacctggagaaaccttgtctctactaaatacacaaaattagccaggcgtggtggcacatgcctgtaatcccagctactttggaggctgagccaggagaatctccaggaggcggaggttgctgtgagccgagatcgtgccattgcactccagcttgggcaacaagagtgaaactctgtccaccccccccaaaaaaagtaagggctctccattagggcccatagaggacttgtaatatggaacctgaatccaaggatcccacaataagtggtcagtagttcatgatgaattaaaagactcaatatttggtcttcacccaatacctgtgtgacttttagtcctaatttcctcatctttaaaatttcagtgaaagtgcctacctgaggattgtgtagattaaaatggaaaccgtgcacttaattttttgttttgttttgagacggagtctcgctctgtcgcccaggctggagtgcagtggtgcgatctcagatcactgcaagctccgcctcctaggttcagaccattctcctgcctcagcttcccaagtagctgggactacaggcgcccgccactgcgcccggctaattttttgcatttttagtagagacagggtttcaccgtgttagccaggatgg

SEQ ID NO: 13772 - DNA, 20805 bp, Human
aagggaagggaagggaagggaggggaggggaggggaggggagggaagggagagagaaagaagaaagagaaagaaagaagaaagaaagaaagaaagaaagaaagaaagaaagaaagaaagaaagaaagaaagaaagaaagaaagaaagaaagaaagaaaagagtgaacccaggaatgaaagatcacacacactgtatgactctatttacatgaaatgttcagagtaggcaaatccatagagacagaaagcacatttatggttgccaggagctgggaaagggcaggatggggaatgactgtttattggatgtggggctctattttggggtgatgagaatgttctggaattaaattcatggctgcataacactgtgaacatactaaatgcccctgaattgtacactttaaaatggttaaagtggcaagttttcattaagcagtaaattaaattctactacaattttaaaaagactaaaaaataatttaaaaaagattaaatgagataacgcaaaaaagcattatctcgaaaatacagctgatattagtataattcttactaagttttaagagtctaaggtgcaggattctaagtttaaagggataggctcttttggttttttggtttagttatttggttttttttttaatccattatccccacccttgggaggcccccagcacccagtctgcactagaggatggggcccacctcccttttctctccaggcccagccactgaccaccagtaccctggccaggggcaccctcggtcattgccctccgtggcccaaggaagggaacagaaacaacagccaagaagacaatagccgccgggaagtcctcacatttctggagaaatagagcccattaatgaatgaagttcctccagcctgatcggaggacggggtgctggggaggcctgggctaaagggctcacctccagcccccaccctggcagggccgatggtacatgctcactcagtgagggggctccagaggtctgtgggtacgaacccaagggctggtgcccaggggcaatcagcttatgtctctgagccttgggaaacagtgagggtcagcccggctccccacgtgcttctgggcagctttggtattggagcaggtgcaaactcaggactagggcaggaccccctgagaggcgactgagcaaggccatcccgactcatgtttccttggccctgcccggggcacagcatcctgcccacatccctgcagccctggctccttcctaggggctctgaggaggcagcacttggccatctggtcacagttgctgcagggcagttcttggccccagctgtaggtaaagtactgtatgttgtaattttttgaaagataacacgttcacacaactcagaattgaaatgccacagacattccccctgctccgcccctttcccccggatacccagtttctcccggaggcagccaatgatctcagaggctgtatacccacccagagttattttatgcatatcaaggaaagtctacatagaggactgtttctggggtacccagatgcagcgtcaaatgccatggaatactacagtgaggacattatcctttcaagctttcaaatcagagcaagggaaaggtcgatgctagagtttctctagcacccatgaagccctctccctttttctactgagttttactttacaggcaacagcaggcttcaagcttggggtcattgtcgggcaacagtatctggcaagaattcaatgtctttttctcatagtcattgtattttggcctctttctatttatggcaactgagagagaaagcttattcctagatatatgtatttaagtaaaaaataaatgaattcatggaaacatattaagcaattatccagataacataagggatggcaaaaatggtgcagatggtggaggggagacaagtagaagttggggtgctcttgttgaatgtctggctctgaactctagaggaggccgcaggggctgggcaggaaggaggtgaatctctggggccaggaagaccctgctgcccggaagagcctcatgttccgtgggggctgggcggacatacatatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgtgtaagtatcagtgcatctgtctgccctgccaggggtcttttcatggacacccactatgccaggagcctccctggcctgaagccagccctgaagccggctgccacactagcccagagagaggagtgccctgggagggagatgggctgagtggagctgtcatcaccccctcctgacctcgccttcaaggtcaagttctttggtgagaaggtcctagctgcattgcaaacagccaggtatagggatttgtgtttgtctgagacccagaatcactggggttcgagttagggttcagatctgagccaggttagggggttgagtcagggggtaaagattaggaggttggtgtatatttggtgttgggggtcactctatggccaaagtcaggggttgccatgagctcaggtgacggaggctccatcactgactgttgtgtgactttggccagctcccctgccctctctgggcctcagtctcttgctcaatataataagggtatagggaggctaaatgatacaatttctaaaatagagtatcgccaagttcaaaagccagaattatagacccccaggactacagacagtgtcacagcatcgtctgggtgaggctagggttagtgtgcggctgggctcagggctgccccatttgctaggatcgtggggttcccatgtgtcaggatccagaggctagggtatgatcaggatctctagctggggtcagggtcagagctctctgtgtcccctagaattgccatcaaccttaaacccagagggaggcccagtccaacccctcagctttaagacctgctgggagcctcatctcagagaggctgagtcatggccaaggccagttgggggtgggagcagggggcttggtgtgggcctgcagcccctcatccactgccctcccctctagtgaaccacgagactgccaaggtgatccagaccgccttccagcgagccagctacccagatatcacgggcgagaaggccatgatgctccttggccaagtcaagtatgggttgcacaagtgagtcgggcctcgggtgtgaccaggctgggggtagggaggcgggaggaacagcctggggcttgcccccagcccacagggaggaaaggcagcagctgggggactcaggtctctccccttgatttggaaccagagcctgacaccttccctacccccaccctccatcccctggtgccctggggggatttattggagtgtatcaacctctccaacagcccctctaagagtcaggcttcaaagggtcctttcccactgccctgggaagatggaggtcttatttcggggtgaatggggggtagggtagaaaaatctcaaacaaaataagtatttttttaaaaaatgtataaatgttgttttcttatagtacagacaggtcttgctatgttggccaggttggtcttgaactcttggcttagccagtcccccaccccaagcctaaaattagtatcttgactttatttgggatgatggtaacagtcaagggtcggttgtgggccaggtgcttttacaaacaatatcctcacctttatcatatatttttttctttcttgtttttcattttttgagacagagtctccctctgtcacttaggctggagtgcagtggcacaatctcagctcgttgcaacctccgtctctgggttcaaggaattttcgtgcctcagcctccagagtagctggaattacaggcacacgtcaccacatccgcgtaatttttgtatttttagtagagatggggtttcatcatgtgggccagactggtctccaactcctgacctcaagtgatccgcccacctcagtctcccgaagtgctggggttacaggcgtgagccaccacgcctggccctttatctatcttaatctttattttatttatttatttatttatttatttatttatttatttatttatttatttattgagatggagtctctcactgtcacccaggctggagtgcagtggcacgatctcagctcactgcaacctccacctcccgggttcaagacgttctcctgcctcagcctccctagtagctgggattacaggtgcccaccaccacgcccggctaatttttgtattcttagtagagacggggtttcaccatgttgacctggttggtcttaaactcctgacctcaagtgatccacccgcctcggcctcccaaagtcctgggattgcaggcgtgagccacagcgtccggcctatcttaatctttatcatatattttagcctcttctgtaaaagaggataatgccatcgcccggatgaccctgcttaacaaacacggaaacaggagccgatagaggtttagcagcctggcggagctcatgtgcaaactcagctcagtatcggaaactcagccaccttcatggcacctcaggctgccctggagcctgggtcccggtctgtgtgtcggtctgaggccccaagggtggggcagacattgttcagggaccttgtctttgtcttaaagccaatctcctcctcctccccggccctgctaaacacgctccccaggggtggtctctgctacccgcgcacattgggccttgagtcttggtaaatgtttctgagccaccagggggcgccagcggtgctggatgccacttcgccttttgcaggaaaactcccgccgctagcgggtgctgtggggcgtcccaggtctcgcgcagccacgccctctgtgtgaccttgggcttcagtttaggcttctgtaaaagagaataatgggcaaggtccagtggctcatgcctgtgatcccagcactttgggaggccgaggtaggaggattacctcagccagggttcaagaccacctgtctctataaaaaatttaaaaattagctgggcatggtggtgcgtgcctgcagtcccagctactcaggaggccaggggaggtcaaggctgcggtgagctatgattgcatcactgcattccagcctgggtgacagagcaagactctgttgctaaaaaataaaagaggataatgctatcctagacctatgtgttgcaagaggtcagacatggcaaaagcgttgagaagttaaagaaatagtatccttaataaatcagcaataattcagtaagaccagactgccatagactagatgtcatagtcattaatatataactgttatcccaaacgtatatgagtggggtagaaataaaatatgattggccataactatgattggtcatgattaatgttagatgaagttggatcatgggtaagatgagaattcttcacactattctctctaaagcgaatggaataaaatagaacagaacagaccgggaaagccagatatatgtggattctccttgctgggcacagtgtgtcatagtggcttataatatgggatttggagtgggatggacccaggatcaaattcccttctactgaggttttctgaagccacataagctgtctgagccatttctgtctcagttcagtgggtacagcaatagtgactacctcgtgggtagctgtgaggattaaaccaggaaatgtgtataaactctaagcacagtgcctgccacacagcatgtgtttggtacgtgatggccgcttctattgtgtcatattccatgtgctcaagccgggccctgggggagagttcagcaagggtagagggatatgagagtgaatgtggcccactggcctccctgcctgcagtctctcctctctgatccttgcttcctaagggtcttcactgagccccacctctgaccaagtccccggcggcacaggcagcacagatcctctgctgtacctacaccaagaccccagggccaacgcttctcccattgtgcagctccacctctgcccccggggcctagctgaggcctcctccaagctgagccacctactatcttccaaactcccaccctccatctggtgtcacctcctcccggaagccctctgtatcagtttcctgttttctgccataaaaaaaatcactccaagtttagtggcttaacatgacacaagtttaccattttacagtttaaaaggctagaagtccaccatggccctccctgagctaagatcaagctgtcagcagaaccagattccttctgggggctataggggagaattaattccctcgctttctgcagcttctagaggcttcccccattccttggcttccctccatctacttttatttagggcgagggaagcttcctgctctgactttctcatttatggtattctcccctgctttccagcagctgtgattgtcccaagtcctgtcctctggttctctaggccagaaaaactatgatctaccagagctcaagaacttgaaagggccttttcccactgtcccttctcacagtgagagccggagcccagcttcgtgctagaatctgtgaaaatggagaaatgcaccctgtgctgttctcttcctccacccggcatctcccctgcagcccggctgggtttttttgtttgtttgtttgtgggtttttttgtttttttgtttgtttttgagacagagttttgcacttgtcgcccaggctggagtgcaatggcacgatctcgactcactgcaacttctgcctcctgggttcaagcgattctcctgcctcaacctcccgagcagctggaaccacaagcatatgccaccactcccggctaatcttttttttttttttaatgcatttttagtagagatggggtttcaccatgctggccaggctggtctcgaactcctgacctcagatgatccacctgcctcggccttccaaagtgctgggattataggcgtgagccacggcctgggcccagtctgactgttttcacttactctctaatgtctcaggtagtgtttattgtattctgtgcagaggtcaagaatttagtcatccaaggaggttagtgtattaggagcttacgcagctattaccagaagagactccactcaaaaatttggtacgtggctgggcgcagtggctcaaacctataatcccagcactttgggaggccgaggcgggcagatcacctgaggtcaggagttcaagaccagcctggccaacatggtgaaagcctatctctattaaaagtacaaaattagctgggcatgatggtgcatgcccataatctcagctacttgggaggccaaggcaggagaatcactgaacccaggaggtggagactgcagtgagctgagattgcccgctgcactccagcctgggcagcaagagcaaaattctgtcacacacacaaacaaacaaacaaacaaaaaaaacgggttgggcatggtggctcatgcctgtaaccccaacactttgggaggctgaggtgggggaatcacctgaggtcaggagttcaagaccagcctggcaacatggtgaaaccccctctctactaaaagtacaaaaattagctggatgtcgtggcgggagcctgtaatttcagctactagggaggctgaggcaggagaatcacttgaacccaggaggcagaggttgcagtgagccgagatcgtgccactgcactccagcctgagcaacagagccagactcagtctcaaaaaaaaaaaaaaaaacaatggtatgagctttaaatttctgtagaactgaaagaggattggagattgtagtagggtctaattctaaattagagcatttagaataatgtggagtctggtcaacatagtgagacccccccaatctgcacaaaaaagacaaaaattagccaggcagtgttggtgcatgcctgtggtcccagctattccagaggctgaggcaggaagatcgttggaattcgaggctgcagtgaactgtgattacacaactgcactctggcctgggcaacagagagccaccctatctcaaacaagaaagaacaaactaaaaaaaaaaaagaagaagaagaatttggagcaatctagttgtttcctataccagaagtctttgccaatctatttttttttaattttatttttaatttttgtgagtacatagtaggagtatatatttatggggtacatgagagtacatagtaggagtatatatttatggggtacatgagatgttttgatatagacctgcaacgttttgtcaatctattttttttttggcgacagtcttgctctgttgcccaggctggagtgtaatggcgcgatctcagctcactgcaacttccgcctcgtgggttcaggctattctcctgccttagcctccaaactagctgggactacagacgcccaccatcatgcccggttaatttttttgtatttttgtggagacgagatttcaccatgttggccaggctggtcatgaactcctgacctcaggtgatctgccctcctcggcctcccaaagtgctaggattacaggtgtgagccaccacgctggcccaccaacctatttttgatctaactttacctctggtggtgtattgatactcttccgaatcaattttcacccttcttcatataccatttacatttctaagaatttgtccatttcatttcatctagttaacctcatttgttgacatacaattgttcgtagtattctctcataattccttttatttctgtaagactggtaataatggccttgcttttatttctgtttttagtaatttgagtcttcttctttttttttttttttgccagtctagctaaaggtttgttgattttgttgatcttttggaaaaaccagctattgttttcaccgattgttgtttttgttctattatttcattcataggcactaagatcctgattacttccttccttctgctagctttgggcttagtttgcccttatttttcaagttccataaggtggaaagtttgattattgagttgagatctttctcttttttaaagataggcatttctagatataaatctccctgtgagcacggttccctccatcttcagcacaccagggttgactctctccgggcgttcttccctggtcacctctccccttcctctcctcttctgcctcctcttccacttttcggtaccctgtgattgtattgggaccacccagataacctaggatcatctccccacctaccccaaggtccttaacttaaccatactttcatatgggtaacacgagttgagtgtggtacccagggtttgacatgttgggtaacatatttgcaggttctgtggattaggaggacattttgggggccatgattctatcttccaccctcgcctagacaaaattggaggctcactccttgggctccctggatgacccccaacatccttcctcacttccattccttcccagcatccagatcagccacttgtccatcgccagcagccaggtggagctggtggaagccaagtccattgatgtctccattcagaacgtgtctgtggtcttcaaggggaccctgaagtatggctacaccactgcctggtggtaagcattcctgtcagctgatgccccatgccctggccctctctgggctggagggctgaatgagggtcctgggtccttggctctttccaggctgggtattgatcagtccattgacttcgagatcgactctgccattgacctccagatcaacacacagctgagtatgtgtcaagcgtcctctggggaagtgggagctggactccagggcttggcctcagcagagggggaggttgtgcaggcagagggttctggggccaccaaaggaggcccagcctgggaagtttgcagggttggggaccccagagctggccaagctcttgactggcctgggcagcatgtggataccatctgatagcggaggctgccctgaggtcatgtcgggtctccctgcagcctgtgactctggtagagtgcggaccgatgcccctgactgctacctgtctttccataagctgctcctgcatctccaaggggagcgagagtaagtacaccaccctgtggcccccattcctgctcgtgcccatcctgttagtgtgtccacggccccctccaggctcaaccccacacagggcatgcttgtgggtggccaaacctgagggcagcaataccttcagtggggtcacttcctaccccctcccatcaatacaccctcaaaggctggaaacaacaataaccaacagctagtaactaacagctattaagaacttgctgtgtgcaaagcactattccaagcccttttcatgaattaattgattttgtccttaaaaccaaccctaggatatagattctgttatcatcccctttttacatatgggtaaactgagtcacagagaggttagaaaggaaaagctcatatctacggagtgcatcctgcattccaagcaccacactaactcagagataaaactctagccaagctaagtaacttgctgaggacacacaactcgccactaagggatgggagtaggatttgaacccagcattctctgaccccagaagctgagttcctagatactttactctcctgcttcccagggtggggctttttgtcttggccaacaccctctgtcaaggagctgtgggtaaccccattgcacagaggaagataacaaggtttggagagtccctagtcatgttaccaatgccaaacctggaaggcagaagggaactggtgggtggggtctggagaggagccctctattcaggccattttctgactctggagcagacggatacatgtatgaatttggactctagacacgttctcgtgtgtgtgacaggtgtgagcgtcacaggagctgggccctcccgaggaattctgggatggtgccacagttaattcttgggtctgaggctccgtgttctcagctgcaaaatgggagtgataattcttacttcctgagctacaagagtcagggccaacagagccatgaacggtgcctggtacacactaggcgctccatggatgcacaggactggtcaggggctcattgtggtgcttgctgccttcaggcctgggtggatcaagcagctgttcacaaatttcatctccttcaccctgaagctggtcctgaagggacaggtgagtgaggctggctgactccctgtggtccagggccatgcccaggaggctggatccctttcctccctgcctttccctgagaaggtgccactcccaccttctccatgtggccagtcccctgtgccggtccccagcactgccaccaccacgcagctggaaggaggcactgcctctggcctcctttcctgcctggaaagcacctgctctgtctgccccagatctgcaaagagatcaacgtcatctctaacatcatggccgattttgtccagacaagggctggtgagtgcgtttctgtctgcatgcctcagaagacagcagtgggagccagaaagccacctgctgcactatgtggccttgggactgtcactcttcctgtctaggtcccatgggctctatctggctctgacacttgatgattagttatgagcatactttggcaaatctctgcccctttgggctgcagcctcacaagctgtgtggcgttgggcaagtctatagaactcaggacaaatgggtgattaagtccaagaggactccaagattctcctggaagtagattaggaaaaaagataattagattgctcacatggctgggcactcatccatgtactgtactctcctatgcagtacagagcagagctgggtttcagcccaagtcttggactctgctctgaaccaaccttctagaagggctctacctacccagacagacagacttgggaaaagagagaatgaaaaagtgccacacccctccccgcacacccaggtcccactttacagaggggaacactgaggctggagggttgggtagctgtgtggatgcaggggagcggtgactcagggcaattcccccatcctgaggccctgcgttgatcttttcctcctgcagccagcatcctttcagatggagacattggggtggacatttccctgacaggtgatcccgtcatcacagcctcctacctggagtcccatcacaaggtaggagttgtgggagggtggggcagggcccagcttccccaggggagttggtccttttttgtgctctgacaaccccgtcccccagcttcaaccttatggcagccaagagtcctggggcgctcctcctcattcctgatgctcctccgcattcctgatgctgcgaggagggcaggccacagcgacgtgcccctgacccctctctgcaggcaccagggctgcccactacaaggatcccagcaaagcaccagctccttcctagagggcttattcggcttctgtcatcctctacagcagtggattgtggcccccccccagggggtactgacaaaagctttggaccctctattacttaggatatagatttctgtaacaaagaaatccgaaataatagctgcttaaacacaataaacagttatttccctctgttgcgttctgagcatctgcagccccgcgggatcaggaggctgcagggtgtcaggcacgcaggccccttccacgtgttctcagccagccccaggcatgacctcatcccagggtcctggctgactggcctgaccaccacacccactctgctcacagcccgttggcctgaacctgatcgcaggaccccaccctagctgcaagggaaactgaggaatttatttcagctaaatattgagaccagctaaaagttaagtggtacagaatggagggagagattggagaagactttagggcggacccagccatctttgtaacagagcctctccctggaaaactggacagaaggatcatttcagaggttcatggccactcctgaagcctgttcacaacccatgggctggatgatctagaggggcgggggactgggcagcagcttgttttcctgattttggcctccaggagccgatggtcaatggactgccctctgcaggggcagggctggtggtcagctggggcggggtgggagctggaggtccgtggtcaccagctgccctgactaatgtcgttacttgaatataaccctgtgaaggcaggaaccacgtctgtctggttcacttcccacggtggttgagacatagtgggcactccggaagtatttgttgaatgagtgaaagccccgctgggggaaactgggtacagctctttcctcagtttccccatctgcactctgggctgaatgctggggctcctcccaatctccctgaagctggacctgagcccagtagggacacacagggtccagccagcgtcctggcttcctccagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggtgagtgggtggggctgggctgctagggaatccagatggcatgtggtatgtgtgtgtgtgcacacgcatggggaggagggaggaaactcggaaacttggtggtgggcaaaagaactaagctggagcaatagcagtgaagtccagactgggcacagtggctcacacctgtaatcccaatcctttgggaagctgagatgtagcaggacgaaccgcagacaaaactcctcagacactgagttaaagaaggaaagagtttattcagccgggagcatgggtaagactcctgtctcaagagcggagctctccgagtgcgcaattcctgtcccttttaagggctcacaactctaagggggtctgcatgagagggtcgtgatctattgagcaagtagcaggtacgtgactgggggctgcatgcaccggtaatcagaacgaaacagaacaggacagggatttttacaatgctctttcatgcaatgtctggaatctatagataacataactggttaggtcaggggtccatctttaactaccaggcttaggtcaggtaggcccaggcctggtttcgggtctggttccttggtttcgggtctggtctctaggcgttgggctacctgcctttagtttcacttctctttctttttctgagtataaaacaatataaaacaatatgagagggtctgtctctcttctctcagagacaggagggtccctggaggccaggagttcaagaccagcctgggcaacatggggagacccctgtctctacaaaaataaaaataagtttaaaaatcagctgtgcacggcagtgcatacctatagtcccaactactcaggtggctgaggagggaggatcacttgagcccaggaggttgaggctgcagtgagctatgatggcaccactgcactccagtgtgggtgacagagtaggactccatctcaagaaaaaaatacagtccagcatttattggagtcaactatgtgttgccagatagatagatggatagatagacagagtgatcaatagatttaggtatagatataacttggcacgtagtaactgtgcattaaatataagttgatattagtcttacatttattgcagttatatttgctacactttgttttgttgcactcatcctgtgaaataagtactgttacctctgttttgcaaacaaaaaaaccacaaagctcagagaaggtaggtgacttactgaagatcacacagcctgtaagaggtggccccaaagcctgtactcttcacctatactgtactagaaatgcttaggtagtttccaggctgtgcttgtcattgaactcatgaggaaactgaggcccacagaggggaagagacttgtgcgaggtcacacagcatgtgtggggcacagtggggagcagaagccaggcctccagccgggacaggggttccctgttccacaccctgcccagagcatctcacatgttgtctgggaggttgggagttgcgtctgaggaggggtccagtccttgaaactgcccttggtccctgcgaagttttcttctgaggagtggactttactccacccaccctccaacttcctcatttcttttcaggcagtgctggagacctggggcttcaacaccaaccaggaaatcttccaagaggtaactgccccctgcccctgtgtggggtttatctcacgtaccccaatcctgctctggcttcaagagcccccacacagccaataacaccaccaatggcaacaattataacagcgaacacagctcctactcggttgttcggcatggagtgaagcacttagtgtgtgtgacttccttcagtgctcacaccgaccctatgagtggggcggtcaaactgtccccattttacacacagggaaacttagtgaatggcaaggctgggtttgagcccagctctattgcccccaaagataaggctccattccctgctccatttcccaggcatagggacttgtagggggctggaaccccaggatcaactctgggctcagagggccccagcaataagtgactgttgattactcctgatcccaaagctgacttcaggcaagctccttggaggtcgcagccccttcttgctatgcccagtggcaatgatgttcataatcccactcctcagtgcagggttccactaagaacccatgatctcctacctcaaatggacctcatgctttctgagtaagcctccctcagctttctggtcacctcactccccccacccactgcaatgacttcttcaggccttccctgccatcctcaaatctccagctgccccctcctgtctaccttccacttccctctccacacacaacctgcttaccagagagctgagcagagccaccaacagaacttcccccccacgtcgctgctcccagtcgcaacccactcacccacacctgcgccttcctgcggccgttctcctgttctaacagaggacggtccctcttcccttctgaactcaggccgtccagccttccccggctctgtgatgcctctctccttgcacatacacaactcacaatattgggcaggcccctgaccggctcttctcccttagccccttgtctgagtcctgttcctttgatgtcctatttctagtctttccatttctctctgtctctacctcctccccaggctaccattatctctagtggggacccatctgtagctcccggtgggtctccctgtgtcctgataccctccaataatctgttccccacagcagccagaacaatcttttcaagaaataaaactggtcattcacctgcctgcttaaagccggtgtaggatacaggctaaacgctctcccatggcctccagggccctgcattttctcatcctgtctacttcttcatctagttgtttcccacccagcgtaattgtaactgtttagttgaaagttgacgaggtcttttgtcagctctagaaatttcttttcttttctttcttttttttttttttaagacagagtcttgctctgtggcccaggctggagtgcagtagcacaatctcaactcactgcaacctccaccttccgggttcaagcaattctcctgcctcagtgctgaaattacaggtgtgagccacagcacccagcccatcagctctggaaatttcttcatcactctctcttccatgattgccccatccctattttctccatgcctacctcctggaatttccatgagacacacgttgggccatctcattccattttccgtgtctcttagttgctctgtcgtgttttccatctcttttatctctatcctaaattctggatagtttcttcaagtatctttttagttcattaattctttttacagctgtgtcttatttgtttacttacccactgagattttcattttattttatttaattaattaatttatttatttttgagacagagtctcgctcttgttccccaggctggagtgcagtggcgcaatctcagctcactgcaacctacgcctcctgtgttcaagcaattctcgtgcctcagcctcccgattggctggggttacaggggtgcaccactgtgcccagctcatttttttgtatttttagtagagacggggtttcaccatgttggccaggctggtcttgacctcctgacctcaaatgatcctcctgcctcagcctcccaaagtgccgggattacaggtgtgagctcccgcaccccgccggccctttctttcttttgagctgagctatgtatttaatgaaaccttttcttgtgtatccagcagttcagtggtttcttggggcatgtgatctccttgagcccagtcccacaggctgtaatcgaaggtcctcaggccacactccccagccccgctggctgcctgcgcattccttatcttggccatgttccttccacagggctcttgtccacactgtcccctctgccagaatggtttgccctcccccatgccatctgctcctcctcctgccacctcagggaaggcctctcccacctccctgactaggtcaggtcccctcgtgccacagcctggtgtgtctctcctttaaatactcctcagctgcagttttacgttctgttctgggatgccctggaaaatgctgggctcctgcagatatggcccgcagctcctgcgctctctgctctatccccacccctagcccagctgctacagcagcttccctcggagggttaccatgcagtaggtcctgttctaagctctttccacagattatctcattccatcctcaggacaaccctatgaggtaggatctatgattatccccattttacagatgaggaaagtgaggcccagaaggctaagtgaaggcatcctcagcacatcctgagagaggagttcagggtaggaatagcttcactagcacacagatgagaaactgaggcccagagaggacaagagtcctaatttgcacagcctggggcctgggcactaccccgagctacttccttttccccagccctggggcccggagccagctttgtccttcccatctccgagggcatggactgctgctgccctgatgggcccctgtcctggccatgggacccctgtcttccacaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggtgaggcgggtgcagggagaggtggtggtgggggaacctgactcacatatgggccgcagagggcaggggcctgggggtctctgaagcctccagatccttctcaccacctctgctggcactggttgtctcttgcacatggctccttacaatcaaaatcacatcatgcaagtaacgagggggtacacacgtggtttccacagcttaggtaatattttctctcttttcttatttttattttttttagagacagggtctcactctgtcatccaggctggagtgcagcctcacactcatagctcactgcagcctcgaatcctgggctcgagtgatcctcccacctcagccctcctgagtagctgggaccacagacaaacaccaccacacctggctaatttaaaaaaaaaaatttccttagaggcggggtcttgttatgttgtccaggctgttctcaaactcctggcctcaagcaattctcctgccttggcctcctaagttgctggggttataggcatgagccaccatgccaagcatatgttctttcattcttatttttatttattatttatttatttacttatttatttttttgacacagagtctcactgtgttgcccaggctggagtgcggtggcacaatctcggctcactacaacctctgcctcccaggttccagcgattctcatgcctcagcctcccaggtagctgggattacaggcatgcgctaccacgcctgactaattttttgtatttttagtagagacagggtttcgctatgtgggcccagctggtctgagactcctggtttcaagtgatctgcccgcctcagcctcccaaagtgctgggattacaggcatgagccaccacgcccagccaatattctcctccttaagctgagcagtggacaatggtgtttattacccgagtccacaaccctttattcattagggccacaagggtttccaaattcagaacttctgtgaatttgtaaaagtagtatagtgtatagacactggatatattgcagaacaccccaatagggtgtggggtggcaccccacaatcaattctcctcaaatgcctcaattggcatttctcctcatatgaagcaagataaataccatacatagcttcctagacaatggccaggttttgccaacaaaacttaagaaaaaacttgtagttttcagatcctgtttgattttataattacaaataaggaattaagaatcagtattatctttaatgctccttagaatatcttcaatttttttttttttgagacagagtctcactctgtcacccaggctggagtgcagtggtgcaatctcggctcactgcaacctccaccttcctggttcaagcgattcgcgtgcctcagcctccccagtagctagctggcactacaggcgcgtgccaccacgcccagctaatttttagtagaggcggggtttcaccaggttggccaggccagtttcaaagtcctgacctccagtgatccacctgcctcagcctccaaaagtgctgggattacaggcatgagccactgtgctcggccaatatttcttaatacattaagaactaaagacaagagcgatacaatcacattgtggaaaatatagaaaaatagaaagaagaaaaccactgtcaccataacccccttctccaggggccttcgatgtggtgactgggtgcatttccttctggtgctttgttatttttaaataaattttttatcttggagtaactttatatttgaataaaagttgcaaaatacagagtgttcccatatatcccccacccacttcccgctttgtccacatcttacataaccatgctacagtgtcatagcggagagattaacattggtgcatgactgttaaccaaactctaaactttatttgaatctccccagtttttccactgatgataccctttttcttttccaagatctgatccaggatagcacattgtatttagccgttcttttttgttgttgtttgtttgtttgtttgtctgtttgtttctgcccaggctggagtgcagcggtgatcctcccacctcagcttctcgactagagatgtgcactaccacgtatttttttgtagagacagggttttgccacattgcccaagctggtctcaaatccctgggctcaagtgatcctcccaccttggcctcccaaagtgttgggattataggcatgagccactgtgcccagtttatttagccttttaaatatctctttaatttttgtattactttccttttcatttttctgttttattccttttggctttctcatgtggatgtagacatattattttatttacttatttttttgttgttaagaatctgaaacattgagcatttgttaaaaaaaagaattattcggccggg

SEQ ID NO: 13773 - DNA, 5326 bp, Human
tctcaggagcttggccaagaggaaagcagcggaggaagtaaagaagtcctcttcagctcagatcgcaaaatatgacctcctcaaacccagggacactctctatggtgtctgggaatttggcatcctaaggcacagaacccgggcgttccttaccagcctcgcaggagcagttggggtccattgcaagccgaggtgagactggagttcccaagcgagaagagaagaggcagtggaacacgtggagggcgtggtggagcgcaacagttggcagctccttttctagtcaggggagggagccgggtgcagagaccctgccccacccttgcacccgacccactgagtccgagccgcccgcggtcctgggctgggctgtgcgcagcagacgggtcgggcgcaaagtaccctgagcgcaggtcggtgcacaccgcggggacggccctttcgcagcggctcccgcgggaggggctgtgcacccgggtgagctgcttgtttcaccctgccgggcctgcccagttccctgagattacctgctactcccgccctttggcgttccgcgtgccccgagatcctgacctgcgccccacaccccggggcctgcccaccccctgtcaacagctaaggctttcctggagtcccagtgcaaccccagtctcttgttcaattgtctggattggtgggagcagagagcacagcgagggagtagtgtgcaagggacatgccgaggatgcgaccttcagatctctggcattgcctgttcctgtccccgtccccacctcagttcttcggccacgtttctcctgtgcacagcaacacggaagacacaggaccctgcctccctcccatcaaagtatacttattcatatccctctatgtctctgttttgcttccaggactgactgtaatgcttggttttgttgaaagatttcaagcagtgaagagataaacatacctaggccatagagaagcttcatcactgacctctctacctagggaagctgacaggattcacaccaagcagtgccacttcccagctccctgaccctgggctagtggcttgaactcctcgtcattgtccagattaggaatacgggttcgtgaaaaggactcatgtccctttagggttgctgtgagggttcaaagacagaaagtgattaaacagggccaaacacagacccgtgtaacatagagtaataggaatatggaaggaaaaataaccagcgctcttgctttctaatttaatgcaggatcttcatatcaccttcaatgatccctcttctagggacttgccacactttccaaactgccatcctgtagtggggtacccggctaggctgtggggagaccctggagagatttatgcaaaggaggacctggacaaatgggcccattcagctcctcaagagtggagaatagaagagagaggcagatcactgtttcttccgtgttactgagcacaggagaagcgtgaccaaaggactgaggtgggaacggggacagggcggatactgccagagatgcgaagttcgcacccttggcctgccctttgcacactactcccttgctatgctccccgctttggcagatccagaaagtggagcacaagactggggttgccctcgactccaggaaaggcttagctattgactagagacctgggcgttggtgaaggtgaggggaaagccagaatactggggtaggcggaacgccaaggggcgggtgtagcaggcaacctcagggaagctgggaaggcctggcagggtgagagaagccgcacacggggggcacagcgcctccctcgcgagccggtgcgaaaggggccgtcctgcggtgtgcgcccagctgcgctcaagggaccttgcacttggcccatctcctgcgcacagcccaggccgggaccgcgggcggtgcggactcagcgggctgggtgcaagggcggggcggggcgtctgcgcccggccccgtctcctgactataaaagcagccgctggctgttgggctccactccgccttccacgtgcacccactgcctcttcccttctcgcttgggaactctagtctcgcctcgggttgcaatggaccccaactgctcctgtgccgctggtaagggacgcccgggttctgtgccttgggatgccaaattcccagacaccatagagagtgtccctgggtttgaggaggtcgtattttgctatcagaggtaaaggggactcctttattggtccagtgctttcctgttggccaagctcctgagggcattttcctcctccctgttcctctatgtcagagttgagggtcctgaggctcaaggctgtcctgctccacgtcacctggttggtcacagggctgctggctgagccccaattctctaacctgactctgagctaccggattggataggagacattggataggaggggacattgcctcttccaggttcaggacagaaagtcgaagtcttcctgggccatgtctgcagcctgggactttcctttggagtagaaataggagggtgcttggttttcccagcatgaatggagaggacatggggcttctcttcctctgctctgagtgggaaaggagctctgagggctggctctgcacagagaagggggaagtggacactcattgacccactgctgtaccttctgcatctcactcaccgttcactggctttttctcttctagcaggtgtctcctgcacctgcgccagctcctgcaagtgcaaagagtgcaaatgcacctcctgcaagaagagtgagtgcggggccatctccaggaatctggggctgtggctaaggttgggagggaacccaaggctgtccctgagtgcgtgcttctggggaaccggccttcctttgtccctgtaggttgtcactgcctgtctagtcttctgcactttccagggcttatgtgaggtggggcagctttctcaaaggaagacccattccaatgtccaccagttgtctcctgacaaaaaccatgccatcatgaactaagggtcctctggggctggagggatggagacaggcctctgttggggcagggagttctctgatcgagtctgctctgacctctcaatctcctttcctccccaggctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttgattcccgttctggttcctgttgtgtttttggaatgagggactggggtgggagattgaactgggagtttagactgggctctggatggaaatgtgagtgctgaacagtctgagcgccttcaggcaagccccgttacatcactgacctccatcttctgtaaaaggcacctgcactgtgctggatgatatggggatggggacatacgcgatcagctccactcattaaacgtggtacagagacttctccattcctcatgtttattctcaggtttccctgcccaagttcagatcctccgcggattttaggcttgaaagtgaccacaggaggtggattccaatgcctaaattacttgaatcctccacggggcttctcaaactccacggtgaagggacagttttcattttctatccatcccagacctaaacctttgtaaataaagtaatattaactatgaagataatgaaacacaaaatacagaacccatgttttacattttacacaaaaaaatcaataaatacatacagaaataacagaaaaatggaaggtttacaaactctgcacatatgttcatggatgagttgcattggagactggaaacagcagactgaccccactgtggaccacaccttcagcagcacaggccaggacattctcatgaggaaccatcaggcttggcctagccagcgtcacagacagacagcacactcaggacactcgctgaaccctgagagctccctgttgggagttggctcagaatctttggaagttcctcccaaggtcaggcttcatttgttcctctttcaaactccagcccttgactacttcaaaccagcatattcccgccaagatgtagtgtgatcgtgggttgcagatgaacttagtttggaattttgcttgtgatttcatcatctccataattaatattactttgtttacagaagttctcagaacacagctatggcagattgtgcagctggctgagtgtggtgatgttccttaggaaagaaagagtccctggatgtcttgttaatgacaagttagtccctccacttgtggagggaatgctatttgatgttcagtcaaagaggaagatgaatctccttgtgtagaagtcaggaccacacttacctgttgcttccttgtgaaatgatttcagaaggcagcctgcccctagggcatagttttaggtgtcagggagtcttatttcacagcccactccaccacttactggctgtgtggtttgggcaagtcacccacactctctgagcatctagtgcctcatttgtagaaaggagattatatctcaatgcagggattaaatgagagtgtgggccgggcatagtggctcatgcctgtaatacctgcactttgggaggcagaagtagggagactgtttgagcccaggagtttgagaccagcccgggcaacatggagaaaccccgtctctacaaaaaatacaaaaattatatggctctggtggcctgtgtctgtctgagctactctggaggctgagatgggaagattgcttaagtccaggatatagaggctgcagtcagccaagattgtgccactgcactccaggctatgcaacagaatgagactctgtctcaaaaaaaaaaaaggaaaagaaaaaaagaaaataagagagtggcctggctgctgcctaggctttaataaacaatggtgattatgatcattctctctgcactgactttcttggaaaaagataccattaaatcctaactcactcctggagaaaggctcattggtttggaagcattgctctgggtgggatgctgtgaagtggttgcatacctggctgatccagtgacaggaggagtgtggatgtcctcctgcagaaagtcctctgtgataagacgctcccccaacatttgaacactcataaaatcctttcccattcttcatgtcatttgaccttcatgtaacctgttgaatgaaggtcacaagcttcaggacagggacagaaaatattcaggg

SEQ ID NO: 13774 - DNA, 22728 bp, Human
  misc_feature (1)...(22728): n = A,T,C or G
acatagcagagctaatacaaaaggggatggtcatgaattttggggaacctaatacttaaagtctaagatttggggaaaaaatgataagctctgacctttcttctttacccattaaatactacttttaaagataccatgcttacaactccagtccttgagatgagtgatgggtgatgtcactaaatcaaggttcctactcttttttttatgtgtttcaatgattacatattgaattgaatgtattttagatttttaattcatttccctcaaactttgggtagcacattaaatgagagtagcaatactggtcggcagtttccctgcttttgcttttcccaagttactgtcagaggcatttactacttactgtacttaaaaaaaaaatcagttcagttcgggcataaccacctctaattccttgatttctaccccaacatttacccactgcttccggctggctagatcaccatcctgtaatcatcagcaccacctaccaggtgccaggcccatgatctcattcaatctttttaacagctctgagggagacattatcactctccccattctacagatgaagaaactgagagtacagagcctgcacttaaacactaagctatcgttttctataggcatccagcctacccaggactcacctcttcaaagcacttgacaacggaaagaaaaattacggcaaactctagaaggggatgcctggcgcatgaagcagagctctgaacacctaaggtgatatttaaagctgaggctggaatcgttcaacgtaggcgcctttccttggtcaaagcgcgtttattttcatacatcatggagtcaaactacaggcgcgtagagacgagtacactagggagtcaagctggcagctcacgacaaatgccctggctagactctcctgggacagctgagcaatgcccttgcaggagaaatgacatcagccactcctgtatttgtccacatgtgtattgggccttactcagggaaacatttactgaagcctgcaagcattagtgtgtcgctcccattcaccgactttccgaggtaaatattatgaactatcccattttacttaggaagcaactgaagtttaataaggttaattccattgcctggcgacgcccaatcaggggagaggattctaactcagtaatctttgactccagaatgcaactatctcttgcataccctctgcttcccaaaactctccggcctccatttctccctcttctcacgtttctaaattgcaaccgaatttggagtgaaagggagcagcagccgaggcaggagagtaggaggtggccaaagtcctctaagagcctcttcccttgcggccccgctgcccaaggctgggcgcgagtcccagggctttttcagagatccctagacctctgcgtggcggcccctccctgagagcacccggttaccgtgactgaacggcgtcctgcggctccaggcctcagccacctgctttttcaaggtttcttccgtaacagcgtccgaaaactccgccatcacctccttctttcccttttttcccacccgggctgggccgggctccgctggccgcttcccattcatctcttcccaaggcacagaaccacgccacgcagatcaagacgctaccttcctgagggtactgcaactcccggcatgtcccctttatcgtgtttcccggccctacccaatgggaagcaccaaagtaagagaaggcggaacctatacccggtttaccaatgggagctccagctattgcagccatcccaccagcaattggcccactggagctcggtctggcaggccaccgcccctctacttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaagtgcggcgcggccttggcgggcatttctctcgtgaaagctcctatagactctccgacgcgcccccggcttttcggcgcgcttcacgcctctgcacctccccgcctccaactcccgctggcggatgcgcgccttcctccctctctcaggcccctttctcatcctccagcctccagggttagagtccttttctgaaaggaaggcttgttcccatcctatgtattcggtcataatggggaaaaacggagtttgcttttaactcatcctttccccacctctccagaggtaaccgacttcaaaatgtgtgtttttttaatccttccagtgaattgtttatgctttcgcatcacgtacatggtattgctttgtgagtgttgatgtgatacgaatggtataacctagtatcatttttgcagatttcactctgacagtaaggtttcgagatctagctgtaatgcctaggtctagttttcttccttttaggtgccacttaatacttcagtttttgaatacaacacattttattcatgtgctcagggctgtctgccctgccccatgccttatgccttcgcgtcgtctgatgtctcaatgccggcatcccaggcaccacaagtaggcccctccttgggagtaaggatgctgctatggttgggctttcagactggagggaaccagaatgtttgtaccagaaaacccattgtgggctgtgttttattttcaacacctttctgtttcaacacttcaaaccattgcatttcaaggtcattctcagaagcagactcgctgtagcaggtaattggcgtttggggtgtcttaatcaagaaattgtcagtaatgctttttaaaatcgtttctgaggatttgttttcgaggcaacgcggtgcctccattttatgccaggatggaggaaagtggccagtttatgccagtcagggtacaagtgcaaggatttggtggtattgatgttttcgtaaggcagtttaggtgtttctctgtttcatattaaaataaacggacattgtctccccgtcccccaaccaaaagtgatttgaagttgaaaagatggttaacattgttttattttgcaaaacgtgttggcttggaaatttagataatggaaatgctgggtttataaaatctggaattagttgatagttgtgtgtataaaagttctcaggagtggcggctcacgactgtactcccagcaccttgggaggctgaggtgggaggatcacttgaggccaggagttggagatcagtctgggcaacataggctgtctctacaaaaatttttttaaaaattaagaaaaaatccatcaaatggtaaaggcaaatgttatcctttttaaaagtgtgaaagcacagcttctggattactttcggtggttattagaactaaaacccacagtcttttcttgttttgtcttgattactgaattaatttgcatccaaccattttgtagaattggcaaaatagttagctttcagtaagatattttaatcttcgctctattaaaattatgggttgatttacagtacatttcctctcctgtgtaaatacaaatattcagaaataataattgtgttgtgaacttaagttcacctgagttaacattaagttgaaaacaaatgccctctcccccagtatattttattttaggaaatattgcatgaatgcctactttgtaccaggcactgtgcacaatactggatatacagtggtgaggaagtaaggtgtagcccctgctttatgaagctcacagtatgatgagaacaatatgtatgtctgggctggcactctgatttcacaggtgaaaattctgacatttcatcttcacatctccttactgatatattggagctggctcttgcaacagagatgtgtaatggctatccttaattctttctaactcaggttgtcagaattaaatgttaatatatgtaaagcgttttaaaaaattgcttggcacgtcgttctatgtagcatatctgctgctgctatggatgatggttttagatttagcattggatctaccggggatgttctttaaatttttaaagcatcctggaatggtatattttaattattttagagctttttcatatgcctagaacttggcttctggaattaaagtaatttttaaagttttggcaaccttgattttttcccctttcaagaatggctgagtggggtagatacaataatgttgactattaatgtcaagggcttttggtagaatagataccttggatgggcaaatgtggcctaaattcgtactcaaaggcttcttgctgtaaggctttaattaagggcttacaacatataagtatggattttttaactatctttaaagaaaaatttgatccttattaggcaagatgaaaactgtctttaacagtttgagccatattttaaattattggtaaaggaagagagttttcgattagatatggtgggtagaagattcagatgaggagaaggaaacaataaggagactgaatagaataaatgccaaaggctagtaaataggtttagaggacaaaaagagaaagtagaagagttgctgtgaaaaggaaaggctgtggtgcaagaaaaatctgaggatagttgactgagagaaatagaaaataactggagggatgttgatgaaaaacggtggcttagttttaggaaaaagaaattagccattagcacccataattaaaactttctgattagattagtagtcagtggaatgcagggggacattaattattagccaaattggtaatgttgaaatagcagccatggtataaaaccagaggattactaatgttcagataaccatttctctaagcatttaaggatagtgttatctacacttgaaagttaaagtatggaggagcagcttgatctaatggaagctctggctttaagagtccagagagcaagattccagtctctgctgtttcattaactttagttaactgtacaaatcctgtgtctgagtacaatatatgcactttttttgtaccatggtttctttatgctaatgtctgtcatggtaaattacattcttcagttctcatgttagatgtttgtcttcggatcacaggtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactgtaagtagtgttggaaattaacagcaagacagtttttagtaggattgctgtttatgcagctctggaatacaattttagccctcggtcattcatttcaacaaacactgctgttaatgatgtctttagaaagagaaaatcatgagtaatttttctccattgcagtgctcatttattttcctaactagtaatctgtatgtttctgtatgttgttgatgttaatgattgagcttggtagaaaccccatggaatagttgagtccaagatcaatgtctagatgtcattgtagcattaccaagaacaattgatatttctttcttggtatgattagcatttcctgttcttaagatgacttaggtttttgtggataacagtttagtgttttatcatttaagctcctacatctctcaaacatttgatccgtaactatttgactagattataccaaaaagaaaagtctccaatacttagatgacgttcttgaaaaagtttcccattctttaggcctaaagaatgtgatccattcctctctgagcatttctagactccattatcatcagatagctcccagagaggagattgggatggactggtggttagcaattttgtttatgtttgtgctatgttatatattctgtttgtttaaaactagggtttatgtgatgggtacatatggacataaagttggaaaaaataaacactgtatactccaaaggtggggagggtgagggggaggcgagggttgaaatacttcctattggatgttatgttcactgtttcagtgatgggttcactagaagcctaaaccttagcattacacaatatacctatgtaacaaacttgtacatgtacccgttgaatctacaataaaataaaaataaatatatacgaagaggaaaaaaacctagggtttgtatactgttagtctggggaattgacatgaattcaagcatattctcccccttcactttgatacttgttttgattgccttattatgctgaaatatgttcttagtgacttggtagaaataacaattattgtgttatttgttatctccaaattgtattaagttgaaagctgaaattcttaacttttatacagacctggtggtgaacttaacccaggagaagatgaagttgaaggactaaaacgcttaatgacagaggtatttttctgtttaaccactttgaataccatcaacttactagttatttggcttttaatgtcttgtaaaaaggatgcttattttggaatatttagttttcaataaatacaacttaaactccagaaggttagtacaatgttgatttttttttacaagttgaagttacacttatttcaatttttaaaatgttaaactgtgtcacagcaatggtaaattaaaactgacatttaagtattactgtgctagacactgttctgagtgctttacatgcgctaattcctttaatcaccaccacaactgtaggaagtagatattattaagtttaaattacttcttgttatatagctagtgtgttgtagagccagaggtttgaatgcaggtagttttgttcaagagtaggcctctatagaattttgaaaagagaaagatgcctgtgttttcacttttttcacatattttttagactttgcccaaattattctactttttaaaaatcattgtaatgcctgcatgtaaagacttggggccaaatgcatagatactgaggattttgagattgtaaattgttttcaatgttagttttcttctttaacattcaattgccgcctgcccctgttacaaagctcatatattctctgtgcaaaaagcttggcaaacacagaaaagcaaaggagaaacaaaactaaagtcacccgtaattctcccacttttgacctattggtttgtctttctagtatttctaaaaatgtattataactcttaaacattttcctgtgcttggacttccatttatataatgtatggtacaaagatataagtccattaaggttgagggagtgcaaaatgagagaatcacaaaagcaaaatttttggaaactggaaaacagatgggcaaattataactaacttagcagaaaccttagtccagcagacaggcaggcagaatctagcattgcagagtaccagaatgactgaggaactgaaggtgctaggtacttatgaaagtgggggcatgcatgggctgaaaactggactggttcaaagtatatatggagtatatttatacaggttgtgtattccttatctgagagcttgggaccagaagtgtttagctgctatttgatagcacaacagggtgactatagtcaataatcacttaattgtaaatttaaaaataactaaaagagtataattggattgtttgtagcacaaaggataaatgcttgagggggtggatatcccattctccatgatgtgaatattacgcattgcatgcctgtatcaaaacatcttgtgtactcaaaaaaattaaaaattaaaaaagtggttaggatttgggatttttttcaggttttggaatatttgcattatacttaccagttaagcatcccatatacaaaacttgaaatgctccaatgagcatttcctttttttttttcttgagacgaagtctctctcttgtcacccaggctggagtgcaatggtgcaatcttgtctcactgtcacctccgcctcccgggtttaagcgattctccggcctcagcctcccgagtagatgggattaaaggtgcctgcctccacgcccagctaatttttgtatttttagtagagacagggtttcaccatgttgaccaggctggtctagaactcctaacctcaggtgatctgcctgtcttggccttccaaagtgctgggattacaggcatgagccaccacgcccggcctgagcatgtcctgtgagcatcatgtcagtgctcaaaaagtttgagattttggagtttcagattgggatgttcaacctgtgtatctagattgtcttccccactctgtaattaggcaaagactggctgatgattctctgtagtaattgaatcagagaacaactagcaatgaaaaaagtttaggggatggggagaataagagttcctattctgaatagtcagactcttggacctctattaggctgacagaatgttaacaattaggcttgtttttttttttttttgtttttgtttttttttttttgaggcggagtttcactcttgtcgcccaggctggagtgcagtggcgtgatctccaatgtgagcaatggttgctcactgcaacctctgcctcctgggttcaagcgattctcctgcctcagcctccagagtagctgggattacaggtgcccactaccatgcccagctaatttttatatttttagtagagatggggtttcaccgtgtcggccaggttggtctcgaactcctgacctcaggtgatctgcctgctttggcctcccaaagtgttgggattacaggtgtgagccactgtcagtctaggcttacttattttttttagagacagggtctcactctgttcctcaggctggaggatggtggtgtgatcatagctcactgtaaccacaaactcctgggctcaagcaatcttcctgcctcagcttcctgagtagctaggactgcaggtatgtgcccatgatgcctggctaattaaagaaaagttttttatagagatgagatcgtgctatgttgcccaggctggtctcaaactcctggcctgaagcagtcctcccaaagcattgggattacatgcatgagccaccaggcccagccaacaattagatttatatatcccaggctgagggttggaattcttgtttctggaaaaagtgaccagtccaagaaaaacttcagatactgccatttgggagctgtcttcgtctgtttaatgttgctataacagaatacctgaggctgggtaatttataaagaaaaagatttatttggctcaccagttctggtggcaagattgggcagctggtgagggcttcatggtgcttccactcatggcagaaagcaaaatgggagtgggcatgtgcaaagagacatggcaagggaggaagcaagagtgaatccaggaagccacactctttaacaaccctctctccagggaactaatccattcctgatggaggaagggtattaaactattcatgaaggatccacctgcatgactcaaacaccttccactaggccctgcctgccaacactgtcacattggggatcaaatttcaacatgagtttgggggcagggagacaaaccatatccaaaccaaagcaagaattttctatagaaataatgtagtcctgggccaggcgcggtggctcacacctgtaatcccagcacttggggaggccaaggcgggtggatcatgaggtctggagtttgagaccagcctgaccagcatggtgaaaccccgtctctacaaacataaacaaattagctgggcgtggtggcgggtgcctgtaatcccagctannnnnnnnnnnnnnnnnnnngcaggagaatcagttgaacccaggaggtggaggttgcagtgagccaagatcatgccactgcacgccagcctgggcaacagagcaagacttcgtctcaaaaaaaaaaaagaaaaaaaaatattgtagtcctatcactcatgcacacagaggtgacaattaagcatcttgttgcttctcccttgtgagtacacaaccaactatcaccaggcttttggagaaaacttcttaacaagaaaaagatcaaaagaagcaaaaggacctcaacagaagcagaaaattcaaccattgacaaaactatgattaatattcttggtgagatgagaggagattttgcacctgtgaaacagtgctattaaaaagacattttagccaagaaaaacctcatggatattaaaaaaatgttggaagaaatgaaaaattcagtaaagagttaagaggttcattctaccagaaaatagaatgaaaagataaaaagatagaatgtaggtaagaatagataaaattagtgggtcattctagaaggaccaatataaactatagataaatagaacagagtaaaaggaagaattagcaaagcataattagagaaaatttctcaaacctcaaagggcatgagttttgagattgagaagacctactggccttgcctctatagtgaatgtttaaagatccacgcaaaggcatatcatcatgacgttttagatcctacaaacgaaaataaaaacaaaaagatgtaaaagcttccaaagtgggaggtggaggattggtaagcagagaggttaaatgcaaaacatcaaaatcagaaattgcattaaactacccagaaataattctggaagctaagggatggtggagtgttgtctttgtaattttgagagaatataatctctgtcctagaattttctaatcaaactataaatcaagtgtgtgggtaaaagttacttctagacatgcagagtttcaaaaagttacatctcttgtaccttttctcaggaagctactagagggtgttcacccccaaaatggaataaaataaggactccagctgtgaagcagggttgagactatcaagtacagattacagcaggatgatagaaaaacgtgtcttaggctgggtgtggtggctcatgcctgcaatttcagcactttgggaggctgagatgggcagatcacgtgagcctaggagtttgagaccacccttggcaacatggtgaaaaattagcctggtgctgtggcttgcatctgtagtcccagctactcgggaggctgggggcaggggaggctgaggtgagagaagcgcttgaacccatgaggtggaggttgcagtgagtggagatcgcgccattgcgctccagcctgggtgacagatcttgtcttgaaaaaaggaaaaacatgtcttagaaaagatgaaattaatagaataactgacaattgatatttgaattgggaagaaatttaagttatcatggagaatgtgggaaatgaatttagtgatagcaaaggaaatgaaagttattaactaaagaataggacagttgaacaagtaaggagatacggtttgctaatcattgctctgttgtgactgatctaccggatcatactaacttaaatactgaatattgacttaaccaaatattgataatgggaagatggtggaagaaaaagtgtaactaggatgtgtgattttaatatctaaattctcattcatagtagagggttataggcttttaaaaaatgtttttaaaatgaaaatcaagaggccaggcgcagtggctcacgccagtaatcccagcactttgggaggccgaggcaggtggatcacaaggtcaaaagatcgagaccatcctggccaacatggtgaaaccctgtctctactaaaaatacaaaaaagctgggtgtggtggcgggcacctgtggtcccagctactcgggaggctgaggcaggggagtcgcttggacctgggtggtggaggttgcagtgagccaagattgcggcactgcactccagcctgggcaacagagcgagactctgtctcaaaaaaataaaataaaataaaatgaaaatcaagaaactgtcataaaagaatattttggctgggcatggtggctcacacctgtaatcccagtgctttgtggggctgaggccggaagattgcttgaggccaggagttgtagtgagccatgattgcgtcgctgtgctccagcctgagtgacagagcaagaccctatctcttaaaaaatgtagttttgaggcccggtgcagtggctcatgcctgtaagcccagcactttgggagagtgaggtgggcagatcatctgaggtcaggagttcgagaccagcctgaccaacagggtgaaaccccatctctactaaaaagacaaaaaattagctgggcatggtagcatgtgcctgtaatcccacctactccggaggctgagacaggagaatcacttgaacctgggaggtggaggttgcagtgagccgatattgcgccattgcactccagcctgggcaatgagcaaaactccgtctcaaaaaaaaattttttttttgaaaaatatgactttacattgaagaaacgtgataaacagtacctcagcccattagtgataagccatattgatatagcatgtacctttgatatgacgtgatgagaatggcccttttacctctgtagttttcttcccaaaagctcataacttcaatttaattgagggatgttttacaaaatacttgaccagtattcctcaaagctatcaagatcatcaaacacaaggaaggtatgaaaagctgtcacaatgtagaggaacctcggaagaaatgaagattaagtgtaatatggtatcttagatgggatcctgggactgaaaaatgaaaaaggacattaggttaaagactatggatatctgaataatatatggacttcagttaataatcttgtcttggtattggttgattagtttgacaaatgtgctttactagtgtgagatgttaacagtcggggaaactgtgtggggtatatgagaagtctctgaacaagttttgcaagttttctgtaaatctaaaactatcctaaaataaaccgtttatttaagaccaagaagaatgcttttaaaaatagaagaaaacatgaggggaaaaacaaccaagagttgaaagttacagccagtgggaatgggtgaagcaggacagagaactgcagtttctcaccatgaacattgtagaactatttttggccacttaaaatatgtagagtatgactttggttaaaataagtttagtgttctgctatacaaattaataaaaatgaaagctgaattttgaacacaatttttatgttgatactagcttgccagttttgaactaatattgtatgtcttgggcagagtgacatctatattaacaaatcatagaaaatctgtatggaaggcatattatccctatgtttcaattaggagcactgctaagaattttctgttcactgaagaaggggatttgtgagtacatatatttagttgtttactggcttatttctttttgacagatactgggtcgtcaggatggagttttgcaagactgggtcattgacgattgcattggtaactggtggagaccaaattttgaacctcctcaggtcagtgttcagttacatttgctgggcattttggaagcagaaagctcgtttaattctagccactttaaaaaagattaaagtagaatttgacttgaaattttcttttcttccctccttaatttaaattacaaaattaagccaagcacttcttattttaaaggaaaatgtaaaacaaatacaaggccgggcgaggtggctcatgcctgtaatcccagcacttcaggaggccgaggcgggtggatcacctgttgaggtcaggagtttgagaccagcctggccaacatggtgaaagctcgtctctactaaaaaatgtaaaaatcagctgggtttgatggtacaagcctgtaatcccagctactccggaggctgaggcaggagaattgcttgaacctgggaggcagaagttgcagtgaaccgagattgtgccattgcactccagcctggacaacagtgagactccttctcaaaaaataaataaataaatagaacaaatacaaaagaagagagaatggtaaaagtgaatgaattgcgctacccgtcgtctgcctttaacagttagcacatcacaacccctcattccaccgcttcattctcctaccctcatcttggattattttgaagtgtatcctagctattcatttcaattgtaaatatttcagtgtgnnnnnnnnnnnnnnnnnnnnnnnnnnnnnnnnnnnnnnnnnnnnnnnnnnnnnnnnnnnnnnnnnnnnnnnnnnnnnnaattgtaaatatttcagtgtgaatcataaaaataaggatctctttaaaaagataactatagtactgttattatcatactaaaaataaacaattccatattattgtcaaatatatagtcactgttcgcgtatcctgattatttctattttctttttataatttgtttggattaggatagtctctaaagtctcttttacacacttggcaccttttttttttccttgtgttttatttgttaatgaaaacaggctaatgtttccatttcgattgcattcccctgttgttgttgaatatgtagctgtttcccctgtgtgtcttgcaaattgatagttagatctagaaattgtattcaggctcagttaatttggggaggggtaacaaggcttgtcataggcggtatataatctatacctgcataacaaattacctcaaaatttagcagcctttaggcctctgggagttgcttagggtggttctggcttaggctctgtcatgaagttacagtcaagttgtcagctgggactgcatcataaggtggaactggggttaaagtatctgatcccgagcttacacgtgtgtgtgttagcaaacttcttagtttcatctgggctgttagactaaagctttgcttcaggtgttgctggctgttgtctcaaggtctccctcagttccttgccatgagaacatctctaaaaggacaactctcaggcagctggcttacccaaggctgtgtgatccaagagatagtgagagacagagtgctagaggagtgcccaagtaggaagcctcagtctgtgataacctaatcttggcagtggcataccatcacttctgctgtgtgctattggtcacacaagccaaccctggtacgctataggagggactacacaaagcagtgaataccaggagacaggaatcattgggggtcatcttaaggcagtctatcacaattggtatagtgtacttccatcaggaatttaaaaatatttggttgtttcttgttgtaatgttagcagctcattgatgatcatttcctggtctatgaattcataagggttgtgatcctcatataaaaagaaacttatgtattactgaagtgtgtggtttgtgtagaaaaaaaaaatatgctgctattcctttacttaacatttttcagaagaatgacttaattccttagcatcctctaaagacttgactttattcaaaagagagggtaagaccaagacttgggtacaggcagtttgagaggtgattccaggaagcagcagaatacaggggagagagagaccagaagcagcagaagtaagacagggcatgttattgatctttttacacctgtgggcaactggatttgttctgttaaggaccaggaaccatgtagggactcctataccccattggataagggttgcatgaactcccttgcatttccatgttgagtcttgagtgcttgttgagacagtggcagcaaacagggaaccctctgatacttttcaaacatagctgccccgaaatcggaggtagcgtaatgtggggcacacacacacaaaaagcatgtttcagtgacctttaaagtgtcagtatgaccttttggatttaaataatttgaaatattttaatccatgataatgagtgatgatgttactgatgctcaaatattcctatttttgctaatggtggaacttcttaaagttggatcctgaattctttaggcaaattaaaaagccctatgactttatagctcctttacatgacaagatgtttcaggtcaagcattgcacaaaatatcaaccaagcaaaagatcgttcttttctcttgcttctgactcccttgtatggcagagggacaagaagataggggctgtggaagctgatgctggtgttcactacctaagaattgccaggaacacatcttggctttaaggaagaacaatttcatatggaaacagtgaagttacttgttcaaagatacatagtacagttattctaaacttttttttggcttcctgaacatgccttgatctaattggaaaatgcttagtagtgaccccagtggttttccagataacttttctgaatatcttcactcatctcccctaccactgtcctaggacagttctcttcattcagtaaggcctagagttggccctggtggtatttgacataaggtaagtgtattgatttatttaggaagcctagagtattagttagatgtcagtggaaaaggagcatatcatcttcctatctcagtctttttgtataaagtacagtcaacttaaacattaagaccagagaagaaaggcttaaaaaaataggaacatgtagccttgagcagaagaaatttggggaaatgctactcattttgtttgatcatggtttgggaacttttattgtatgtgatccacagatctcttagcttgtgctattcaggccactttctctgtgactgttaatgtatctggttttcatgacagtttaaggaacctccaaagcctgggacaattgcctcaattcattgtaccctagggatggctctgatatataattattctaactggaatactggttaggtgccaatgagtaacacagtgggaaataacataggcttttataattagataagagttgaatagatacagttaaatcttggcttcacaacttggctgagtaatcttgggaaagatacttagcctctcttagcatgtgattctgtgtaaattgaggatgatgctaatacctccttttggcagcttctgcttttatctcactttccccttatatctgttttcagcaattttaaattccccagctctcagatacaactccaacagcaaaagtagatttctgaatgtattgtggagagatttatacaagaattgtataacccttagactttttttttgttctgtgtcagaatttttccttcccgggtagcaacttccctctctaattctcttcatccctttaaattctctaaaatatacatatatattatatatatatttttatatttgtttcctcgagtaatttggctttgcccatctggcaaaacttcacttagactgctcttctggtattcctgaagcatgcaccttggcatacggggaggtttgaggttggggctggaaggaggagcaagaagcatcttgtcaaatgcctcacagcttatatttgaatttttaatgtaaacaggtctacaacaggattctagactgtttaacttactgatcatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgcccagcctatatatatatttttaaaaaaccagcttttaggctgggcatggtggctgatgcctgtaatcccagcactttgggaggccagagcaggtggatcacctgaggtcgggagttcaagactagcctggagaaaccctgcctctactaaaaatacaaaattagccaggcatggtggcgcatgcctgtaatctcagctactcaggaggctgaggcaggagaatcacttgaacctgggaggcagaggttgtggtgagccgagattgcgccattgcactccagcctaaggcaacaagagcaaaactctgtcttaaaaaacaaacaaacaaaaaaaagcttttattaaagatactaattaaaatcggacttcattatgttttaagtatctcaagctataaatcctgtgactacatattttatctcgaatggttgactggtttactgcttgttattttatatgcattaaagcatttatttactagtgtatctgttagataagtcctggtaaagaggacagaaagtagtatgcttctcccaacagtttatactatactggggagtaaacatgtaaagaaatgaagccatggaatacatattaaagttgtattcatttgtaatttcagtatccatatattcctgcacatattacaaagcctaaggaacataagaagttgtttctggttcagcttcaagaaaaaggtaagttattttgttttcaaaggtagccatctaaaaattctgtagaataatttcaaggatacctctatttgtgttttctcaaagttccttgaacttttgggtttattgtaaaactaaagatgtataccatgcttttagtttcaaatctgtggctaggaaatctaccttgaaagacacaaccaaaatgtattaatgagaattatcttttttcttacactttttattaaatgtaaaattggtaatttaaaaatgaaatggaagcagtgattatataataacttataataatgaattctgttttattttagccttgtttgcagtccctaaaaattacaagctggtagctgcaccattgtttgaattgtatgacaatgcaccaggatatggacccatcatttctagtctccctcagctgttgaggcaggtacagaaagttgaacattttttggttcatccatattaactgtcaaatttaaaatattctgagccacttgggaaggtatagttcatgaattttggtctttaaggaaactaagaaagtagatagactcttagatcatgtgcaagccatagattaattgtgactaataccatccccagactcttaagtttcggcatgacattctggtatttgtgcaactgctcttccctaattctgatattctcaagagttaaggttgatgtctttattcaaaaaagagatggttaaatagcagtcaacagtgtgtaaatatgagcggagttgtctgtattaaaatgtggcaaattggctggatgtagtggctcatgcctgtaatcccagcactttgggaggctgaggcgggggtgtatcaccaggtcaggagttcgagaccagtctggccaagatggtgaaaccccatctctactaaaaatacaaaaattagtgaggcgtggtggccagcgcttttaatcccagctacttgggaggctgaggcagagaattgcttgaacccgggaggcagaggttgcaatgaactgagatcacgctactgcactccagcctgggcgacagagtgagactccatctaaaaaaaagaaaaaaaaggtggcaaatcgaatatcttggtgtaatatattcgttttccttttttgaaacttactatattttggcccaaattgaggcttgtgggattaggtcctgaacttttacgtggggtttgaatctttaggcagttagagtgataagaaatgcagttttttaaaagttgacttgtactggttgaggtctctattagagccagccatatataggaattgcagaataacatggtggttatgaaagtagattctgcagtcagtgttttggatttgaagcccaacctcagtacttgctggcagtgtgaccttgaacaaactattatacctatttgactgtttcttcttctgtaaatggggatagtagtctctacttcagaggattatgaggaccaagtgaaataatgcatataaaatgcttacaacagtgccagtaatctggtacatacttaataaatgttagtgaaattggccttttgtgaaagcttattgagtatgaaattgctctttctacttcgtcactaatcaaaccttatcttttgccactccactttggcctcctgataggttacaagttgaaatgcatatggggggaaaagagtcatattatttattcaaacacctacttgtcaagtgcaggaactgtgctgagtagtcagagtataaggacatgtagaaacttttcctgccttaaagaacttattagtggataattaatcaaatttatagtcttaattttttttattataagtattcaacaagtgtttttagtgtgtaagatgtgaccagtgagggaaaattggtgtagaaaatgccaaacgtggtaaaaaggcattcgaaggggaaaaaaagaaaatgccagacatgctaagggagggcagaaacatccagataaatttatttatctaatatggaaagtagtatgtactgtctttaataaaggtattgttctttttaaaattcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtgccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttgg

SEQ ID NO: 13775 - DNA, 14207 bp, Human
cagattccagagaatgagctggcttggagccctgctgagtcaatgcccttctccttgccagtgctctgagccaacctgccccgagttcttcctggcaggctggttttctgtgccagcctccccttcctgacagggtataggggaatgggtagggaagaggcagaggagatcggtgcaagtttgaatgaacacttagccctgtggaatgaatgtggtccagccctttagcctcactcagtacttcctttgtcccaactctatccctaccccaggctcagaatgttggggtatctccacctgcctgagaacttcaaacatacaggggctgggcttagagggcagcagcaccttcgttcagtgcatgagtgaatgaatgaatgagggagagaaagaggaaggtcttccatgtctgaaacttttttttttttttttgacacacagtctcactctgtcacccaggctggagtgctgtggtgcaatctcagctcactgcaacctccgtctcctgagttcaagcgattctcctgacacagtctcccgagtagctgtaagcacgtgccaccacacccggctaattttttatttttagtagagacgaggtttcaccatgttggccaggctgatctcgaacccctgacctcaggtgatccgcccccccccccctcccaccacccggcctcccaaagtgctgggattacaggcgtgagccaccgcgcctggccacagacttttattttatttcttttttagagacaggatctcactctgttgcccaggctggagtgcagtggcaccattgtggctcactgcagcctctacctcctgggctcaagtgagcctcccacctcaggctcccaagtagctgcgaccacagtcatgggcgaccgccctggttcctcccttccttgtgtctcctctttctgttctctaagttcctgctttattataggcaaagctcaggacattaaagaccctggcggtagagggtaggctatgggggtgaggccctgatccaagtcctgccgctaaggcactcataatttcgggctcaggggagaaatggaagtcaaagaatctcataaacacagctgcgatgacgaaccctttcacgggaaggaacatgcgagcccagaaaagtctctcctggtcttgggatggaggtcacacgaagcctccgcaaggcaaggacttttggtgagttccgggctccgctgaactcagctctttttcttttccttcctttctttccttcttcctttctttccctccttccttccttcctctttctctctttcctttctctctctcttttctctctctctctccttcttccctccctccctacctctctctcttttctttttccgtccttccttccttctttccttctttctctctcttttctttcttttcttttcttttctcttctttcattttgagacgtactctggctctgtcgcccaggctggagcgcaatggcgccatctcggcgcactgcaacctccacctcccgggttcaagcgattctactgcctcagcctcccgagtagctgggactacaggcgcgcactaccaagcccggctaatttttttttgtatttttagtagagactgggtttcacgatgttggccgggctggtctggaagtcttgacctcaagcgtgcgccctctccgccactgggtaaggcgggggcggaatagggggcttgcaatttcacactagaggcgggcaccgtgggggaaagaagagtcacgtctcccacggttcgtagaggaaggcctgcctgagcctggagcgggggcgggagagccacagtttggcatccccagggcatcccccagcccgcagactaccaggcctccagaggacaggaccccacccccggccacaggccctgcccccagcactccccgcaccccgcctccaagactcctccgcccactccgcacccaacttataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcaggtacgtgtccccagggctggttctccgcgcccctagtggctctcctggcttggaagggtatggacaggagtggggcgtgggggcggggtgcgcaactgtggctccctgggcttccctgcgtcaagggatgggctccccccttaggaagccgaggagggaggttcgctcaaggccaggaattcaagaccacctaaagcaaaatagcgagacccccgtctcttctacacacacacacacacacacacaaaataaataaaataaaataaaataaatataaaattaaaaaacgaccgggcgcagtggctcacggagcctccacctgctgtcgagactagcctggccaacatggagaaacctcgtctctactaaaaatacaaaaaattagcctggcatggtgtgcatgcctgtaatcccagctacttgggaggctgaggcaggagaatctcttgaacccgggaggcagaggttgcagtgagccgagatcgcagcactgcactccagcctgggcaacagagtgagactcctcaaaaaaataatagcgataaaataaaaataaagccaggtgcggtgactcacgcttgtagtcccagcactttgggagggcgaggccagtggatcacctgaggtcaggagttcaagaccagcctgaccaacacagtgaaaccccgtctctactaaaaatacaaaaattagctgggtgtggtggtgggcgcctgtaatcccagctactggggaggctgaggcaggagaacctcttgaacccgggaggcggaggttgcagtgagccgggatcatgccattgcactccagcctgggcgacagagctcgactccatctcaaaataataataataataaataaaataaaatacaaatacaaaaattagccaggtgtggtggcagctacttgggaggctgagacacaagaatcacttgagtctgggaggcagaggttgcagtgagccaagattgcgccactgcactccaacctgggtgacagagcgagactctgtctgaaaaaataaaaaataagccaggcatagagctgcatgactgtagtcccagctacacaggaggctgaaaacaggaggatcgcctgaccccaggagttggaggctgcagtgagctgtgacagcaccactgcactccagcctgggcgagagaacgagaccccgtcattgggaaaaaaaagaaaaaagaaagactcccttgcctggcctcagcggatggagatttggaaggatggatgagtggatgaattaagaggttggggtaggcaagctgggtcctcaccaaggttttcacccctccccagacacaactcaaggctcagaacagcaggatccagcaactcttccacaaggtggcccagcagcagcggcacctggagaagcagcacctgcgaattcagcatctgcaaagccaggtaaccctaggatcaagggagaaaaggtccctctgatagctggaccccaggttgagagggaggtggtgagaactggacgtgtggctggggacgtggggccaggcaggacctgacaccctcctcccgtcccatcctagtttggcctcctggaccacaagcacctagaccatgaggtggccaagcctgcccgaagaaagaggctgcccgagatggcccagccagttgacccggctcacaatgtcagccgcctgcaccgtgagtgtctgcccctcgatgctctccggtggccacccctaccccgccacttgccattgctggtcctctccttgtcaggtccaccttaaggagaagatgtcctggcctggagcccctgagggctcaccagtctctgggtcaaagctgatgggagcacctccttcctcagccctgacctggcccagccaggccacccaacccttctcctctgcaagccagtgggctgtccctgaagccctgctgatcactgattggaacagaggtggagaaagaggtcttgagggacttgagctgcaggggtgctggagaaggtagaaatggggttcggggtgccatcctgaaggttagaaccttctaggggagggtgtcatggaggaaggggtgccaggtagtagtgtttgtagatttgggccctccacaatgtcttggggtatgtgggaattagggctgggaacccccagctcccagaccagaaacactcttgtatcttacaaatccaatgctccaggtccctgacccctcttcctccttcctctcttgttctcctcctccctccccgcccccgccggccccctccccaccgcagaaagtgggcttttgctgccaccacaagttgtaggtgctttattcccaaatctccgttcatctcgaaccacagcatgtccacgtgtgtccgatgcagactcgcggttctctaagttcacggccccacacggtttctctgtggtcctcatccttccctgcatctgtggctgtccacagccaactgggtgaaagtttggatccccctctcacaccctagggtcagtggcaggcttccagcactgtagacctgagggttctctcctccccaagctcccgctccttcccacctccgtgctgcccgcccccaaccccgccaggctagcatctcagcgtggtcagggtcctgtccaccctcccaaagccaccatcccaggatgaggggcttctggagggtgacgggggaaggcacaagtcctggctgggaaatgcggtggaagggggcaggggttctgtgggttcgggactcccagactcttggctcaggcccgccaagtaggagaaagttcagagctgggaaggcgaacagctggcattcatggaagccacactggtggtttggccgcgtgcccatccttactggatgggaggaaagtaggggaaaggggagatgcctgaggggccggaaagcgtcttcctggtcactctgggcccgcccccacccccaccgtgcagactcatttcgacctttcccctacttttccggctgggctgggggcggttcctcccagtctggagcgtctgagcctccagacgtgctcaacgccatcctcccctcctccctccctctttctttcctcaaccctgcctcctctccctctaggagctgggaccccaggcagagcctctgagatgctcctgctcagcacagttcttcccgttctggacctgctgcctcattcattcattcattcattcatttgtcaagactgttttgtttgctttttgagacggagtctcgctctgttgtccaggctggagtgcagtggcgcaatctcagctcactgcaacctctgcctcccactgggttcaagtgattctcctgcctcagcctctcaagtagatgggattataggcgcctaccgccaccacgcccagctaatttttattcatttatcaagtcttttttttttttgagacagagtctcactctgtcacccaggttggagtgcaatggttcaacctcagctgactgcaacctctgcctcccgggttcaagtgattctcctgcctctgcctcctaaggagctgggattactggcgtccaccatcacacccagctaatctttgtatgttttactagagatggggtttggccatgttgaccaggctggtctcaaactcctgaccgatccgcccgcctcccaaagtgctggattacaggcatgaaccactgcgcccggcccattcctcaagtctttattgagcagctgctatgcgctggggcctgcgtggatgctggtgccaggctgtgggcagagctgctccttgtccccagcctcatggagcctccattgagtcagaggagagaccattagatgacctcagtgtccaggagtgggaagtccttgctcaattcccatttggggtgttctggcctggtctgggggtgaggcaaggcagggtgtccttccagaagctgggacccagagagagaagtgaggaaagagagtcccgccgggcgcagtggttcacacctgtaatcccagcactttgggaggccaaggctggcggatcacgaggtcaggagatcgagaccagtctggccaacatggtgaaacccccgtctctacaaataatgcaaaaactagtcgggcgtggtggcacatgcctgtagtcccagctgctccggaggctgcggcagaattgcttgaacctgggaggcggaggttgcagtgagccaagattgcgccactgcactccagcctggcgacagagcgagactccgtatcaaaaaacaaaacaaaaaaagagagtcccaggcagggggaacagcatgtgcaaagtccctgtggcaggacggtgtgtggtacaagggtgggaagaaagcctgtgtgccagagagggtgtgggtacagcatggcaggaggaggatgggcacgggggctggtcctccaggtgccttgtggaccatgctgaggaaggacatagggagccatggaagaggttaggcagatggcagagaggtggtcatgagataagatttgccttttacttccctggtcatccactgttaagcccccagatatgcctggctcctgagaccccccccaggggctgccctcctgtttcaagtctccactttatctcccttcagggctgcccagggattgccaggagctgttccaggttggggagaggcagagtggactatttgaaatccagcctcaggggtctccgccatttttggtgaactgcaagatgacctcaggtagggtgtgttagtccaccaggggcccctctccccataggccctgttgtctttctttaaattgaaaacaaaacaaaacaaaaaaattaaaggcagggtcttgctatgttgcccaagctggtctttttttttttttttttttttgagatggagttttgctcttggagctggagtgcaatgccacgatctcagctcactgaaacctccgcctcccgggttcaagcaattctccagcgtcagcctccccagtagctgagactacaggtgcgagcaaccacacccagctaatttttgtatttttagtagagactgggtttcaccatgttggtctggctggtctcaaactcctgacctcaaatgatttgccgactttggcctcccaaaatgctgggattataggcattagccactgctcctggcctcttttctttaaaatgcagcccttgtctgggtgtagtggctcatatctgtaatcccgacactttgggaggcctatcatgaggatcacttgagcccagaagttcgagaccagcctggacaacatagtgagagctcatctttacaaaaaattttgtaaaagtaaaaaaaaaggccaagtgcagtggctcacacctgtaatcccagcactttgggaggttgaggcagacagatcacgaggtcaggagttcgagaccagcctgaccaacatggtgaaaccccgtctctactaaaaatacaaaaattagccgggcatggtggtgtgcacctgtaatcccagctactcaggtggctgaggcaggagaatctcttgaacctgggaggcggaggttgcagtgagctgagatgacgccaccgcactccagcctgggcgacagagcgagactccgtccccccatcaaaaaaataaaaaagagaaaataaaataaaataaaataaaattcagcccttgctgggcatggtggcacatgcctgtagtcccagctactcgggaggccaaggcaggagggtcacttcagcccaggagttaaaggctgccgtgagccgtgatcacacctgtgaatagccaccgcactccaacctgggcaacacaacaaaacctcgtttctaaaaaaaaacaaaggctgagcacggtggcttacacctgaaatgccagcactttgggaggctgaggcgggcaaatcacttgaggtcagaagttcaagaccagcctggccaacatggtgaaaccctatctctaccaacataaacattagccgggcgtgcctgtgattccagctgcttgtggggctgaagcacaagaatcgcttgagccccgaaggcagaggttgcagtgagctgagattgcggcactgcgatccagcctgggcaacagagtgagactccatctctaaaaaaaaaaaaaaaaaaaaaagaaagcttttttttccactgagaagtcctttccattacaagaggttacaacacggggttttacccagttcagctggcccagagaggctttgcagatttccactgcctactccctcccacactcagtccctgctgggttcttgggacaaagatcttcccaaggccagcccataatattcctccctctgacccaccctcctcgagtcctccagggatgagtgagggagctgctgtcttcctgggtttggagggggtttggtgcttggcagccagatgagggagtggggtcgtctgtgaagagggacttcctggtgaccttgtacctttctgggcagatggaggctggacagtaattcagaggcgccacgatggctcagtggacttcaaccggccctgggaagcctacaaggcggggtttggggatccccacggtaggtgtttctagtggggacagaggcaggggaggaagagggaccctcagaagtggccctgcctcatggagtggcctctcccactccaggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggtgagcaggccctgccatgccacacccagccagcagcttccctccttatctttctgctgctctgtcctgccttcaaccccacattgcatctgtttcctgcccccacctcttccttacatgccgtgtgtgtgattgggccactaacttagcctatctggcctcagttttcccatcctgaaaagggtcttgaccgtctttacttttatttacttatgtgtttgtttatttatttatttatgtatttattttttgagacggagtctcactttgtcacccaggctggagtgctttgtggcacgatcttggctcactgcaagctccacctcctgagttcacaccattctcctgcctcagcctcccgagtagctgggactataggtgcccaccaccacgcctggctaatttttttgtatttttagtagagatggggtttcaccgtgttagccaggatggtctcgatctcctgacctcgtgatctgcctgcctcagcctcccaaagtgctgggattacaggcgtgagccaccgcgcccggcctacttatttattttttgagacagagtcccgctgtgtctcccaggctggagtgcaagtgacgtgatcttggctcactgcagcctccgcctcctgggttcaagtgattctcctgcctcagcctcctgagtagctgggattacaggttcccgccaccatgcacagataattgttttgtatttttagtagagacggggtttcaccatgttggccagggtggtcttgaactcctgacctcaagtgatctgcccacctcggcctcccaaagtgttgggattacaggcgtgagccacaatacccggccacaaacatctttataatggtgctccacaggattctttttttttttttttttttgaaacagggtctcactctgttgcctaagctggagtgcagtggtgcgatctcggctcactgcaacctccacctcccgggttcaagcaattctcaaaaaaaaaaaaaaattaggcacggtggctcacacttgcaatcccagcactttgggaggctgaagcgagtggatcacttgagcccaggagaccaatctgagcaacagggcgaaatcctgtctcaattaaaaatacaaaaaactagctgggcatggtggtgcctgcctgtgttcccatctacttgggaggctgagttgggaggatctcttgagcctaggagataaggctgcagtgagctgagactgcgccactgcactcaagcctgggtgacagagtgagacccctgcctcaaaagaaaaagaaaaaatgcaggcatggtggctcacacctgtggtcccagctacttgggaggcccaggtacaagaatcacttgagcccgtaaggttgacgctgcattgagccatcaccacaccactgcactccagcctgggcaatggagccaggccctgtctcaaaaaaaattgtttttaaacttaaaaataaggccgggtgtgggggctcacacctgtaatcccagcactttgggaggccgaggtgggtggatcacctgaggtcaggagttcaaaactagcctggccaacatggtgaaaccctgtctctactaaaaatacaaaaattaggccaggcgcagtgggtcatacctgtaatcccagcactttgggaggctgaggagggtggatcacatgaggtaaggagtttgagaccaacctggccaacatggtgaaaccccctcactactaaaaatacaaaaactagccaggcgtggtggcgggtgcctgtaatcccggctactcaggaggctgaggcatgagaatcccttgaacctgggaggcagaggtgcagtgagccgagattgtgccactgcactccagcctgggagatagagtgagactcagtctcaaaaaaaaagaccaaaaattagccaggtgtggtggcaggcgcctgtaatcccagctactcgggaggctgagggaggagaatcacttaaacctgagagacggaggttgcagtgagctgagatcgcaccactgcactccagcctgggtgacagagtaagactcaatctcaaaaaaaaaaaagtcaagtccaaagcccagcctggtccccaacctgcctcatcctcaaccctatccctatctcctttcagccccatcggtggctcaaagacctgaccatgttccctctcccctgaccccggcaggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacactttgttctttgttcttgtttgttttctttcttttttttctctttctttagttcacagatctagtaagttaccctcagtttgttttaaaaagtgaacaaagtccatgtaaacatgttcccagggccaggcacggtgtctcgtgcctgtaatcccagccatttgtgaggccgagacaggcaggtcacttgaggtcagcagttcgagaccagccgggccaacatggtggaacccccatctctacaaaaaaatacaaaaattagccgagcatggtggtgcacgtctgtagtcccagctactctagaggctgacgcagaagaatcacttgagccaaggaggcagaggctgcaaataagccgagattgcgccactgcactccagcctgggcaacagagcaagactccatctcaaaacaaaaataatttttttttcgtagaggcagggtctcactctattgtccaggctggtctcaaacaccgagactcaagggatcctcctgccttggcttcacaaagtgatgggattaaaggtgtgagcgccactgcacccacccctgaaggctctaattctacatctgtgttttgttaaaaaaaaaaaaaaaagatggcgtggtcgctcatgcctgtaatcccagcactttaggaggccgaggcaggtggatcatctgacattacgagttccaggcccgcctgaccaacatggtgaaaccccgtctctactaaaaatacaaaaattagccgggtgtggtggcgggtgcctgtaatcccagctactcaggaggctgaggcaggagaatcacttgaactcgggaggtggaggttgcggtgagcagagatcatgccactgcactccagcctgggtgacagagcaagacttgatttcaaaaaaaaaaaaaaaaaaaaaaaagaatagggctgggcgcattggctcacacttgtaacactagcactttgggaggccaacgagcggatcacccgaggtcgggtgatcccgctgtattgctctatatagtgagatccctatatagggtctcactctattgtccaggctggtctggcctggccaatgtggtgaaacctcatttctactaaaaatacaaaaattagctgggcatagtgatgcgcacctataatcccagctactcaggaggctgaggccggagaattgcttgaacccaggaggtggaggttgcagtgagccgagatggcgctgagaggtgacagcgtgctggcagtcctcacagccctcgctcactctctgcgactcctctgcctgggctcccactgtggcggcacttcaggagcccttcagcccaccgctgcactgtgggagcccctttctgggctggccaaggccggagctggctccctcagcttgcagggaagtgtggagggagaggcgcgagccggaatcggggctgcgcgcggtgcttgtgggccagctggagttccgggtgggcgtgggcttggcggaccctgcactcagagcagccgtccggccctgctggccccgggcaatgaggggcttagcacccgggccggacagcggctgcggagggtgtactgggtcccccagcagtgccagcgcaccggcgctgcgcttgatttctcaccaggccttagctgccttcccgcggggcagggatcgggacctgcagcccgccatgcctgagcctcccaccccctccatgggctcctgtgcggcccgcgcctccctgacgagcactgccccatgctccatggtgcccagtcccatccaccacccaagggctgaggagtgcaggcgcacggcgtgggactggcaggcagctccacctgcagccccggtgcaggatccactgggtgaagctagctgggctcctgagtctggtggggacgtggagaacctttgtctagctcagggattgtaaatacaccaatcatcaccctatgtctagctcagggtttgtgaatgcaccaatgaacactctgtatctagctactctggtggggccttggagaaccttt

SEQ ID NO: 13776 - DNA, 17198 bp, Human
caggaaagcaaggcttttttttttttgagacagggtcttgctctgttacccaagctggagtgcagtggggtgatcatggctcactgcagcctcgatttcccaggctcgaatgatcctcccgccttggcctcccaagtatctgggaccctggcatgatgcaccacatctggctaatttttgttgttgttcttttcttttttttccttttctcttttttttcctttttttctttttttttttttttttttgagagactgggttttgacatgttgcctaggctggtctctagctcctggcctcaagtgatcctcccacctcagcctcctcaaagggcatgtttttaggcataagccaccgcagccagccaaaacaaacaaacaaaaagtaacgtatactttgtgttaataattttgcatagtatattgaaaatttgccaagaaagtacattttagatactctcactacacacacagttaattatggaaggcaatggataggttaattgcttaactctcataattggccatgtgtggtgaaaatgcctgtaatcccagcactttgggaggccaaggtgggcgaatcacctgaggtcaggagttcgagatcagcctgaccaacatggagaaaccccgtctctactaaaaatacaaaaaaattagccaagcatggtggtgcatgcctgtaatcccagctattcgggaggctgaggcatgagaatcgcttgaacccgggaggcagaggctgcagtgagccgagagcacaccattgcacttcagcctgggcaacgacagcaaaactccgtctcaaaaaaaaaaaaaaaaactgtcataattattatttcactgggtacatgtgtatcaaaacacacgctgtacaccctaaatatataaaacaaacacatactgtattgtcaggtagtgataaatcctatcactacctgacaatacagcagtatgtgttttattttctatattacctatttttatattttacctatgtggcaaaatataggacaaaagaggggtagtggtaggaggtcctgttggagagcattggtatccagtaaggatttaaaagtatttatttaacaaagaatagcagaaagtggacggttgattcacacttggtgcaatctcggctcactgcaacctccacctcccaggttcaagcgattctcctgcctcaacctcctgagtagctgggtttacaggcaccagcgaccacgcccggctaatttttgtatttttagtagaaacggggtttcaccatgttggtcaggctggtctcgaactcctgacctcgtgatccgccagcctcggcctcccaaagtcctggaattacaggcgtgagccaccgcgcctggctgatctggttattttcaaaagattccatgagacgggtttcttcagtttacagaggaggaaactgaggcacagaaggataacccagtgagtcccaatatagagatggagactgcaaccgagaaaggggacccagcgctgaggtccccggaaatggtcatttatgggcttggggggcgaccagggcagcgcgcgctgacctatgacgtcatcgggacgttaagcatcgtagcattacctggacgtagccccatttctcttcccggacaggtcctctgatagtcgggtaggttctcaatcaagcctctcattagttatttggtctgtcaatccatttcattcctgcagtcttccgccccgccctcttgagctcgcccctgataggctggcgcgtccgtcacttcaaaaaggtccgcattccttccgcctttctccaggacaccgagggcgaggagggtggtaccaagcggcgcccaccctcagagcactacttccatctctgattggcttcgctgggtgcccgtcgctactccactcgccgctgataggccattcaaccgccgctctgcgcggcgccggctccgcccccgtcgggtgtttgtggtggggctgcggagtcgccgatcccgccggaagcgccaggacaatggggacccgggacgacgagtacgactacctattcaaaggtgcggccggtggggcacagacgggcgaagtcgtggcggcgaggcggcgggcagacgggccaaggccgcgctccaggccgctgggcccaggccggagcccggggcttggggcccggcgggtcaggcagccgggaaggccggagccgaccgggcagcatcagcttcgggctaggatgcgcggctatacggagccggaggcccggagagacctgggggacctaggacgcgccggggcggggccagagcctagagggggtggggcccggagcggtgggagaggctgttagggcggggcctccgcagggggtggagctttcccaagatttggcgggccgggctgggctgaaagcgtgattcgggatgggggcggggtttttaggggcggggctaaggcgtgatgggcgtgaccaataggtgggttgggcctgggcaaacggaggcggggctctcacgaggcttgtcctgattggggcagcgtgtttgggggtggggcccgggagaggcggggcaggcaatgggggctgggccgagatgagggcctgggggtgaggtgtgtggtggtgggagccttggattggggtgcaaagctgggattgagtggaaaggcacccgtgtgtgcagcaagaattccatctcttcactcagaactctcaacagtgctaagccagtacttgcacttttctgagcactttacccgaattaactaaaatcctcactgcagccctttgaggttgatactaaccagcctctctttttacacgttgggaaactgaggcccagagtgacaaagacacagtttataagtgttggaacccgattgagcccaggccacctgtaggccttaccacttaggaagcgtgtcttagggggcttgtggccagcatctgggactttgggttgttggaccaacttcttccaacacgtgcgcactgatggccggggccccagccagcctgctggagggtcttccccgcccgagggactgagggggctctaggagcatcacataaggcctaggtagatcaggcagccattgcccatttagggacagctggaggaagccggagtcccttgtttctcagctgagccttctgtgcccagctacactttggcctagtggtctgccctggttgctgggctccctggctgacaatggcagcccttgagggctaacccctggatccaaggtgccttcaccctgcggcctgctctatgagggcctgcgtcgcacatcagctgttggtatcctcacctcgctgagccgttcctccgagtgtgctctgtggcttgcaccaggcctagctgggccttgtgtctggtctcatccagcgtcttctgattgtggggaatgaggcagaggtctccccacctgggctgtccgtgtggcgaaagccttccggggggagggagaggaagtgcctctacaagggcctagagtcgtcctgtggcactgagggctctggcagctgcacacaggttgataatgtcactggtgggtgaggctctgtggtcagcaggtgcccggcccaaggtctcgcccctcgtggcaggaggaagctttggaagggttttggagactgggattctaaggggccgtctggagacagggggactaaactttgggtcctgctgatcgggtgccatctccactcagcccaccgtgaggcagctgctcccaggtcctggctgggcacccacccagacgtggcactgccagggcaggggtgttgctccccacatgccccatccaggtttctgtggttatcccctgcttgttatttttgcccttttgctgtgttaaatgacccagctccgagtgcttgctcaagtcatggttttgccctttagattatttccttgaagtgcgttcccagcagaacagttactgggtcaggagcaatggagaggctgtgtggttcccgggacttgtctgcagagactgcttcctggaaacactgatttagcttctgcggcatctggcatttggcgggcaggcggtgtggggtgggggggggcggtgcctgccctgctgccctccccacactggcctccttttactgagtctagcaggtgccctgctgaccttctcaagctagttggtagcaaaaatctaacccacaagttcagcttttcccaaactggtcatctgccgtctcaccttcacagctgtgcctcatcagaggacctcctctattctctttcaatatttttcttttcctttttcttttcttttttttttttttttttttttgagacagaattttactctagtcacccagcctggagtgcagtggcgcaatctcggctcactgcagcctccgtctcccgggttcaaacgattctcctgcctcagcctcccgagtagctgggattacaagcacccaccacacccggctaatttttgtattttagtagatacggggtttcaccatgttggccagctgatcttgaactcctgacctcaggtgatccacctgtctcggcctcccaaagtgctgggattacaggcatgagccaccgtgcctggcctctgcatttttttttttttttttggtggccacatcacgcactggctcccttgacttcagcggccaaggccagcagatcccccgggtgatgccccgtgtgccatttgttttccttcgtgaatgttctttccttcccccaggaatgacactgttgatttgtacctaattatagagcctcacatttatcctcctaacattttctcctttagccatgggccattttcatagcctgccactaattgccgtgggaccccagatttcttttctgatggactcggtactccatggttgcagctgtgtccccaagggccactgaggtcctctcagagcccttcccctaccctagaggccctggccaatcagggctcacctggccctggaggacatgggtcgtgggggaaacgggccgcagctgccccaggccctgtcctctgggtcttgtccacccctcccctgcccaaggacaaggtggcccctgtccccagggaaggggcctgcctggtgcttccctttctgtgctgaggctcctgaggcagctcccagccctcaagcctgggcagacctcacagtgggcctgctgttccagttgctgtttggggacccaaacataccatcttccccatttagaatgggggtccctccagtgccctggctctgtacacctccccatagaagagctgagacaagagtggcccccagtgccggtccctggggcctaggatgcttaggaccagcttccaggggagggatgggggcactgcttggctccgccaggctctgccggaatgggggcaccattcccctgaagagtctctcagtctgcctgagcattagggtctgggcccccagggccaccacactgtcatggggcaggccagggcacctaggacttctcagaggtgccagttctttgtttttgccaaccgggcttgcctgctctgtcagccaagtggcgtgtctggggtaggggggtcgcttcccagccagtgaagccaccaacttctgtggaaatgctcggagctgtgtcctcaagggctctttatttccccaagacaacagattgcttgtgtcctagacaatgaagttttcatccccagcctgcatcctggaccagcccgccactgccccgctggccacctctctgcatcgggcacccagtgccagggactggttgggcagctcagcctctttgccattcacctgttttgtcacccagactggagtgcagtggcttagtgtcagctcactgcaacctccgcctcctgggttcaaatgattctcctgcctcagcctcctgagtagctgggattacaggtgcctaccaccatgcccacctattttttgtatttttagtagagacggggtttcgccatgttgacaggctggtctcgaactcctgagctcaagtgatccacccgccttggcctcccaaagtgctgggattacaggcgtgagccactgcacctggcctgtcattgatctgttcagtggccatttggcctttgctctgacttggtcactctgggttgagtgtccccagctgttcagggagaatgataatatttacatctgtccctggggcagccctgagaatgtggacagctgaggcctgcaaagcactggggacccagcctggccaaagtgcttgagggcaaaactgatggggctgggtgccatggctcacgcctggaatcctagtactttggaaggccgaggtgggtgaatcacttgaagtcaggagtttgagacagcctggccaacatggcaaaaccccacctctactaaaaatacaaaaattatctgggcgtcgtggtgcacgcctataatcccggctactcgggaggctgaggcaggaggatctcttgaactcaggaggcggagagtacagtgagctgagattgtgtcagtgcactccagcctgggcgagggagattccatctcaatacaaacaaacaaaaacaaacaaactgatggggctgaggagccactaaggctgtacagctggggcaaggctggaatggtgtgaaggtgtcgggaatgcctgggcagggcccgagtttcctgtcttatttcctgaggacgtgagaactgagcagacctccctggccttggccaggctcccgtagctgccgtggaaaggaggttaaggttggtggtgtagatgggggccctcacagtgagtccatcttggcccccagtggcctgggagccgattctcatccctactggcttggttgggaggtgctgggccacacgcctacattcactccacctctttccatctttctttttttttttttttttttgagatggagtctcgctgtgtcgcccagcttggagtgcagtggcacgatcccggctcactgcaacctccgcctcccaggttcaaatgattctcttgcctcagcctccaccaccacacccggctaatttttgtatttttcatagagacggggtttcaccatgttagtcaggttggtctcaaactcctgacctcaaatgatccgcctgcctcggcctccccaagtgctgggattacaggattacaggcatgagccactgtacccggccatctttctgtctttctctgaagtccacttggtagccctgtgcggggcacccatggtgacgtgagagaatgccagccccgttgtcttaggtctttcacgccaggccaagcagtggtctttggggagaggagaggtctgagccgaggggtcttgaaggatgagtaggagtttgctggccgccccagggggacaggctgccctatgcggtgggagctggggtgcccagagcctcaatgcccaccccataaggcagaaccacgactcccgagccacgtgctggggtttggggtaggacagtgagtgtggcagtgagttgcgaaggaagaacttggactgtggatgcagaagacctgggttcaaatcctgcctggctcacttcccaggcggtggctccagacaagtcacttggggagcaccgttgggaggtgagggcgagcccacaaacatgcatagcttcagggtcctgctctgccccgcaccccgttccccatccaagcctcagtttcctcatctgtaaaaatgggctacaggaggcttctgcgaagtaacgcacatcaagagctttgttagcacaagctcatcgaatattctccttgttcttgttattcttggcttccaagcagccaaccagagcgggtaccaggtggggttgtaggggctgcctgatcctgccctcctcacctgtggcccaagggtggtgacctggcatcctctaggtatggggcaggcggcatgcgtgggaggctctgccagcctttttggcattttgtttgttcacttgacagacattttcttgggtgtttattgtgtgccaagcactgtgccaggacctgattcctgcccttggggcagactggcaaaagataaatgccacctgacaggtgagagagtggcaagagtgacggaggaagaactgggtccgggagcagggtaattcggagagtagagttttagtagcatagcagggagggccttcttggccaagtggcatttaaggggccacacgaaggggatgagggagggagccaggtgtgtgcctggagaagagcgtttctggcagcaggagcaacccgtgcaaaggccctgaggcaggatcgcacctggcgtgttgggggaacagcatggaggcctgtgtggctggagcagagtgagccggggggggggcgggagggaggaggggagggccctgtgggcagcggggaggactgtggcttttcccctgcggaaggtgggggccacggagggttgtctgcagaggagggagggaggtgccctggctcggcactcacgggcgctctctggtggctgctgcaggaggacagcgttttggttggtgatgagcgtgaacacagggaccgcacagacaataccttccagggtctgagagtctggaatggaatcgcccagggagacatggtggggtgcacccctcgtcctcccttctcttggatctgtttcggatgtgctgaaggattgattctgagatgcgagagaaaggaaggagtcgagaatgactccaggtttctggcatgagtgcctggtaggaccaagccaaagttaaccaagataaggagggtaggtgagcggtgggtgagcaggcttagggagtgatcgggagcttggctctgctcttctgggtatgaggggcctggggcccctgaggagacatgaaggagacaatgggcacgccagtctgggcttctagggagagaggtaatataggagttaccagcccatggctggtatttacagccatgagcctggatggggtcacctggggactgggtgtggacagagatgcctgtcctgaggctccctgaggttcgaaggtagagtgggagactgagtgggagtgactgtgaggagaggagtcggggtgtggagcccctgcaggcagggaaggagggagagctggctgggtgcctgctgcacaggcccgggggagtgggggtagctgaggctgacactgactgtgggggcgaaagcgtgcttggtttgagttctaggactgggggacaggaggtggagtgagtgagtgtagatgataccttccagtgcccgaggcaggaagttgggtcaggagagaatgttttctagagggaaaattccaaacgtgtaggtacagccccacagtgtggccaggggaagggcagaggagggctgcctggtgggctccagggcctgctccctcaatgtagcaggggtcccgagtggggccagcggacctctgggtcagccagggctcagcctggctgccagcacctccccgagctcaggaggaacagccatacccatctcttcccagacaaggaagcctcatcctcagtggatgccccctaactccctgggaccagggatgaccaagccactgagccaacccaccctcaggtgccggggcccaaggcccacacttgggggtccacggggcttctggctggggcgtctggttggctgtattcaagtgcacacacacacactgatcttccccacatggtatgttctgggtctggggacagctcacccagaccccaccccagagcctggggcggctgggcccatagggacagtgcttccatggctgggacaggaaacagtttacaaggcagctcacccctggcctgaccagcaggcacctgctctgctcagggaaagtgttcctgatgctccttggccagcatgagacaggcctgctgcacaccccgtgtcgactgggctcaggcccccgtccctgggtgctgttgcccacaaaccctcatctctgttctgtccacgctgcgctgactcctttctgggccagggtttgcatcttggcaagctgctctgctgtgcacccccctcctgggacaatgcatacctgtgttggagccttgtgaggagctgtgcacacacgtggactgccacacggactgccccttgaatgaggacttagccttggctggagctccctgcagctcagcaggggacctgaccctggggacaggggtggtgggaggtggctgcaggctctttcctccgggctgcgtcctcagggcacattcctgtttcccactcagccatctgtgccgaagctggatgtgggtttgctgcaccaggagaggtgggggttgaggtgggagtagctcctcatgtcctgtcacttacatacctggagcagtgacccttcccatgccctgaccagaaaccacaacaaccgtgacagctgcctactcgtgtcccttcctgtgcgatgcctgctcttttcgtggggggagacagaatctctgttgcctaggctggagtgcagtgattcgatctcggctcactgcagcctccacctcctgggctcaagcgattctcctgcctcagcctcctgagtagctggggctacagtagccaccacgcccggctaattattattattattatttttttttttgagatggagtctcgctctgtcacccaggctggagtacggtggcgtgatctcggctcactgcaagctccgcctcccggattcacgccattctcctgcctcagcctcccaagtagctggggctacaggcgcccgctaccacacccagctaattttattgtatttttagtggagatggggtttcaccacgttagccaggatggtctcgatctcctgacctcgtgatccacccgcctcggcctcccaaagtgctgggattacaggtgtgagccaccgcgcccgggtactttttgtattttttatagagacgggatttcaccatgttggccaggctggtctcgaactcccgacctcaagtgatccgcgtggctcatcctctcaaagcattgagattacaggcgggagccaccgtgcctggccatgcctgctcttacttcctcctcctgtgactgccttcctgttcacacatttggaaaaagtagtccagaggtgaagtgacttgcccaaggtcaccccgctcaggagccttctcaagccgtgtctggctgcccagccaccaggctgcaggtggaggctcagggttgatggatctcgagctgctctgcctgcctggctgcctgggtccccttgccccagctgggacagccctgctctgaggaccagacacaggcaggtgttgtgctatccacagtggctgtttctggaaggcaggagcctgccttcacttctgcaccacttagcacagtgcctgcaggccctgggctccaggcatctctcgactcctccacaccgttggcagccgcgttggtgcagcacccagggaaccggcgggaaggttgtgggggcagtcgtgggtggagtgtggggattcacagaacctcgccttcccgcccagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtgcgtgtcggcagcctgggcagggacgctgagattcgggggcgtgggcttgcagcgcgtgggcttggaaggatgtgtaggagttgggcaggagaaggggagagtgtgctcccaagaccagggagtgaggctggaagaacactttagccatgcgccgtgggaccctcaggctgaccagcgcccagccttcgccacaccagggtatctctgggtaccaagtgcagtgaggacctagctcaggccactccgccttgccgctgcccctgcccagccagcatcccagccttcctcctccctcagcttccctcctcactggtgcccacacctggtcccacacgcctcctgtcctcccacctgggcttggcctccattccctgcaaaggcttcccagccatcaggacccactcagctgcctttttctggacccctcccaagccccccagccattcccaccaccgtcttgagatcctctgggctccctcccatctccttcatccctcaggtacatctgtctctctgtcacctcctcttgttttttttttttgagatggagtttcactcttgtcgcccaggctggagtgcgatggcacgatctcggctcactgcaacctccgcctcctgggttcaagcgattctcctgcctcagcctcccaagtagctgggattataggcacatgccgccataccaggctaattttgtatttttagtagagatggggtttctccacattggtcaggctggtctcaaactcccgccctcaggtgatccaccctctcggcttcccaaagtgctgagattacaggtggcgtgagccaccgtgcctggctgtcgcctcctcttttttggagacagacagggtcttgctctgtcgcccaggctggagtgcagtgccacaattgcagctcactgcccccttgacctcccaggctcaagcgattctcctgcctcagcctcctgagtagctggggctacaggcctgtgccaccatgcctggctaatttaattaattaatttatttattttttagttttagtttttgagacagagtctcactctgtcgcccaggctggagtgcagtggcgcagtctcagctcactgcaagctctgcctcccaggttcacgccattctcctgcctcagcctcccgagcagctgggactacaggcgcccaccaccacgcctggctaattttttgtatttttagtagagatggggtttcaccgcattagccaggatggtctcgatctcctgacctcatgatctgcccgcctcggcctcccaaagtgctgggattacaggcgtgagcgaccatgcccggcctatttatttatttttttgagatagagtctcactctgtcatccagactgaagtgcagtgtcacaatctcggctcactgcaacctccgccccccgccccccagggttcaagcaattctcctgccttagcctcccgagtagctgggattacaggcgcctgccaccacgcctggctaatttttgtatttttagtagagatggggtttcaccatcttggccaggctgatcttgaattcctgacctcgtgatccacctgcctcggcttcccaaagtgctgggattacaggcatgagccaccacccccggccaatttttgtgtttttctagtagagatggggtatcgccatgttgcccaggctggtctgaaactcccagcctcaagtgatccacccgcctcagcctcccaaagtgctgggattacaggcatgagccaccatgcccagccccttcttccctttttttgatgacctcacggtatcttctatttccagctcccaaactccctcctcagacccccacatttcagagctcaatccagggagcagcgctggggcctccagacacacacccttcccttgaggccacaatgactgccccttggctcggccctggacgacccaccctgggcgtgatgtgtgctgttatcccgtgaggctgccgctgcccatggttgtcctccagagaggctcatgggcccctgaccctgcaggtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcaggtgagcagacggagacgcaggcatcagagaggtgtctggaaggcaggaggcccctcacagtgttggggccccggccacagccctggcttcccttccctgaggagtggccttgggatgggccaggtgggtgggcggggtccctgagagcatgtgggagcctgtcaccctgcctccccactcacctaggcagtattctttgttccagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttctttttgtttttttcttttttttgtcggggcaggatggagttttgctctttgcccaggctggagtgcggtggctcgatctcagcttactgcaacctccgccttccaggttcaggcaattctcctgcctcagcctcccgagtagctgggattacaggtgcctgccaccacacccgctaatttttgtaatttttagtagagacaggatttcacaatgttgtccaggttgatctcgaactcctgggctcaagtgatcctcctgcctcagcctcccaaagtgctgggattacaggcgtgagccactgcacctggcctgtttgatttttttccaccaccacccctaacctttgctttttaaacctgccggtccacctggacacttcacagggtcagaccaggtctagcccttgctggcactggggacacagagaccccctggccccagttcctggggatgggccctgccttaactcttggcgctgcggggaggcgggtagcctcagggacctggagccttttggcttctgggagtttacctctgagggaggagggcgcttctgatcttagggagcgagaggccggggctggctgtgaccagatgtgggtcctggctgggtgcgcagcccctgtccttgttacccctgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacagaaacctgccgctgcgcctctgtcttctttcttttccgccaggcgccagctcctaggctgaggcccctctcgctgcacgttccccaatgcaggccagaccccccgtctccccagcccaccccacaggaagcgagaggaccccagcacctgccaagggcagcgtggaagtcagccagcgcagttggggtgggccctggtcaagctgcccctgtggcagggagggatggaaggctgccgcttgtccttgactttaaactcctgggtcctaggacctcaggcctgcgggcgtcccctgatggggatgggagccaagagcagtggccagggttcatcactttgtctcctgccagggcctcccctcccctggggtcctgacgagggtgacttgcccagtggatgttggtgatgccagatgtctccaccctaaactgacaccggaggagggcccagtggggaaatgccagggacagcaaaatgtgtggcatggagttcctcttcccaggatccagcgtctccctccacctcacccctgcagtgaccttgggaccagtgtgagctgccagcagctgtccaaaagctccagcctctagctgaagaggccacccacaccctgaagaccctggggacccatgagagaggacagcaccactccctcttgattctagactggctgccctgcctggagggataggggatcacagacaccttttcccagaagagctccaggtcgctgggagctgtgtagacacaggagttggaatgagccaaggtgtgcgctccaggcccagggagcagcctggcacagagctaactggcagaattggaggcacctgggcaccctgggctccaaggcccattcacagagacccctgggacatggattcccctgggtttgggcagggcaggtcatgtggtggacagaggcattgggtgctaagcaagaaagcaccttgagcttttgtttgtttgtttgtttgttttgagacagagccttgctctgtcacccaggctggagtgcagtagtgtgatcttggctcactgcaacctccacctcccaggttcaagggattctcctgcctcagcctctggagtagctgggattacaggcacatgcgaccacacccagcttatttttgtatttttagtagagacagagttttgccat

SEQ ID NO: 13777 - DNA, 43657 bp, Human
attacactgggaaattgttttagtgtgtacacaattggaaggagttaaactatggaattggtcaaaaaatttaaaatatcattaatttaaaagttatatacttggggctggccacggtggctcacacctgtaatcccagcactttggaaggccgtagatgggggatcatttgaagtcaggagttcaagaccagcctggtcaacatggtgaaaccctgtctctactaaaaatacaaaaaaattagccgggtggtagtggcatgcacctgtaatcccagctactcaggaggctgaggcaggagaatcgcttgagcctgggagatggaggttgtggtgagctgagattgtgccattgtactccagtctgggaaacagagtgagaccctttctcaaaaaagaaaaaaaaattatgttcttggaataattgaatgagatttctgtagtgcatggcatatggtggtttcatctgctggatttcgaatgattagttcattctgtctttgctcaagcattctggctagagtagactgaatcatgagatccttacagtgcaattccaaattctgtattgttggggcaaaaaatgtttaaaattccgaatcacataagcatatattccattctttacttagaatggaagtattcagaggttgcatccagagacattgggactgttgtgtggtcttagtattggtctctattctgttttggagaaaaagaaccaaaattctgtagtagtaataacctggactttgttggtcctatttgattctttattgtaggtgtagtttattttaaaaccttggctcacgcctataatcccagaactttgggaggccgaagtgggtggatcacgaggtcaggagagcgacaccatcctggccaacatggtgaaaccttgtctctactaaaaatacaaaaattacctgggcatggtggtgcatgcctgtaaacccagctactcgggaggctgaggcaaggagaatcgcttgaactagggagtcagaggttgcagtgagccgagatcgcaccactgcactccagcctggtgacagagcaagactccatctcataaaaataccttgttgaggggtattttaatatataatcttaatctatttgaattactataatatggaatatttaattcctaaattaaagcaaactagaatataaaaatcctatttctgtcggttatccttgttcaaataagtacaggacttgagataagaattgctaattagagaagatcgagtgttttgcagaatttaagaattaattttggacagtttccctttacagtacatcttacagatttgtgactctgttctcccccactctctgaaagtgctgggtaaaaagctttgctagcagcctagattttaccacttcatcagtttgttaacttttgtcaaatagcaatgtgcaaaggtagcagtatgataactgacagaaaaatagcaatctgtaatttctgaacacagtaaattctcccataacataatttgaatttgaagtggtatgggattgaaatacttaaatttatagattaagaacctttatatgctattatttttctgtgataagaattggtttttttattacctttgtgtgattagttgtagaagctatgttgggatatgtatgatggttttgtctttagagacttcatttagaaaactgatttgatttaatttaactctcctgtagaaaacagggttaaaagtgttgtgacgttaaaaaaaaacagttttctctggggttgtttatttgcagagttttcttatgctgtgtgattcgtaataactttgtgcttgattgctgtaacagtgttcaatttgtgcattatcaactttaaaaataattgaatgtagtattttgttaatgaaagcatagctttacaaacggtagtgtgaaagaaatacttgaggtatggacacttgtgggattttcacagtactttcacagtaaacattcttttgtcaaactgatctgtattttaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcaggtatgtatttttaaaatttacccatttctgcaggtgtgtaactttcagggttttttgttttttggtttttttttttttttttttttttttgagatggactttccctctgtggccaggctggagtgcagtggcacgatccttgctcactgcagcctccgcctcccaggttcaagcaattctcctgcctctcagctccacgagtagctgggattacaggcacatggcaccacgcccagctaatttttgtatttttagtagagacagggtttcaccatgttggcgaggatggtctcgatttcctgacctcgtgatccaactgcctcggcttcccaaagtgctgggattacaggcgtgaaccactgcacccggcttttctggggggcttttgggggcttttcagaacatataggcctgttttttttgtagcagaaaacttacccaacagatgctgttgtaggagaatgccttagtcatttttttttttttaagattgagtcttgttctgtcacccaggctggagtgaggtggcgcaatctcggctcgctacagcctctgactcctgggatcaagcaatcctcctgcctcagtctcccgagtagctgggattacaggcgtgcaccagcatccctggctaatttttgtatttttagtagagacgaggttttaccatgttggccacgctggtctggaacacctgacctcaagtgatccacctgcctaggcctcacaaagtactgtgattacaggtgtgagccaccatgcctggcctgtaatttgttttcttactacagtttgatttcacattgacgaaaccaaaaacttcatataaaacttgtgggccgggcacagtggcctcagcccccggagtagctgggattacaggtgtgcacgaccaggcccagctaatttttgtgtttttagtagagatggggtttcaccatgttggccaggatggtcttgatcccttgaccttgtgatcttcccgcctgggcctcccaaagtgttgggattacaggtgtgagccaccgcacccagcctaattgatgttctcaaatgaaacttgtttattgatgataggaatgaaaaataaaacacctgtatttgtaacatttgctggttttcgtttgctcagtgacttattctgaatcatatatattctgtgtacatctaaaatcactgggttattttgaaattagattttgtctaaacagctattttcctttctatgggttagcaaaatcttacctagttaggattttttccttactgtttttttttggcttccagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtaagtgtttctttcaactcctatagagctttgagaagtaggaaaagttgggaaaatttaagccaatttgaacatgtaaaattatatttagcatagataataaaattagtgaattatatggtaatttcaatttattattttctttttgacatagcattctaactccgcagttgcttttctttattctactaagaaactccttgcacccttttttcttaatcaccgtctctttacctattcaaaaactaagttatctctaaagacggcctcctcaatgtgtgctgataaaagtccttcaggtaagtttttctaaaatgtgaaggtgatcagaatacattgaggattaaagctctttattacttgtggcttttttttctgtgaatttttatcttaatttaggctcttgattaacttcctctgattctttaagaagaattcattggaatttcatgtgatcttctttaatcagtgtgttttgggggattcacactcacctatttcattgttggcatatttaagcagattatagttcatataggtcattagtattagaaaaaaagattttaggccaagtgattattttagatcttgttttagggatcaggaaaaaaagatctaacctagaaagttgaggtatagcactgagagtggtaagccacatgttgaaggagttttttaagtctgtagttgataggcacttgaaaaggtttgatgggatattacgaggaaggcataaggaagacttttataccatgatcgtgactttattgccagtcttaacagctacacagatgccattgtgacccctctaattctgggacttgcagttagcctccaataccctctttgggtcccatctcaaagtggctgatgaactgctgcttttattctctgagcaggagagaaatataccatttacagcattggtactggtgttttcttgtgttcccaccagctacccatcttcctgctaaggaatgttccagctgttacagttctggtaagtgagtgactaaaattggagagaataaaaacaataagctgtcaatatcattgaggaggttcaaggccctcctgtcccataatcttagcaggagggaatatgacagggatttttaagtgggagatacaggaggctgctacatcattggaattcagttcattttcagccagtgttttcgttgtgaagcacaaggtgttcacaagggatctgtgtggactgaagcagttctaagaaaatttacagagaaattggaatttttggtggtcctcaggagcatagatcctcaggaaatgcttgtcagttgaaggaacacaaagaacatatgaagaggaaggcgtgtcacaccatatggagtggtatgaacaaagaaagagatggaaatgtgagatgctgtctttagtgggtagtgaggagactgcttaatggtgctgataatttccagtgagaggttgggaatagttttggactggtaaattgggaccatgttaaagagggttttgagtgccagaatgggaaatttggatgtgatcttttagatactgagaaccactgaaatttttttttaacagaatagtgataagactagtatttaaggattttctatgagtatggttctgcagtttgacacatcacagccttgtggtagtagaattttattagtgtcatattttcatcctttcaggaatgttcaggtcttacagggtagtaataagtttggtaccataattttttactcattagcttagattaacaactagtaccactcaactcccagtccactattcagggtattgagggaggtaggagagaatatctgatgtagaacaagtatttaaactctcttagggtgggtgatggacctgtgatgcataaatagagctgcataatattagttctcacttttagtgtttaaagggaattttgtgtataattgtagtttgtataatcagattggagagtgcaaatggctttcttttgtgaattgttattttgtcaactcaaaggtatagataaccttttaaaatgtatgctaggtataatttgttagcactttaaagtaatatttgaaataatttgtcagtagatagtgttaatagctttagcagtcattgttaatgtgaacattcctttttgtattttttattcctggtgatttactttgttactcatttcacctggtaggaaaaaaaatagcttttaaaaagagtctcccagtatcattttaaaatgtactcagatactcaattctttatattttctctcttaaggaagagggataccaataaatacaactgggatgtgcaatggaaaaccaatttaaagctgttttgataatatctgttccaaaaagataagctgtggctcttagaataatgatttctataatcagtaatctgtattttaaaaatttagtctgcctattgactccttaataatggaagctggggctgggagcagtggctcagcctgtaatcccaacactttgggaagctgaggcaggcgaatcacttgagcccaggagtttgagaccagcttgggcaacatagtggaaccccgtctctcccctactctctacagacaaaaaagaaagtaatcagccagatgtggtggcacatgcctgtagtcccagctactcaagaggctgaggtgtgaggatagcttgagcctggaaggttgaggcttcagtgagccatgatcaccactgcactccagcctgggtgacagagtgaggcactttctccaaaaaaaaaggatactggaattgcttttgtgtagttacaaatttgtttgattgattgatttttttttttttttttttgagacggagtctctctctgttgcctaggctggagtgcagtggctcactgcaagctctgcctttcaggttcatgccattctcctgcctcagcctcccgagtagctgggactataggcgcccgccaccacgcccagctaattttttgcattttagtagagacggggtttcaccgtgttagccaggatggtcttgatctcctgacctcgtgatcctcccgcctcggcctcccaaagtgctaggattagaggcgtgagccaccgcgcccggcccccaacagactttttaacgatacttttttattttttttgagattgagtctctctgtcacccaggctgtagtgcagtggcacaatcttggctcataattgatagcctgttggtcacattttgttgccctatgggttaatagaagaacttacggtttatgatgcttttagaaataaaatattttctgctttatacataccatttctgctttaatgctgttggtatgtaaattacttaaggatggtaataataatcagttttatttatcagctgctactgtttacgcaaatataatcaaatacttcctaatttattatttataatttatacaaatatttataatttattattactttcctcatttattatgaggtcaataacctattccagttgcctaggttcatgtctaactatgtaatactgagaaagatagttaatttctgtgcctcagtttcctgaactatcaaagtgaggatactcatgtgggccttgaagatttttgacctcataatacatgttcagaaaatactggataatctttacccaaggttttattcaagatgctttctttttatggttttgctctagatatttttctttttctaaattggttaggaagtatttgattatatttgtgtgaatagtagcagctgataaataaaaaatttcattatgcctcctcatctatatcaattgattcacagttagagactgcatagtcaagtggttaagagggcagaccttggattccagttgcctaggttcatgcctaactatgtaatactgagaaagatagttaacgtctgtgcctcagtttcctcaactacaaaagtgaggatactcatgtgtgccttgaagattattgacctcataatacatgttcagaaaatactggataatctttactcaaggttttattcaagatgcttcctttttatggttttgttctagatatttttctttttctaaattggttaagaagtatttgattatatttgtgtaaataaatgcatagtttaaatatatatacaattgtggaaataaattcttacagaattagtttgtattcctactcaaaggtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcaggtaatatctgtgaagcagtttttatgcataaaaagttagtctgtcatttaccgtgttaaaaattaacaaagaatttcagcatttgaataatagttaacttgaaaatctacattaagtggatgattttctagcaaaatagaaattgcaaaaattataagtctaaacaagcatacttcctccccaaatacataaacaaccctaatgaatcttttttttttttttttttttttttttttttgagactgtctcgttctgtcgcccagctggagtgcagtggcgtgatctcggctcactgcaacctctgcctcccggtttcaagcgattctcctgcctcagcctcctgagtagctgggattacaggcacgtgccaccacacctggctaatttttgtatttttaatggagacagggtttcaccatgttggtcatgctggtctcgaactcctgacctcgtgatccacctgccttgggctcccaaagtgctgggattacaggtacgagccaccgtgcttggcccctaataaatattaaattgcaaatgggcaatgtcaaattatcttaaaccatccactgcaaccaaattagtcaatttagaaagtatctttcaccttaggaattaatgaatctgggccgggcactgtgactcacacctgtaatcccagcactttgggaggctgtggtgggcgcatcacctgaggaggggagttcgagaccagcctgacccaacatggagaaaccccgtctctattaaaaatacaaaaaaaattagtcaggcttggtggtacatacctgtaaactctgctacttgggaggctgaggcaggagaaaagcttgaacctgcgaggcagaggttgtggtgagccaagatcacaccattgcactccagcctgggcaacaagagcaaaactctgtctcaaaaaaaaaaaagaattagtgaatctgaaaaccagttacttgattacagttgaagtctaacacatacttgatatgcaaaatatacatagattgtctcagtacaaaacgtattcctaaacttgtcgcaaaaatactaaatcagtgggctttactggtacacagtaatggcttttattatttctgtatgttctaaatttttctaggataaaagatacccactacagaaatggttggggccgggcgtgatggctcacgcctgtaatcccagcactttgggaggccgaggcgggcggatcacgaggtcaggaggtcgagaccatcctggctaacatggtgaaaccccgtctctactaaaaatacaaaaaattagctgggcgtggtggcgggcacctgtagtccccgctactcaggaggctgaggcaggagaatggtgtgaacccaggaggcagaggttgcagtgagccgagatcgcaccactgcactccagcctgggcgactgagcaagactccgtcccaaaaaaaaagaaaaaaagaaaaaaaagaaatggttgggtcagtattcgcagtgaaatgtaattacttgtaaaacagatttttaaaaaccaggaaaattctggttctttttgttgtatcatgtaccatagaaggatttatctcatctgctaagatcattggttcaagtcataccattacatttaaaaatctcatttaaataaatcagagccaggcacagtggctcgcacctgtaagcctgtaatcccagttattctggaggttgaggttggaggattgcttgaaaccaggagttcaaggctgcactccatcctgacagagcgagacctggtctcttaaaaagaaggaagaaagatctatgacttcacctccattaagactgtacttgcctaactctattccttggttggattttgcatgtctttgctagatctttaaagacattcaggtatctcccactctgaatctaagggcaccttaatgccattctattggactcttaggttattcttttgttaagtaatttgaataaacactagtcttttcaatattttttctaactaggaggatcataacttttggattaaataataggtctttttgaaaactatcatagggcatagggaataggacaaaatactttctcaactcattctttgagactagcatacctgttgtaaaaatatagccccgtctcacttgtgaaaatagatgtcctaaaatcccaaattggataacttttttattggcctactgagaaataggatttatcccaggaatacaagaatggatcaacagtaagaaattagtttttgtaattaacccttacatcacgttaaaatagagacctgtaaacatctttatggatgtcagataaagcatttgataaaattaaataaccatgtctgctttgaaaaaaataaacaactgttagaatcctagaacagaatctttcttaacttgatgaaaggtgttcattagaaatctacaataaatatcacaccttatggtgaaaataaaatatcccagtaaaatgggaatatggcaaggatgcccactcactgtttaccattatagataacaagcaaagaagtttgcctatgtactaaaagcaggaaatgtggattgaatgaaatacttttggtaggtattgtgaagagtaaaaagaagtaggattttctttagcaaggatttcgaaatattaattcttgacttttatttagtatacactaccactggaactgataaaccaacagaacctgacagaatggatagaaattttaaagactgttgtgaacagggatgtacctaatgtaagtttctgtatgttctcttatattactaaatgtaaatatttaatgatcttttgaagactttaactggtgtttcctgtaacattctttatgaatttttataatatggtgatgtatttttttctagattagaggtaccttttcatttgtttatatatgcattacatctgtacatttacttagtgtaaaaagttgtaaagggtgtttttttaaatatattattggtttaatttcttctgttgtccttttgtttcatcctaaatcttctgttccctctcagttcataaattaagagctcatagctggctcttagcctagttaatttgtcagatgcccacgtacagaggaagaggaagaacttgatttacagattggccaacttttgtagttatgttattttttcttaataactctattgagaaataactcacatacagtaaaatttattcttttaaagtacaacttggtagtttttagtacattcagagttgtccaattgtgttatttttataatcaaactttttaaaattattataatttttctttatagtctagttttcttttttcttttttttttttttaagctgaagtttcgctcttgttgcctaggctggagtgcagtggcgcaatctcggctcactgcaacctccgcctcccaggttcacgcgattctcatgcctcagcctctcaagtagctgggactacagacgtgtgctaccaagcccggctaatttttgtatttttagtagagatggagtttcaccatgttggccaggctggtctcaaacttctgagctcaggtgatccgcccaccttggcctcccaaagtgctgggattacaggcgtgagccactgtgcccggcctatagtctagttttctagagatataggggaatttacagattactgaatacgctgttttgttttgttttgtttttttgagacagagtctcactctgtcgcccaggctggagtgcagtggtgcgatctcagctcactgcaacctctgcctcccaggttcaagcaattccctgcctcagcctcccaagtagctgggattacaggtgcctgtcaccatgcctggctaactttttttatttttcatagagacagggtttcaccatcttggccagggtggtcttaaactcctgaccttgtgatccacccgcctcagcctcccaaagtgctgggattacaggtgtgagccaccgtgcctagcctattttacagtgtgttttatgtactgttattaatatatacttatttaaccctcaaaatccttctgacttttattttaaacttacacatgggagggttatgtaatttatccaatataatattgttaatcgcataagtgagaccaaagtcctattttgtagtttaatttttttaaagatttgtttcaaaaaggtttatgaacaatgcagaagaaacaacatttctacaccctccataggaaactagtttggtgtatatttttctttgcacatttaatagatataaaatataacttttaaagttctcatatacatattgtgcacctttttgttgtacaatttataatccgtgcaccgattataaataaacagttcagtgagttagcacaattattatgtacccatgtagccatcacctcagaatgtttgctcatggctggttctagtcatctctggcatcatctcattcccggcacaatagatttaatctgttttagaacttagtaagtaatcttttgttcctggcttctttcacttaatatatttataagattctttcatgttgtatagtggtagtttattattttttattgctgagcggtatcccattgtatagatatatcacaatttatgtatgttgatggacatctgggtagttttactttttcagtattatagataaagctatgaacattcttacgtgtctttttgtggtcacatgtttttcacactcttgcataaatatcaaagaaaggaattgggtcataaggtaggtgtatgttttactttacaagtaacttccaaagtggctgtagcattgctttcactagcgatgtatgagagtgttcacttgctctgtatattcacttccttatcctacttaaaaaaatatgtcatggataggctgggcgtggtggcttacgcctgtaatcacagcactttgggaggctgaggcgggcggatcacgaggttaggagatcaagaccatcctggccaacatggtgaaaccctgtctctactaaaaatacaaacattagctgggcgtggtggtgcaagcctgtagtcccagctactcgggaggctgaggcaggagaatcacttgaaccagggaggcagaggttgcagtgagccgagattgtgccactgcactccagcctggcaacagagtgagactctgtctaaaaaaaaaaaaaaaatataatatatatatatatatatatatatgttatggatgtcttaggttattaatgtataatgatccaattccttctttcagtgattgtataggagtcttttatggatcttccataattgaacattattaatgaatcttcaggttcttggaaattttttaccattacaaataatatgataattaatattctcatacacaaatcgttgcgcatttatacttatatatctgaaactagatttctgaaatggagtttctcatgccctttccattatgaaatatactgattttgattaagctacaatagtcgtggccttgactatactatttagatcttggctaaaatgtttggctttaagcttgtagaattattttaaaaagcatgtcttttataaccaactagtgaagcagtgaggatgcctctttgatttaaatagggttaatacttttccaagtctaaccttctactatgaaaggccaacatcaggccaggtgcagtggcgcacgcctgtaatcccagcactttgggaggcggaggcgggtggatcacgaggtcaggagatggagaccatcctggctaaccccgtctctactaaaaatacaaaaataaaattagctgggcgttgtggcggccacctgtagtcccagctacttgggaggctgaggcgggagaattgtgtgaactcgggaggcggagcttgcagtgagctgagatggcaatagagcaagactccatctcaaaaaaaaaaaggccagcattagtgaagcattcacatttttgtcaatctattctcatctcatgctgttcctcctatattgtattatctctatcattaaataagtgtctttttaaaggaaacacttcaagttgaagaagatgatcgacctgagttaccatggtggaaatgcaagaagtgggccttacatattttagcaagactttttgaaaggtaatctcatccatatatggtgatttaaattaatttattaaggttttgctttaaagtgctagcataaagcattataaagaaacaatgggcattttgatgttcttttagatatggaagccctggcaatgtttccaaggagtataatgaatttgctgaagtatttctgaaggcatttgctgttggtgtccagcaagtaagtctgtttttagtttttctcagtggaaacatggcatctttaagttaatttatatattgcttattcccagtttctttgacatctaaagagtgcctgtttggaccctgtaccaggtctcaaacatttttggtctcaggatatctttatgttcaaattacttaggataccattgggttctcatttatgtgagttatacctagtaatatttatcatattagaaattagagtaaacagttcattaaaatataataacaggcctattatatgttaagacaataatttttttttctcttgttgcccaggttggagtgcagtggcgtaatctcggctcactgcaacttctgcctcccaggttcaagcgattctcctgcctcatcagcctcccgagtagctgggattataggcatgtgccaccacacccagctaattttgaatttttagtagagacgggttttctccatgttggtcaggctggtcttgaactcctgacctcaggtgatccgcctgccttggcctcccaaagtgctgggattacaggcatgaacccccacccccggcccagaattctaatttttgcttgaaacctcaagttttaacaccagtaacatattgtcagcaattttccttgaaatgagggactcgttttattcatttttgagaatataatcctataatcccagcactttgggaggccagggcgggcagatcacgaggtcaggagttcgagaccagcctggccaacatggtgaaaccccgtctctactaaaaatacaaaaattagctgggcgtggtggtgcgtgcctgtaatcccagctattggggaggctgaggcaggagaatggcttgaacccaggaggcagaggttgcagtgggctgagatcacgccactgcactccagcctgggttacagagcaagactccatctcaaaaaaaaaaaattcttaagaaaaacttgttctaaggctgggcgcagtggctcacgcctgtaatcccagcactttgggaggccaaggcgggcggatcacgaggtcaggagatcaagaccatcctggctaacacagtgaaaccccatttctactaaaaattcaaaaatgtagccgggcgtggtggcgggcgcctgtattcccagctgcttgggaggctgaggcaagagaatggcgtgaacctggggggtgcagcttgcggtgcgcagagatcctgccactgcattccagcctgggcgacagagcaagactccgtctcaaaaaaaagaaaacttgttctataagaatatggctgtaaagaatacagtgacttggccgggcgcggtggctcacgcctataatcccagcactttggaaggccatggcaggcagatcacctgaggccaggagttcgagaccagcctgaccaacatggagaaatcctgtctgtactaaaaatacaaaatcagccaggtgtggtggtgcatgtctgtaatcccagctactcgggaggctgaggcaggagaatcacttgaacccaggaggcggagtttgcggtgggccgagattgcaccattgagcaaaactccatctcaaataaataaataaataaacaaataaataaataaataaaaatactgtgaatttaatatcatactcttgattcaaataaggcatcagaacatttaacaccatggttttgtaccattggtgcaaatactcatttactcaaaacacagttttgtttttttttttaaaaaaagacaatatcattatgaaagtagctttaaactagtagatcctctgaaatagtcttggggaccactagaggtttgtggaccacattttgtgtgtcagtgttctgaaacatgaagtagagttagaactattgacagatgctaaataggcagttgactgctttgggtaaggttttcccagaagatggctttaacaagatagggttttctcccaatactgtggtttttcaataggtagcaaatgggttaggtgtggtgacttacacctgtaatcccagcactttgggaggctgagatgggagaatcgcttgaggccaggagttagagaccagccggggcaacgtagtgagacactgtctctaacaacaacaacaaaaaaaaccccagaaaaacgaagatagtatatagttttctcttcttttcattcttaatcagaaatgagttaaattatttttcaaagtatacggttgtttttcttgatgatgagcttgtcattaaaatatgtgttaactgtttttactggcttgtaagtggttgaaatttctatttgaacattgatttgtgatcgaaaatttttttccaaggttttattgaaggtgttatatcagtacaaggagaagcaatatatggctcctcgagttttacaacagacattaaattatattaatcaaggagtttctcatgctctcacctggaagaatctgaagccccatatacaagtaataatttttatctgaaatgtttttatagtaaatataatagaaatgacatcaattgccataaaggttgaaaaattgcatgtttgttgagttgtgttacttagactacttctggtgattgttttgagagtatagcagaaaaaggagataagacagtgacataaagttatgagaggtatcttgtgaatattcaacttatcttttaatccaaaactgttgtcttcaaacttgcaatttaagttcttaatattggactatgattatattttatcatgtaatttggagtagccaagggactttatctcaccagattcatttctagtataaatgacttacctgctatttctatgaataatttatgtgctttatttagagctgtagaattttatagactatatatatttagaatacttaattgcgacctttgtacacatatatcttaaagttacttgttacagaaaggggaagtacatgtagtttgatagttgatcttagaacacattaaatgcattactaacgtttgatattaagctttaaaatacatatagtgttactttggttttaatacttaaaggaaatttgaaggtttaaatttgaaaactgatggttattgttttcttaacttttaaattgcagggcattatccaagatgttatttttccattgatgtgctatacagatgctgatgaggaactttggcaagaagacccttacgaatatatacgcatgaagtttggtaaggaattttcacgtttttagaaacaaaaaatgtcagtaattaagattacagtgattgcatgtagccaacctagggggtattatgtatcttctttgttgttttaatgtaattgatcccttgtgtagtcctttttggggctatttattaattatgacatttgataatgataatcttatttttggcagacacaaattcaatactgttaagtttttattactgaataccaaaactgttagatattcaagattacacctcaacactaaatgtcttaactatacttttggatcttatgttagccatcatatgagtgggaaatgagaaaacacatctaggaagctggtgtcacatgaagtccttgcacagaactaaagaattgtaatttggctaataatgttgaatattggtccttattcttaccaagtcatttgtgctttttgcagcttgtacttttgtgaccctgttgtgaaaattctcacatcagtagtgtttcatacatacgatttaaactgctgagttctgagttaataaataaaaatgaaagctattaggaggaattcatggattaacatttaattttcacaggccaggtgcggtggctaaggcctgtaaatcccaacgtgttgggaggccgaggcaggcagatcgtttgaggtcaggagtttgagaccagcctgaccaatatagtgaaaccccatctctactaaaaatacaaaaattagccgggcgtggtggcaggcacctgtaaaccagctacttgggaggctgaggcaggagaattgcttgaacctgggagatggaggttacaatgagccgagatcgcccactgcactccagcctgagtgacagagcgagactccatctcaaaacaaacaaaagcattcaatttgtacagaaaagacattgaattctgcttttgcaaaattataaagggatctgggatcattttcataccttatgtaaagattaagcatgttttttaatgctttgttgaagaaattaatgtttattgtcttaattttaaacttgttctctagatgtgtttgaagatttcatttctcctaccactgctgcccagacacttttgtttacagcctgtagtaagaggaaagaggtaggcttatttaatgtttagataacttttctgtattatttaaaatttattcaactatacactttttaaatgttagtcatgtgagtcattttgttagtatgttttttaaggactgttggcctattcagtaacaatacttttctcttttaatctaggtactgcaaaagactatgggattttgttaccagattcttacagaaccaaatgctgaccctcgaaaaaaagatggagccctgcatatgattggctctttagctgaaatacttctgaaggtattctttagtgtgtttgtatgtgcatgactatgcaagtagttttaaaaaataaatagccagccaggcacagtggctcacttctataatcccagcactttcgggatgctgaggcaggcagattgcctgagcccaggagtttgagaacagcctgggcaacatagtgatacccccatctctataaggataaaaaataggccgggtgtggtggcttatgcctgtaatcccagctatttgggaggccagggcggggggatcacctgaggtcagcagttgaagaccagcctggccaacatggtgaaaccccgtctctactaaaaatacaaaaatccgccgggcgtgatggctcacgcctgtaatcccagcattttgggagaccgaggtgggtggatcatgaggtcaggagatcgagaccatcctggctaacacagtgaaaccccgtctctactaaaaataaaaataaaaaattagccgggcatggtggctggcgcctgtagtcccagctactcaggaggctgaggcaggagaatggcttgaacccgggacgtggagtttgcagtgagccgagatcacgccactgcaatccagcctgggcgacagagtgagactctgtctccaaaaaaaaaaaaaaaaatcagctgggcatggtggtgggcacctgtaatcccagctacttaggaggctgaggcaggagaatcacttgaacttgggaggcggaggctgcagtgagccgaggtcatgccactgcactgcatgctccagtccaggcgacagagactccgtctcaaaaaaaaataaaaaaataaaaaataacaaccttatggagtgtacaactcagtggtttttagtttattcacagttgtataactatcacccccagaaggaactctgtatacattagcagtcactccacatatcaccccaaatctcccaaccctaggctacctatagtccacattttttctatggatttgtttattgtggacattttatataaatggaatcatataatacgtagctctttgtgggtgacttctttcatttagtgtaatgttttcaaggattatctgtgttatagcaggtttcagtactttttcctttttgttgccaaattatatttcattatattaatataccacattttatttactcattcattagttgtttctactttctggctgcttacaaatgttgctgtgaacattcatgtttaaatttttatgtggacatacgttttcatttttcatgggtatatacctaggactatgaattgcttgtcataatttgagacaccgcagaacccattttccaacgtagctataccattttatatttctgccagcagtatattttgattatagccatcctagtgaacgtgaagcattatgtctttgtggctttgaaatttttcatgtgcttactatccgtttgtatattttctttagagaatatctattcaaattccttgccccaaaaaaattgcttgcctttgttttttttctttttattttttgagatggagtcttgctctgtcacccaggctggagtgcagtggtgagatcttggctcgctgcagccaccagtctcccacattaaagtgattctcatgcctcagcctcccaagtagctgagatttccgcctccccgccccccccgccatatgctggagtacagtggcgcaatctcgactcactgcaacctctaccttccgggttcaagtgattctcatgcctcaggtgcctgccaccagcctaatttttgtatttttagtagagatggggttttgccgtgttggccaggctggtctcaaactcctggcttcaggtgatccgcctgcctcagcctcccaaagtgccaggattacaggcgtgagccactgtgcctggcccttgcccatttttaattgggttatttgtctttttataattgagttgttagaaatctttacattctaaagccaggcactaagtactcacagaatatttagtcattgtatcttttatcttttcgttttttggaaatggagcctcgttctgttatacaggttggagtgcagtggcgtgatctctgcttactacaacctccacctcctgagttcaagcgattctcctgcctcagcctcccgagtagctgggactgcagacacctgccaccacaccagctaatttttgtattttcagtagagatggggtttcaccatgttggcctggctggtctcgaactcctgacctcaggtgatccacccgcctcggcttcccaaaatgctgggattacaggcgtgaatcactgcacccggccgtctttcatcttttctatacctgttcacccatccttctctttgtttataaagtatgtattaaagacattctaatcatttgtggcatagaaggctgagaattagtgagttctcttggcaaattcaagtttatctattcttacctttcactcagcttcacttagtggtaataccttacataggtaggcaaagttatcaaaaacatgaagttgattttggtatgctactatcaactaatccatggacctttttaaagtttcacaagatttcccactatgtccttttttctgttccatgacccagtctagggtctcacattgcattaagttgtcatgtctgattatgtaagtgttgatatataagtgtcttatgtttttaatgttgatttaatgtgcagtttaaggaactcttctaaaaagcttctttccacttagaaaatactcactttgaatactgagagtgcctttttagagaatcacttgaatctgggaggtggacattgcagtgagccgaaattgtgccactgcactccagcctgggcaacacagcaagactccgtctcaaaaaaaaagaaaaaaaaaagagtgtgcctttttagatagccagtttattcgtttgaaagcaggatttttctcaggttatgttattttcagccagaaactttatcagacaagttttttccttataaaagtttcatagtaacagataaaattaaccaaacttacatcattcgaacactattgctggtaagatttggcataatggctttctaatcaaggaatataaaaacgtgaaaatgtgtttagtggtttttggtggtgaagttctggaatacgaaaattggttgtggattctggggttcaaagaatgagaataaatatatgtaacattaatagtcatttttaatagtgttatatctgtttggaaattgagatgattatatttggaactgtatcaaaataactgttgtttatatttacagaaaaagatctataaagatcagatggaatacatgttgcagaatcatgtattccctctcttcagcagtgaactaggctacatgagagcaagggtatgttttaaagctgcattatttatatacttttgtcttgtaatgaatgactctgtggacttttatattgaaacttttaaatgttcactttgaagcctgtgtcttattttaggtttctgtttaatgtaaatctttacatggctgctgtaatgtgtgcataggtttcatctgtgtctggtagcagtgtctgtctgtgttttgcattcagatcttgctatccacacaaacatcatgcggccaaagagtaacttgggatcatagtactggtctagtgttgtctctggacacatctaccactggccagcctccaaattcccacacacagaactcagggaatagagattagcttgggggaatttaaggtaaggtatctacagtaactcactgtgtttttacaaaaggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaaggtaaaggatttttgtatgtcaagaaaagtgaatgttggccaggtgcggtaggtcacacctgtaatcttagcacttcggtaggcttaggtgggaagagcgcttgaagccaggtgttcaagaccagcctgggcaacatctctacaaaaaaaatttttaaaaattaactggacatagtggcatgtacctgtagtgccagctacttgggagtctgaggcagcaggatcactagagcccgacggttcgaggctgcagtgtgctacgattgccactaccctccagcctgggcaacagatcaaaaccctgcctcttataaaatatatatatatatattaattgtaaaaagccataatcctagaaacttggcatacttcctttttatgtgaaagtacttttttaaaaaactcatcgatatttgttatatcaggttttaagaagttttaggggttttacgcaagttttttactctttctcttacagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggtatgttgtttgaacctaccatatttgcaagcattttaatgtagctctcagtatgttccaggttgtgtcaccagtggcttgccttaccttatagcagtcaacctttttggcacctgggatcggtttcatggaagataatttttccacagatggtccgggggagatggctttgggatgaaactgttccacctcttatcagacaggcaatggtttctcataaggggtgtgcaacctagatccttgaatgcacatttcacagtagggttcacgctcctgtgagaatttccgggagtaatgctcactcacctaccacttatctactgctcctaacaggccatggaccggtaccagtccactgcctggagactggggacccctgccttatagtagatatttcacagacattactgtgtagcacataaagcccttgacagatacttaacttacttaattctaacacaatcatgtgtcagaattattcctgttttacggagaaaatatgaggtataaaatggtttattgcctaagctaggcagggtgcggttgggatttatatatgggccttcatggtacttgttcttaactactacctcgggctgcagcatgactatctgcatagtgccctggaatgctcaaaataatcgattgaattttacaaaagataaatcagtgacccccttgatgattaaatatacttttatttggacattgtcaagtgttaaccagtaatattaatgaaaactattcataatattaagtactttttataccttgcctcatttagtcctcgtacggtgtctatgaaatccccgaagtggcatgcagaaaaggtcaagagaagtcaagtagcttgtttaaggtcacccaatgagcagactatttgattatagagcttaagctctttattatcattaatcaatttggagacattgatttgttgtggtatcccaatgagaacgttctaagaattaaaagtcttagaccaaaacatatttataatgcttcagtgacaaacttgagttatattctcttgaatctaggcaatgacatttaaccaagtaatccagacggggccagatgaagaaggtagtgatgacaaagcagttactgctatgggaattctgaatacaattgatacacttcttagtgtagttgaagatcataaagaggtaagaagatgatctagtgttgcagtttttcaagccattttatgctttttagagggctctaatatctctctggcatctcatgtaccatgtttttgccattttcccttttataaagataagattggtacattatattttaagttctaaagtattagtagaaggaataggaagcaggtatttgttttaccatcttagggctcaggattttggctcctcgttatgttttctcagatccagaaatatggtggttcccagaaaaacaaaaatatttttcttagttttctttttctttgaaaaattttggttatacacatagcataaaatttacaatcctaaccatttttaagtatatagttcactaatattaagtatattcacattgttatgcaaccatcactaccatcttcctagttttcttcttttctagttgtcttttggaaaagtaagaattgtaataatggattttttttttttttgagatggagtctcactctgtcacccaagctggattgcaatggtcactgcacctgaccctgaaattgtttttcttaacataatggaaatattctaagtgttaagaatgtaataaagtttaggtgattaagaagttttggttatagttttcttattatttactcttttctgtatgttttaaataactccattttttaaaaaatccattattgggcggccaggcatagtggctcatgcctgtaatcccagcactttgagaggccgaggtgggcagatcacctgaggtcaggagttcgagaccagcctagccaacgtggtgaaacccctgtctctactaaaaatacaaaaattagctgggcatggtggcgggcgcctgtaatcccagctacttgggaggctgaggcaggagaatcacttgaacccgagaggcagacgctgcagtgagcatagatcgcgccactgcactccagcctgggcgacagagtgagacactgtgtcagaaaagaaagaaagaaagaaaaaacaatttgagatagatgcagttgaaagccctcaggggaccacttcctaaccccttttccctacttcctttcttcccatagaagtaacactgtcatgaatttggtgtttataattccaatgcagatgcttgtaatgtatctcttatccgtaaattacatgttttctgcaagttgccttttgcagcatgaggtttttcactaaacttttttttttttttttttgagacagagtctccctttgttgcctaggcaggagtgcagtggcgccatcttggctcaccgcaacctctgcctcccaggttcaagtgattctcctgcctcagcctcctgagtaactgggagtgcaggcgcgcaccaccatgcccagctaatttttctatttttagtagagacagggtttcaccatgttggcaggcaggtctggaactcctgacctcaagtgatccgcctcccttgacctcccaaagtgcagaaattacaggcgtgagccaccacgccagccacgtaaactgtttttgtattctgccttataattgaatataagcagaagccatgaccaatcctataggtgctttatgttttaacagattaattgtttattctattttaggaattgtaaatgtattaagttctgtatatttgaaatggatgtcttgcttttatatctgattagtggatattattttacccttcctccccttaacattcttatggccctcagggatttgggatctaatttaggactatctagacaattatagaggaatttgtatttcttgtcagtcttgagttgggggctgagttcacattccatggttcactatatctaataaaatttgaaaaactaaggtgacttaaggattattgagattcgtagcaataatgccttccttcggataatttctctgtgagtcattgacggtgacttttcaattacattgagctgaattaatctctatttgcacataacagatgggctatcttccgaatggttttttttttttttttttttttgagatggagttttggtcttgttgcccaggctggactgcaatggcgctcggctcactgcaacctccacctcctgggttcaagcaattctcctgcctcagcttcccaagtagctgggattacaggcacccgccaccatgcctggctaattttttgtatttttagtagagacggggtttcaccatgctggccaggctggttgcaaactcctgacctcaggtgatccacccaccttggcttcccaaagtgctgggattacaggcgtgagccaccgcgcccggccaactcctttattttcatagttgtttgcatttttcgagaatgttgttttttcctttttaggtaaattaagctagccattccttgtgtttttctcattgtaatggtatttcattctatttttatctgagatcacaatttcataatgtgtaagtcattttaaaacaaagacttatttttttcacaatattgactttatatttaagtgtactgaattataatatgcgttgtcttactaagtcatttagtaggctgtaactgcatatgattttttttcttctcttttagataacccaacagcttgagggaatctgcttacaggtcattggtactgttttacaacagcatgtcttaggtattatacctctgattgtgctaagaatttagtgctatttcacatgagcaagcattttcctaatgacttagtattctcttttagaattctatgaggagatcttctctttagcgcacagtttgacatgtcaacaagtgtctccacagatgtggcagctactaccccttgtatttgaagtctttcagcaagatggctttgattactttacaggtgagtcaaagcagcatggaaatactgagggttttccctgctttgatttatttgtagcttatcatttgaacatacacttttttttttttttttgagtcggaattttgctcttgttgcccaggctggagtgcaatggtgcgatctcagctcatcgcaacctatgcctcctgggttcaagtgattctcctgcctcagcctcccaagtagctgggattacaggcatgcgccaccatgcccggctaattttgtatttttagtagagacagagtttctccatgttggtcagactggtctcgaactcccgacctgaggtgatccgcccacctcagcctcccaaagtgctgggattacaggcatgagccactgcgcctggcctgaacgtacacttttgaatgttcagactgcttcactgttcggaacaattatcagtagaagttaatgctctcagtggtgatgcatgatattgatttctgctatataatttagttattttaggcttattctttgttaacacagatacatacccacacacccccttgtaatcttctccatataaatgtaaaaatgtgtctataatttttatgtttaagtacaaagaaaatcactttaataataggttcatttctgcatttaattataaatgaatatgttttaattaaaactaaatgttaaggccaggcttagtggatcacacctgtaatcctagcactttgggaaggtgggaaagcacttcagtccgggagttctcaaccagcctgggctattagaccctgtctctaaaaaaaacttttaaaaattaatcaggcgaggtggcgtgtgcctatagtcccagctacctgggtggctgaggtgggaggatcacctgagtccaggattttggtgttacagtgagttttaatcacaccactgtattgggcactccatcctgagcaacagagtgagagtgtcccccctccccccaaaaaaaggtgaatgttagagacaaaatgatctcatagatttgcctttttctaaggaaatttttcaaaagcaaagaaagcatttgtgttactaaagatgtgtaaccgatgttttttattaatacagatatgatgcccctccttcataattatgtaacagttgatacagacacacttctgtctgacaccaagtatcttgaaatgatatacagtatgtgcaaaaaggtaggtcatttttatatatcagatttcatgaggcttctgctataaaatgtatgaaattgtgaaaactcatgtgataccacattgtagtaataaacatgtaaacatggatctgacagaattaagggctttaaaagttaaaagtcattggtccctagatgccacagttttgataaatatatgtcttttgtgtgccctctgacacttggaatttgtttttgaattttagagtgcccggagtttaactaacatagtcttatggaatcaaaagaaggaaagagtcaagaacttgagagatttttgaaaggattaggaatggatagagatgttttataaaggaaaaggttagcagctataggtttacaacaagcaataggaaatgaatgtcccccttttgtttggttggggaaacaaataaactggagtccatcaatatcaaagtcagtgtaattggaagcattttaatttctagcaatgtctgttgtaggtcgttagaaaatgatttgctccatgaagtttttagatttctttcactcatctctttcctttctgaacacgaagtcacacataatcatctagttatgttagtcattttttactgccaattatattatttatattaatattctgggagcagagatatacctatactatctacatttctattcctgaacacttattcatatgtttatactcatctagttttcactagccttcaagtccatgttcatttcttgtctggagtttatagggcaacatttgccctcaacaggctgcctcttcctccctccgttcctctctcccctactggttttttgtgttattgttgttttcttttttaaagagaaaagggtttcctagaaatgtcaacatcttagctttttgtagttctttacgtgagaaaggttaggtgttttagctaccacctgtgtatgagaagttagtggttgtcaacttgctgtaatccagaatggcactacaggataggtgctttgatcacaaagaccaagatgccagagggctagactatgaaagataggaggcagacagctccagatcctcacagctatccagatcctttagtctttcatctgtgcaatgaacattgcagttattcatattaattagggtacctcaagtaatactcagcctgtacacagggtaggaaattgtttccttgatttagatacctgatttaaaggataaagccttactgcaatttatattctgttttgatcaggttcttacaggagttgcaggagaagatgcagagtgtcatgcagcaaaattgttagaggtcatcattctgcagtgcaaagggcgtggcattgaccaggtcagtgaagctaataatgatttgtagttcagaggggtaatcttttccttccactttctttcttcattttttggcatttgttgcatattctgtatgtttttgtttattgagacatctagacaactaatatttttagttcaaaatgtaactaatatataataatgatcatatgtttaatgtacaggaattggactaagttttatggctactttgttatcatgaaaggtaaacttttgcttaagattttttggatagctttagtaattaaatatccatggtcagtttttttgtttgtttgttttgttttgtttgttttttgttttttgttttttttgagtgagagtcttgctctgttgcccagactggagtgcagtggcacattctctgctgactgcaaccagattcaagcagttctcctgcctcagcctcccaagtagctgggattacaggtatacaccaccataaccgcctgattttatatatatatatatatttttttttttttttttttttttttttgagacgctgtctcgccctgtcgcctaggctggagtgcagtcgcgcaatctcagctcactgcaacctctgcctcccaggtgcaagcagttctctgcctctgcctcctgagtagatgggattataggtgcctgccaccacacctggctaattttttatatttttagtagagaaggagtttcgccattttggccaggctggtctcaaactcctgacctcaagtgttctgcccacctcagactcccaaaagtgctgggatcgcaggcatgagccacgtcacccggcccacggtcaattttaataggaacttgtgaagccatgattgatatcatcgtgagcttttatttattttttatttatttcatatatttttttgagacggagtctcgctctgtcgctcaggctggagtgcagtggcgcgatctcagctcactgcctctgcctcccaggttcacgccattctccttcctcagcctcccaagtagctgggactacaggcacccgccaccacgcctggctaattttttgtatttttagtagagacggggtttcactgtgttagccaggatggtcttgatctcctgacctcgtgatccgcctgcctcagcctcccaaagtgctgggattacaggcgtgagccaccactcccggcccgtcgtgagcttttaatagctccatgaagactactagactttctctaaaattagatttcccagtgcagtgcctcagcagtaaatattggtcatctaatgctacaatagggttaattgaggcaacaaagaagttaatatttttagaatgtttgcatgctattaattatagtcttagaatatcttgctatctttttttgtagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggtaagtgatgtattgcaattttactacatttgctttgggaggaactctgcttatttaagaaaagaaaacagtttttttttttttttttaggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccggtaagggattttcaatggaagaagacaaaacttatctacttagaaatattaccgcactgggccgggcgcagtggctcaggcctgtaatcccagcactttgggaggctgaggcaggtggatcacacggtcaggagttcgagaccagcctggccagtatggtgaaaccccacctctactaaaaatacaaaaattagctgggtgtagtggtgggcacttgtagtcccagctacttgggaggctgaggcaggagaatcgcttgaacccatgaggcggaggttgcagtgagccaagattgcatcactgcactccagcctgggtaacagaacgagactccatctcagattaaaaaaaaatatatatatatatcactagcccttctcccaaataaatgtgggatcatacccaaatgctttcattcacagaaaagacttcctttcttctcactagagtgatgtaatcaggaacttcagctgtattaccaacatgtagaacagttcaaaccattatagtatgcaaccaacaaagatttgtttattttacacattctcagcactgtagatacaaagatgaatgagatgtcatgcagttcttcaaaagttttctatccgactgtgggaaagtattacaaagccaaataattatgtatataataatagagttgacacgaagtgctgagtccacttaagagcgagagattatagttcccttttttatatggtggcatgagcctatagtcccagctacttggaagtctgaggtatcagattcgcttgagcccaggagtttgattccagcctgggtaacatagtgaaaccccagttttttgttttttggctttttttcctttgagacggagttttgctcctgttgcccaggctggagtgcaacagcgcgatcttggctcactgcaacatctgcctcccgggttcaagcaattctcctgcctcagccccccagatagctgggattataggcacgtgccaccatgcccagcttatttttgtatttttagtagagacaggatttcaccatgttggccaggctggtctggaactcctgacctcagatgatccaccctcctgggcctcccaaagtgctgggattacaggcgtgagccactgcactgagccgtgaaaccccatttctttaaaaaaagttgtggggattacatgagggaatccttgacgcttaaatagtgcttggcagatggcactgaattaacagtattaacaaaggtacacatatcattatagttactattacaagatttatgggggttttttttgtttgtttttttttgttgttgttgttgagacggaatctcgttctgtcgccaagctggagtgcaatggcaatcttggctcactgcaacctccgactcccgggttcaagcgattctcctgcctcagcctcccaagtagctgggattacaggcgtgtgccaccacaccggcggctaatttttgtatttttagtagagatggggtttcaccgtgttggccagggtggtctcaatctcctgacctcatgatctgcctgccttggcctcctaaagtgttgggattacaggcgtgagccaccgcgcccggcgaattatggggttttcattttatttttaagcttctaaagatttatggtcttaatgttgactaaatttattggagacatccatcctatcatctattaattctaaaacctaagcatacttgcactataacattatgttaattaaatgttgataaatacattttatctataagactgtacactatcagtgtataaattgataaaatattaagagaaattattataagggtttcaacataagatagctattgctatttttgtcttttatcatttactaacttagccagccttttaaaaaaaatcttacaaaaggtttggtgggtgtaacggtagtgtgttcatactgcgcagttctttttcagatgtctagtattaagaacacattaaatcaaggttggttttcttggactcctatggaaattttcatttctattcattattgaacatgtatttaaacaccaattcctggagctctctcttgtcacttgtgacttgtaatttactgacagtgattgagatgattgtcaatttgttgagtaacaaaatatgtcattgttataaaagtacttatattatgacttggcagaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaagtaagtcaacttgttacatgtggatccatttcattgaacaaatctgttgtagtttctgcctgccctttaaaggaagagtttggaggatatcaaacccagactagaaaaggctggttaggcaaagtaaccaaaattatttctaaggttgccatagtttctgagtattctttattcatcctgttattttacatttagattgtaattttggaagattataggaaaataatgtagttcaaaaaagtatacagtgacagtgcctctttgctacttctgattcccaatctcccagctttcctcagaagtaaccactcttacgtgtatacctgtttgttgtatgttattatttgtgtgtatccttttttcctgcccaaacctatacttaacgtgttaagagtatattagcatttatggcatatgatcttataattctttttttcctatattctgtgatgtgttaactaatttaatctattattactaaattagcactttcggcataatcaaatttttagctttaaacaactaatttaaccttgagatttttgaattatatatgcctaggattctggagccacgtacactgttaaatattccaagaaaagtccactgttcctataatgtgtcattgtatgtggctccagaatactaggttctggttggtttttaccatcatttacttggatttcaacaaggtatagcatttgtgttttaccatccacgttaagaaattaaatttcccctgtatttgaaacatcttttcctctcagagttaattgctgttatatatcatttcctatgcactgggaactgatgaatatattttttgatagaatacattatctgataaccaaggatttgagtcttctaagcccatgacaaggcagttttgatgcaaggttacagaagcacaaagtgctggtttctgagctacatggcagcaagaactgattgaggtgccaaacttgttgtttctgtgccttgtactttgtagacagacaccacatgtcagtccctaaagaatggttcctaacacggggcccatgtaccacagtagccttgatgattttcaagttgctttagctctgaatcttttaagatggttgggttagctttattcctgaagtctccctggtttgttacttactatataagaactagttaggctgagtccttatttgctggagagatggatcgtaagaatgattagagtttttggagccataaagataagctgtagttaatttttattcctatatctgttgtttcacaaatatggtaattttaaaaattattgggagaatataaaatagatcagaatttcagtattgcctcgggatggagtaggaggaatagtgtagaacggagctaccaagcctctcttattcatgttgtttttcccttgtttttattttttgatagctattcaaaatcgtaatcctgtgtggtatcaggcactgactcacggtcttaatgaagaacaaagaaaacagttacaggacatagcaactctggctgatcaaagaagagcagcccatggtatgttaattaactgtaactcctctttaattagtgacttttataggtttaaaattttatatcgtttaattttatatcattaaattttatcatttaagatgatataaaaggtatagttgttgcaggtgataggaattaactctaatctgagggatttaattcaagataacttaattttggctttggctacagttggcttttttcgtttttttttgtttgtttgtttgtttgtttgagatggcgtcttgctctgtcgcccaggctgtagtgcagtgatgcgatgtcagctcactgcaagctctacctcccgggttcatgccattctcctgcctcagcctcccaagtagctgggactacaggcacctgccactacacctggctaattttttgtatttttagtagagacagggtttcactgtgttagccaggatggtatcaatctcctgacctcatgacccgcccgcctcggcctcccaaactgctgagattacaggcgtgagccaccacacccagccccagtttgtttatttttaagtataattgggccaggtgtggtggctcatgcctgtaattccagcactttgggaggccacggtgggtggattgcctgagctcgggagtttgagaccagcctgggcaacatgaccaaactctgtctctactaaaatacaaaaaactagccaggcatggtggcacatgcctatattcccagctactcaggaggctgaggcaggaaaattgcttgaacctaggaggcggaggttgcagtgagttgagattgcaccactgttctccatcctgggcaacagaacgagactccatctccaaaaaaacagaaacaaaaaaaactagagaacacagccagacatggtggcgcatgcttgtaatcccagctacttgggaggctggggcaggcaagtccttgaacccaggaggcagaggttgcagtgagccgacatcacgccattgcactgcagcctgggtgacaagagcaaaagtctgtctcaaaaaaacaaaaaaaagtacagttgaagactactttcagtttgcaataactttagctcatggtgatggttagatagtagaaagttctgttaaaaatgtaaacacctaagccgggcgcagtggctcacacctgtaatcccagcactttgggaggctgaggcgggtggatcacctgaggtttagagttcgagaccagcctgaccaacgtggagaaaccccatctctactgcaaatacaaaattagccaggcgtggtaggcatgcctgtaatcccagctactcgggaggctgaggcaggagaattgcttgaacccgggaggtggaggttgcggtgagccgaggtcgcgccattgcactccagcctgggcaacaagagcgaaactccgtctcaaaaaaaaaaaaaaaaaatttaaacacttggccaggcgtggtggctcatgcctgtaatcccagcactttgggaggccaagacaggagggttgcttgagtttggaagttgaagtccagcctgggcaacatagtgagacatcatctctacaaaaaataaaattagccaggcatggtggtgcatgcctgtagtcccagctacttgggaggctgaggctggaggatcacttgaatgtgggaggtgtaggttatagtgagccattattgtgccactgtactctagcctgggtgccagagtgagaccccgtctccaaaaatgtaaaaacttacgaagttaaatagctcccagacatatcttttcatctttaaatgtttcagtgtgcaatttttaaaagtacattttaagccaggcgcggtggctcacgcctataatcccagcactttgggaggctgaggctggcggattacttgaggtcaggagttcgagagcagcctggccaacatacagtgaaaccctgtctttactaaaaaacacaaaaattagctggacatggtggtgcacacctgtagtcccagctacttgggaagcagaggcaggagaatcgctcgaacctgggaggcagaggttgcagtgagccaacattgcgccactgcactccagcctgggtgacagagtgaaactctgtctctaaaaaaaaaaataaaaacaaacaaaagtacattttaggttatacaccattgttaatgcaaacaattatctatagacttttttttataaattaaaaaaattattttatttatttgtttgagtgacactgtcacccaggctggagtgcagtggtgcaatctcggctcactgccacctccatctcccgatttcaagtgattctcgtgcctcagcttccgagtagctgagattgcaggcacgcaccaccacacccaactaatttttgtatttttagtagagacgaggtttcactatgttggccaggctggtctcaaaaactcctgactcctgaggcggatggatcacttgaggtcgggagttctagaccaacctggccaacatggtgaaaccctgcctctactaaaaatacaaaaaattacccgggcgtggtggcacgcacttgtagtcccagctactcgggaggctaaggcaggagagaatcgcttgcacctgggaggcagagattgcagtgagccaagatcgtgccgctgcactccagcctgggtgacagagccagactctgtctcaaaaaaaaaaaaaaaaaaagatttttttcttaacagtgggaagtgaaaattggctaagaagtctacagcatacagtaaaagagattatattctctacataatgcatgctcccttgcccttatacattggagaaatcatggattttggaacttcctggccactaatgatggttaagctactggcttgtttaatgttttgtcagtttctcaccaagttagtagatgattgaatgccctactaaaattttatttgttttctagaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgtattaagatagtgactgctatactcaactctggaagagactagagtatagagcatgagtggcaaaaccacagcccttgggccatatgctgctattcagtcccagatgtagcccctgaagcaagcataaagaaaaatgaattaaaaattaaattaatatggaaagttaaaaaatggattacattagtatgactaaaccatgtctttggcaaagatctaacacaatgtcttaagtataataggtagtctctgtttgtaaaataaatgacttaaatttaaaacatcagttataaaactgtcagttctgttctttgtaatttaaattttggtaaagattttctgtgaccatttatcagtgcctactgaattctagcttttatccttggtgagttggccattcttgcaatagccacttcacactttggctcatggtaaacaaaggttacctggaaagtgctcttggagatagtactggcatctctcaattgggggagttacctaaatcagacctgcaaattagagaaggctaggataatagattctttaacataaacagttaacattttaagttgacctggcaatccaaaaactagcattagcagaagcagtatgcttctccaaaggtcttctagacccaggctgtaactcagctaactgaagtgatccaatactgttctaggcccttcatcctttgtatgtagtattaccactgaatagatttgtatgtagtattatgactgcataaaacaaacaatggggacagatatatccctttcctttaaggaccaatacagtaggctgtactcattgttgccccttatataaagggtcaaaacatattcttatgaccatgcatatcaaaagaagctggacaatgtggttcttaagctaggcaaaatctttggttttagcactataggagaaatatataagttcttgtgtgtgtgtgtgtctgtgtgaggtagtcatccccactccaggtgtttttttggtggtggtggtggttttttttttttttttccctgagatggagtcttactctgtcacccagggtggagtgcagtggcacgatcttcgctcactgcaacctctgccatccaagttcaagtgattctcctgcctcagcctcctgagtagctgggattacaggtgcctgccactgcacctggctaatttttctatttttagtagagaaggggtttcatcatctcagccaggctggtctggaactcctgacctcgtgatccacccacctcggcctcccaagtgctgggattataggcgtgagccactgcgcccggccccctccaggtgttaaggcacaggtgagaattctcctttatatatttatagatgctgggccaggcacggtggcttatgcctgtaatccaagcactttggaaggctaaggccggaggatcacttgagcccaggagtgcaggactagcctaggcaatacagcaagaccctgtcttaaaaaataataataggctgggcatggtggctgattcctgtaatcccagcactttgggaggctgaggctggcagattacctgaggccaggagttcaagaccagcctggccaacgtggtgaaaccccatctctactaaaaatacaaaaattagctgggcgtggtggcgcatgcctgtaatcccagctactcagaaggctgaggcaggagaattgcttcaccctgggagacgggggttgcagtgagccaagattgcaccactgcactccaacctgggcgacagagtaagacctgtctcagaaaaaaaaaaaataatagattctactttcatatataaattgggatttgtcaattacatacaatatttgagctctataactaccagagccttttttttttttttttggagacggaatctcgctcttgttgcccaggcaggggtgcaatggcatgatctcggctcacctcaacctctgcctcccgggttcaagagactctcctgcctcagcctccccattaactgggattacaggcatgtgccaccacatccagctaagttttgtaattttagtagagacggggtttctccatgttggtcaggctggtctcaaactcccaacctcaggtgatctgaccacctcggtttcccaaagtgttgggattacaggtgtgtgccaccgcacccagtctaccggagcattttaaggtttctttctgaatcttttttttaaacaaatccaagaaactagaaaaaggaacttccttaatgtgataaaacgcatctaacaaaactataaagctaatagacttgatagtgaaagaaaaatgttctaccaaagacga

SEQ ID NO: 13778 - DNA, 18857 bp, Human
tgtttcaagaaaaattcagcttgagtttatttagcctttgaaaagcattagaacaacatatatgacaaagtgttaatatgcataaagtgctaacaataagaaaaataggcaatagagataaatgtaaattatcattaaacccatgacaactgttcaacaatatgaatcaaaacaacaaaaccacatcaacgaacatccactgatgtcctgaattcacagagtgtgctctaatccactgctagtgagaatgtattgtgtttctggagggggagtttgccagtttatatcctttgactgaggaattctaactccagggaggtatccaaaagagtattttaaaaaggccaggcgcggtggctcacgcctgtaatcctagcactttgggaggccgaggcgggcagatcacctgaggtcaggagtttgagaccagcctgccaacatggtgaaactccgtattttgcattttgtaaaaatacaaaaattggccaggcctggtatgtgcttgtaataccagctacccgggagacaggagaatcgctggaacccgagaacccgggaggtgggggctgcagtgagccgagatcgcgccactgcactccagcctggggcgacagagcgagactccgtgtcgaaaaaaaccaaaccaaacaaaaaacatggagaaggaagcatatacaccacggggttgtttacaacagaaaactggaagaggccgggagcggtggttcacgtctgtaattccagcactttgagaggccgaggcgggcggatcacttgagatcaggagttggagaccagcctggccaacattgggaagttcgtctctactaaaaatacaaaaattagccaggtgtggtggcagccgcctgtaatcccagctactcgggtggctgaggcatgagaatcgcttgaactctaaaggcggaggttgcaggttgtagtgagccgagatcgtgccactgcactccagcctgggtgacagagcaagaccccgtctcagaaaaaaaaaaaaaataaataaacaaagaaagaaaaaagaaaactggaagaaacgtgtaagtgcattaagggacagattaaatcagtttaacgaagcactagggaaattttttaaaattgcgtttgagtttgccgcgagccgggccaatcggttttgccaacgcatgcccacgtgctggcgaacaaatgtaaacacggagatcgtgtgccgggcacttggtttcgtggtgggcaactgtgctgctgtttcttttggccgcggacaaggtcggcagaggtggacccctgcttgggagagctcttctcgctgtgctgacacccgcccctaacagtcacccaccccggggaaataatggggctcggaggcctcctcccagccagtgtccagcctaagcacatcggctcccgcagttcagaaaggtcccgaggcccgagtcaccatttccggctcagacctcgacccggaacgtggctgcccactgccacgcccactacgccccagtggctcgccccaggggacgaggggcaagaagcggcctccgagggcagcggccgaaggccattcggtccctggctcttcccagctcgcagagacccggaagcgctgcccggccgcctgcccctcttcagatcccccagcaccggaggagcagcgagggggctgcgtccaggccggctttcgggtcggcttaggcgaatccagctctcttttgcccctcccagaaggcccagccccgtccgggcggtgttcgggcggcgccgggccgggccccccgccgccccaggctcgctcataggcccggaacaccacagcccgcccagacttggctggcgccgagccgggggtggagccagcgggttcccgccaaaatcgcgtagctggtccttcccccgcgggctacgtcgcgccctcctttttttttcaaacccggagctgcactgggattggtggactgggcactcacgtggttaacggtcgcgggaagccgcggagcccgaacctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaaggtgagagcggcgggcgcgggcacccggcggccggggccgcggcgccggaggggccagcgccgctgcctgggttcggttacagaagcggccggccgctcccccctcgctttcctgcgccgccccccaaagttggcagcccttgtgtttggccctgccccgaggttgtccgttgagattatgtaactgaacaatgggcctcgtctggaacttcatcttacaaaggggccgatcggcccgtccgggtggccaaggatttgccgcccgttgagtccgggccgccccgagcgtgtcagccccgagtgcggcaccgataacgcggttcgcgaggatgctggagggtgccggcccggccacctgacactcccgagccataggatgccttttaaacgcggcgatcgggcctgtaatttgggcggcgcgggcagaaggagtttaaagaaaaataattgtcccgccctgatcgtgtcgtgtcgtgtggcgtggatgggggaaaggtctggggcatgcagggagactacgcttggacttgggagtaaaggctggccttccaagcatttacagtcctacagactcatcctaagtccaggcagtactgaggcctgtttctggacaaggtcttggcccagcatttgtttttatcgtgggtttgcggtgcccagagtttggccggcctccgtgtgattaggaacatcctaccgtagataaggtatcttaaagaaggaggtgttcagcacctgtgttttgaaaggccttcgagtactgcgcagatgaccacttttaaaactgcagattttaaagctgatacttccagagattaagacaagcctcgcatttgtaaggttaacagggaagatgcaccttttaaagtgagtttgttttgttttcaatgtactgtttgtcatcagcctaggcaatctgtgtgctttcgagctgtactgtttattggccgacttgctcaaggcaaaatccctctggaagtgaggggaggagtccagcggaggtggctatggaagccctatctagatgggggaggggagattttatggggctctcggactgctttctatttttggatgggttgaaagaatttgttaacttttagccactagaatgaacttagttttaggcagcatttatattctttttagggttagaggcagattttacttggctatttttttcaagaaaagatagttaatatccagcttcagtcttcctaaattagccacaatttattttgcttgaactctaacaaaggcttgtgtgttgctttcacctacgcattcagccctatgaaaggctcgttgaaggttaggttgagaaggctgactataggacttggatcctaaaaattgtatttgtatttttctttccctagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgagtaagtcgtttatttaacagtttggttctccaaataacctaagattggtttggtatacttatcaaaatttagttcctatttaatggcatggatgtatctgtcagatatattgatagaaaaataacattttttttagttcctgtggtgaagacatggaagccagtgattatgagcttgaagatgaaacaagacctgctaaggtaaatagctttttatttttatttttttgaaatttacttttctgccacttaaagcatgctatgaatatgttaataagcattaacacataaggtagaatggtttttaaatttcacacatagccctatcaccatagcaagaaataactgttttcgtatatttgtattacatatatggaaacactttttattacagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagtatgtattaaacattttgtcttttgctcttttgtcccctatggtgttactaacattaaggtttcagctggtcaaacactgaattccatctctaacttttgagaagctgtaatgatttaatcaggtccttttcacttaataccatcagttcttattggacttgttgaataatatgagtctgattttggaacctaacttaaatttcttatttctagtcagcatccatgaattcacagtaaaatggagtttattcttacctgagtcctagggcaagcaacatttcttctttctgataaatctttaatggaatctgcctttggaaaaatctcttacaagtctaaaccccttctctcttaagcaagttgctttttagcataacaatagataccaaaaatttattgtatgaagtttcagataaattaattcagtttaagcttgagtgaaaattatttaccattctattaatctcaaatttcttctaggcagaacgctttgagagaagtatatgctcatgcagtgcttggacagcattctcatgtagttcgatatttctctgcgtgggcagaagatgatcatatgcttatacagaatgaatattgtaatggtgagtgatgtaatggttttcttgtgagcttgagaaaatgaacatcgaggaaatatttatggttatctaaaatcttgctctatttctgtcacttttatcttttataaatttaaagatcagagacctaacataaatttcaagtacaaggttaaaaaccttgtcctttctgaagcaccttgtacatatctcagtagtagaacttcgcatactatttatgtgcttgtcgctccaactgagctttttgacaagactatggcctcgacacatatattttggtgtccgtagtacctagcgtagtgtgtgaagcatatagtattatgaagtgttaagttgaatagattcttcctgtgtctggtctttgatttccatttcatgtgaggtgctgctaaaactgatgtttgttagtcactgagtctctgttgatctaaattcagctgtttctttaagcattctgtagtccggccctactcccacgtatccaacctagtctaccctagaatccactaacgctttattatgttacattcttttagttctctagcttgtcgtctctccctcctctcccctaaggatgaaacaaaacaggcatgtatagattcaagtttggatgtcttgtatagctttcagtttcggtaagtccttcaagggccgacttatgtctctccttttctattaaaaacctttaccaaagtcttggtcagaattctggttcttatggacgtctgtcattattatataccaaatcttttatggattatttctcaacacttttgtagtttataagtgtgatgattgggttttcatactcaagtgtgaaatgtgcctccctcaaaccttgttacgacatcagcacattaccagtctgaaatgaaaaatatctgtagtttgtttctatttctgtatatcttctgtgaatatagacaatttagagtttagtgaacacttgagaggagataacaaaatttatttttgttgattcttattattccttaaataaacaagaccagttatctcataacttgtaaataaataagtggtgtaggtatggattcaggttccccatatttaaaaacagtgaacaaaacagaagtaaaagatccatttttcaaacctgattcctcattatttaataaagttctccacacttgaaagaacttgagtgtctagtatacagccttgctgctagtttttttcacacagctcttgaaatgtttctattcataccatcaaaatatttatgtaactatcacaaccttatggattattctatttcttaaccttcatttttcaggtattgcatttaacctagaacaacttgaccacaatgtcgtctccatttgatatttgctagacaccatctcttttcagtttccttctttctctttctcaccttcttgatgtgaataattctcttaacagaatagttcattagtagtccaggaatgtcaaatatgtagcaacctaccaatacatggttgtgtaaatcagatgattctgagaaaactcacgtgggcctgggagatagggaactgagtgagtagtcttgctaccctctcagattacaaaaaccttgtcctgtaatgttagattataaaataatctattgaaaataagtttttatttatttatttatttatttatttatttatttatttttgagacagagccttgctctgtcgcccaggctggagtgcagtggcgcaatctctgctcactgcaacctttgcctccagggttcaagcgattctcctgcctcagccttttgagtagctgggattacagatgcgcgccaccactcccagctaatttttgtatttttagtagagatggggtttcaccatgttggccaggctggtcttgaaccctgacctcgtgatccacctgcctcggcctcttaaagcaatataaaactcttgaagaaaataaatagtcctgcatgaaacaggactgcctctttgtgtggctatttgtcctacttagataaaagaaaatacgactatctggatgcatttgtgatctcttttgtttcctgtgtccaccgttcctctctccacataaagctttgaatataccaatagggctcatcttcacatcttttccacagtttcactggaaaaggattctgatatttatttgtacatgagtaactgattccctttattgtgatttaatttccttattatcttattcatttgcattataagccttttatcttggtttggtgatagattggaattaacctgtataaacaagtgtagaaaaatattgatggatagggaaagagaacctgaaatgtcagaacctgttttgctctcatcacctttcttgcccttctagcaatgagagaagaaatgggcacagctatggttgctggacctgctaaaaaagagaattagccatattctttcttagcacatttgatctaggacttagcctatcttgtctgacagcgttattggtttgctcccttctagagcactctttcccctccctcagttcaagatttgtacaagtaaggagaacatacttaagactaagataccgagatgtataatttattttaaaaacacatttgacgttatgttattttcttatttaaattataggacctccttttctgactaatacatcattgaccttcctaattttagtacccagctctgatttttttattcctaagccttaaacaggagatatttaaaacaattcctcattgcctttgagatgaaatacaaactttaaaagtttgaaaaaatataaacaaattaactgattgatttaactaattctataaaagcaggttatggtctcattcatagtaagagtagtataaattataactatactaaaatactgtctttttacctataacatttatagacttgtcaagggtatggggaaacaggtatgctcatgcattgacaatgggcatatatattggtacagccttctctgtggagaagagtgtgtgtgtgtgtgtgtgtgtgtgtaaaacacaccatctccatatattacaaatgtgcataccctttaacccagcaatttggcttctaggtgatatactaaatgtacgtgaaattaccaatgtacaaggttatttattaggccatagtatgtaatagcaaaggcttggaaataattttaaaatgtccatcaaatgagggactgataaatgcatttctttctttctttctttttttttttttttttcgggggactgagtctcactctgccaccaggctggagtgcaatggcccgacatcggctcactgcaacctccgcctcccaggttcaagcaattctcctgccttctgagtagctgggattacaggtgcacgccaccacacccagctaatttttgtatttttagtagaaacggggtttcgccatgttggcctgcatggtctcgaactcctgacctcgtgatctacctgcctcggcctcccatagtgctgggattacaggcgtgagccactgtgcccagccaataaatgcatttctactcaattatacaatggaattctataaagacaagaagaaatgggttgtctttgtatattggtatagagtgatctttaagataatgaacatatgctgttatttatgcaaaaagttgaaaagaatacatagacctgagctgggcgtggtggcagtgcctgtagtcccagctgcttgggagtctgaagcagggaatttgaatttgggtttgggaattctaggctgtagtgccgatctatgttgagcatctatgccgatctatgccgatctaagttgagcatcagtatggtgacctctgtggagtggggcaccaccaggttgcctaaagaggggtaaactggcctaagttggaaacagcacaagtcaaaactcctatgctgataagtagtgggatcaagcctgtgaatagccactggattccagctgggcaacatagatagaccctgtctcttataaattaaaaacaaaaacaaacaaaaaaaaagccaacctgataatactggtttactctgagaaagaaacaggtggattgctgaggtgtatgattgagagagagactttacattttattttgtacccatgcaaatgtattacctattgaaaaaacaataaaattttgatttcacaagcaggttgaagggagaaggtcctataaaataacactttcttggttgagattggttggttgagactcatttggtaaagatggaagaaagaaaatatttcagaaagaagaaaatgctaatattttctatctttgttaggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaagtattgcagatcttctgacctgtgttctttggggttatagagaataaattacttcattatgacaacattgaaaaaatatatatcttctgttttctcattgttagttttaaaaggccttagatccacttaccaatattgttttatgatttctattcatctcttcccttgttaatccccaaaatttgagataaacttttttgagacagtgtctcattctgtggcccaggccggaatgcagtggcaccatctccgctcactgcaacttccccatcccgtgctcaagcagtcatcccacctcagtcttccgagtagccgggactataggcatgtgccaccatgcccagataaattcatttttattaaaagccagaaatttttgctgcatcttacaggaactacaggtgggatactaatgagggcactaaaaatctgtgtttaaagccccactcttccactaggccagaccatattaaaatttccccagttgactcaagtccttaatagttgatttgttcaaattagtatctacttaaggatcatgcattgcatctggttatatcagtttttctttttcagaacccatcctctgctttgtaaaaataatatacacttatcttgcaagctatccctttttctggatttgactagttgcttcttgtatcatttagcttgttcctttttctcctatatttcctataaattggaagttataactaaggattatggattcaagttaagcatcttaggctagatgaatttagtgaggttttattaatctttggaaacctgttgatttgtgagaatttcagtcattttgtacaactttatgagttatatgctagaatttcatatgcgtatgttaacaagtcactaaagtttcttctttctttttttctttttttgagatggagtctcgctctgttgcccaggctggagtgcagtggcacagtctcagctctctgtaacctctgcctcccatgttcaagcgattctcctgcctccgcctcccgagtagctgggattacaggcatacaccaccatgcccggctaattttttgtatttttagtagagacgggtttcaccatgttggctaagctggtcttgaactcctgaccttgtgatctgcccaccatggcctcccaaagtgctgagattacaggcgtaagccaccgtgcccagcatgttttttattttcaaaagacaaaaatatatttggatttaaggcagtaaatgtgaattcttaaggaatagctgtactcatataaagtgttagacaaatataatagacccttataaggtataaaagttgaaaatattaagggatgtgaagtttaaaaatcttcaaatttagaccaggtgcagtggctgacgcctgtaatcccagcactctggcaggccaaggcaggcagatcacgaggcaggagttcgagaccagcctggccaatatgatgaaaccccgtctctactaaaattacaaaaattagccaggtgtagtggtgcgcacctatagtcctagttactcgggaggctgaggcagaagaattgcttgaacccgggaggcggaggttgcagtgagccgagattgcaccattgcactccatcctaggcaacaaagtgagactccgtctcaaaaaaagaaaaaaaaaattcgccgggcgtggtggctcacgcctgtaatcccagcactttgggaggctgaggcgggtggattgcctaagcttgggagttcaccaccagcctggacaacacggtgaaacctcgtctctactaaaatacaaaaaattagctgggtgtggtggcaggcacctgtagtcccagctactctggaggctgaggcaggagaattgcttgaacccgggaggaggaagttgaagtgagctgagatcgcaccactgcactccagcctgggcgacagagcgagactgtctcaaaaaaaaaaaaaaaaaccttccaatttacaaataccatcacaaaataagttgtcctataaagaaagtaaaacgtatagatgactccagtaaatgtaacataaatttaatactaaatatttgtgcgtgtgtgtgcgtgcacgcacgcacacacacacacacatatatatatatacacttttttttttcttttgagacagggtcttgctctgttgcccaggctggagtgcagtagtgcgatctcggctcactgcaacctctgcctcctgggttcaagcgattctcctgcctcagcctccctagtggctggtattacaggcgtgcaccaccatgcctagttaatttttgtatttttagtagagatggggttttgtcatgctggccatgctggtcttgaacttctgacctcaagtgatctgcccaccttggcctcccaaagtgctgggattacaggtgtgagccaccactcccggccttattttttagagatagtctcactctgttgcccaggctagaatgcagtggtgcaattatagctcactgcagctttgaattcctgggctcaaatgaacctcctgcctcagactcacaagtagctgggactacaggcatgcaccaccattcccagctattttaatttttttctttttctttttgtagagacagggtctcactatcttgcccaggctggtctcgaattccaagtcttaggtaatcctcctacctcagcctttcaaagcactgggattacaggcttgagccaccatacctggccaatactatactgataaaactattaaaatagaatctgccactaaaagctcatgttaattatgatcttacctgaatttgaagaaaaaaggtaatgtgtatacaataggaaatagtgaatcacaaagccatattgcaaggtagatgctatatggtcagccagactcactggctaaatgactcattctgctcacaccagccttatagcgctacattaaaacttgtgctttcacagaatttcacaaattactgatactaccttttttgctgaagggtaatgtgctagaagacaagggcctcatccagtttaaagtgtttaggatcagtgctaggctggaaaatatattcccagaggcccagagtggtggctcctgcctgtaatcccagcactttgggaggctgaagctggaggatcacttgaggccaggagtttgatcagcctggccaacatagtgaaaccccgtctctactaaaaatataaaagttagctagatgtggcatgtgcctgtagtcccagctactcaggaggttgaatgaagcatgagaattgcttgaaccttgttgcagtgagccaagatcatgccactgcactccagcttgggtgacagagcacactgtctcaaaaaaaaacaaaaaaaattcccagcaactataaccctggtttctgtcccctgagatgcttattccatgggtttgggctagaacttgagaatcggcattttaaaaagcattatggatgattctggtatatgatcttgtttatgaactctggttttattattattagtttggcttacataattaactgtttgacaggtaatattttcatatctcgaacctcaatcccaaatgctgcctctgaagaaggagacgaagatgattgggcatccaacaaagttatgtttaaaataggtaagaaaggtaatcagattattaccttcagataaagagaaggctgttttgtttttgctcttcactgtaagtttttcaatacttctaggtgatcttgggcatgtaacaaggatctccagtccacaagttgaagagggcgatagtcgttttcttgcaaatgaagttttacaggaggtaatttttcttctcccttaatcatagtttgctttgtaacacttagcagttgatagaagaatataaattcagatatattaaactttgaagttaactaatagaatggaaataaaatctaaaccgtcatctgagggcatttaataagcaaaaagtcatgaaggcaaagatttataatggagttgtcgtaaaaaatatgttctcatacaccactggtggaactttataatggcatatcctttttggagatcagagtattagtattgcattaatatttaaaaatcatgtacccattgactcataattttcacttctaggagtttttcctatagaactattcatatacaaatacaagttgagaacagtgtaaataagtgtttactaataagagaatgattaagtaaattatggcacatagttattagtatggcctatagtttcaaaagagtgtgacagtatttcttgataaaaattttgaatgaaaatagaataagtagaaaaatataaagtgtaattgtctgatcccattgctctttgtaaatatgtgtatatatatgtttgctttatcacgtatatgtgtatttgtaacttgtcagtgtgtttctacgtgttttgtgtttgcatatgaatgcctagaggtagagggatttcttttgagagttgaattgggctgttgataaagaagaggcatttactcttatctatgtgtttgcatttttcccccaagagtgtgtattactttgtaatttaaaaaataaacatcctcaaatttagcagtttattctctgaataggtcccaaacttaaatgtggtattagacactttgattaagtcctatttttcacctaagtcatctttgaggtgtaatcttgttttattttgaccatgtttacattcctttaaaaaattgttttaattttacagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagtgagcattttatatatgaagccctttattgacatggttctatattttattaaatgcatgtctttaccttcattttacttttctttttaaggttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaagtaagtgagggttttatgttttctttttgctttttcattcactttaattctcaaattttaatgagagatgatttaagctttctgtcaacaaaggatgtagtggttttttgtgttttttgttttttgagacagggtctcactgtcatcaggctggagtgcactggtgctatcatgactcattgcaacctccacctcctgggctcaagctatcctcccgtgtcagcctcctgagtagctgagccacagatgcatgccacaacacccagctaatttttatattttttgtagagatggggtttttgccatgttgcccaggctggtcttgaactcctgggctcaaaccatccacctgtcttggcctcccaaagtgctgggattataggagtgagccacctcacccggctccagtagttcgatatgttgttatacggtgaaagcttggggacttctgccatgaattagtatttggcctattaaatttgtgttgtttctaaactttcaaattacgaactttaaaaatgttgagactaacatatatttgcaagtggtgatagtccccaagccataaatggtagtaaaagctaagcgagcctataccaatcttttcttcccagactctcaccaaaagttaacgttgtccttgaaacattctgttcttattttatgaaaggatgaaattaatgtcaatttggttaggagatgattctcatatatatgtttttaatttctggctaaatctttatatactgaatgaagattctcatattggacttaatgacttgatattttcaaaaagctggttgcaatggtaaaggttattaaaaagagaatattggagaatattaagttaccacagatcacatttctaattcttttgatttattgcagccattttgcttttaacctaataaaactgacttgaaaaggttatgttaacaattaatattaacatttaatatttaaattataagaattgtatattaagaggtttacttgccactagtttgatatccatcatagttcatacaaataggaaataaagtgttcctttcatctctcttatgtaaggatagattcgcaatataaattggagtttttgaaattattatttatttttaatttttttttattggggataggtttgtctggaaattgtttattattatttatttaaaaagatggggtcttgctctgtcacccaggctggagtgcagtggcactatcatagctcactgcagcctcaaactcctgggcccaagcgatcctccagcctcagcttcccgagtagctgagactacaggtgtgagtcaccacatccagctcaaattattttataagaaccaaagtcattactagcatctttactacttgttttcaagtatgtgtgatactgtaattcaaaaagcataaaataaaataatttcataaatttaagttgttttaatagaagcttcagtttcctgttttatttttcaattacatcttagaataatgatggcatgcaaatatctcccaatcgacaatatagtttgtgttagtttcttagaatctcttcctaggaataataccttgttttctatttttatgtcagagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgcctttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagcttaccttaattgtctaaatccttgtgatgcctgttttctaatattttatctctattattgctatactataaaatgtatagtgtgtataatgtactattataaaagcagagggcacattttgattgaatatgaatatcacattgcatgttatgcatgtgacttgctagaaatgtagcatgatgtaatttaaaatatcttcaaattattaagtgaatataatatgattcataactttctgatttgtactgagtcacagaaaactttaaagtggggaggttttgtttttgtttttaagatggagtcttgctctgttacccaggctggagtacagtggcgcgatctcggctcaatgcaacctccgccccctgggatcaagcgattctcctgcctcagcctcctgtgtagctgggactgcaggcatgcaccaccacacccagctaattttttgtatttttagtagagacggggtttcactaagttggccaggctggtctcgaactcctgacctcaggtgatctgcctgccttggcctcccaaagtgctgggattacaggcgcctggcccttaaagtgtggaggattttaattctcactaaactaggctgggttttaagatttgaggccaggcgtcttggctcacgcctgtaatccccaccactttgggaggccaaggcaggaggattgcttggggccaggagtttgagaccaacctgggcaacacagtgagaccctatctctacaaaaaacaaaaaagaattgagtgcaaattgaagtgataatgttatttctatggcatcgttttctgatgttgattagaaccagagatggagtctcattgttgcttaggctggtctt

SEQ ID NO: 13779 - DNA, 60593 bp, Human
ctccacctcccgggttcaggcagttttcctgcctcagcctcccaagtagctgggattacaggcgtgcaccaccactcccagctaatttttgtatttttagtagtgacggggtttcaccttgttggtcaggctgatatggaactcctgacctcaggtgatccacccaccctggcctcccaaagtgctgggattacaggcatgagccaccgcgtgcagcccacaggtcttaacagtagggtactggtgttactttgagtcttctctgccagcttttggaggtgccaaggaaatgacgtttcagcttgttctatgaacagttatagattatggatccttttgtacctaaaaggtcaccccttgactttttctttaaatgtgcgtgccaccacatccagctaattttttaatatttttagtagagacagggtttcaccatgttgaccaggctggtctcgaactcctgacctcaggtgatccacctgctttggcctttcagagtgctgtgaatccaggtgtgagccactgcacccagccttgactgacagttatcatggcactgatacctttttgtgtatctgaacagtagttcccacttttggtctaatgaaggtacggtttatagtatttccaagacaaaattcttcaagcaatcctaaacgtaaaaagaattacaaattattactactatctgtgtattgctcttttaaatattgatgctaagtcagatctttggacctggaaaggtcctcaagacatcttctggttcagttccctgtcccaaggcagctacattatcccagctactgtttgagataagccatggtccacagaggtaaggagacctggaggtagaagggaagaaggaggttgtgttggtgattggtagaagagttgcccattcatccatttattctgtacctattgtacttctactatgggccaagcactttctaggcactagagtcagcagtgagcaaacaaacagaagtctctgtccattctcatggaaggggaaatagataaactaaatacataaatacatgtaatttgttaaataataagtactgtgcagaaacatggaggggaaaagaaggatggggtttaccatgattgagcagttgggaggtgcagtttgaaatgggatggacagggaagctctcattccatttgagcaaagacttgaagagggtagggaatgaataatgaagatactggggacaatgtttcaggcagaaggaaactcaaatgaacacgttctaaggcagcagaacatccaatatgcttgaggaaaatgccaatgtggctgaagtggagtgaatgagatggtgagtagtaggaaatgaggggcaagatcattggcctcattgatcagtgtaaggatttggggattttactctgagaaagtcctcagaaggttttgagcagaagcgggacatgagctaacttttcccttcaaaggacactgaccgctgtgtcaaaagaagagtgtaggaggctaatggagaagcagggaaataagttaggatgctgttatagtaatgcaggtgagagactggttgtggcttagatcagggaagtactggtgaaggttgtgagaggtagccagattcggggtagatttctgaagattaagtcaacaaaatatgctgacacattgtaagtgggaatcctcagcaatgctaaacccaaaggactctaattatgggaattctagagatcatatgaaactgatgggcacaattcgtcagtgtacttctaagttgctaagcgcactgacaaattgtgcccatcagtttgaattgttgaattataagaagcatgccttggactttgggctaatactcttaccctacatattgagtgaaatttcatcttatttccaacaccattacatcctcagcagctttttgtggttcataaatattctttgtaactttcatttcacatgtatcattctttgttcccaagtgtctttatttttcttcaaggtagaagatgttgttagcccaaataaatcgagattctcagggaatgacagagtttcctggaggagggatggaggcgcaacatgttacgctgtgcttgacagaggcagtcaccgtggcaggtgagcagttgtgtttgaagggatgcgtttgaaaatatcatttatcttaaaagaaaaaaaatttacaacttcctagttcctgatttagcagaaaacaatataaacctaggtctttttatgaggtgttttggtttttttttttttgaaacgggacggagttttactcttgtcgcccaggctggagtgcgatggtctgctctcggctcactgcaacctctgcctcccaagtccaagtgattctcctgcctcagcctcccgagtagctgggattacaggcatgtgccaccacgtccggctaattttgtatttttagtagagacggggtttcaccacgttggccaggctggtctcaaactcctgacctcaggtaatcaacctgcttcggcctcccaaagtgctgggattacaggcatgagccattgcgcccagcctctatgtgtattttttatcttggtgtgggtacaggagggcagggaattttttttttctttttctttttcttttcttttcttttgtttttttttttgagacaaggtcttgctttatcgcccaggctggagtgcagtggtatgatcacggctcactgtagcctcagccttctggcttaagacatcctgtcacctcagcctcccaagtagctgagactacaggcacccaccagcgtgcccagctaattattttatttttagtagagacagggtttcaccatgttgcccaggctggtctcaaactcctgggctcaagccatccacccacctcagcctccaaaagtgctgggattacaggcatgagccattgttcccagcctgtttttggtaagtgctaaatctcactttttttcttttttttgagacggagtctggctctgtcgcccaggctggagggcagtggcacaatctcggctcactgcaacctctgcctcctgggttcaagcgattcttctgcctcagcctcccaagtagctgggactacaaggtgcatgccaccgcgcccgactaatttttgtatttttagtagagacggggtttcacctcattggccaggctggtgtcgaacttctgacctcatgatccacttgccttggcctcccaaagtgccgtgattacaggcgtgagccactgcacccggccgctaaatctcattttgagtctgagttaagcagtttaccttttttctgatctttatttgaaaaaaaaattaatcagcatgtccatatgctagctgtctaaagaaaatattgatttttttgtaatagatggtgacaacttagaaaatatggaaggcgtaagcttgcaagcagtaacacttgcagatggttctactgcttacatacaacacaattctaaaggtatgtgcctcacatatggctgattggttaataccagtgatttataacctgtgagttggagcacctagaagctataccacctttcctatgtctcctaaagatgctgtattgcatatgatgattttaagtcatttcagtttaattctttttttttttttttttataatttggaatagtcctttgagatatttggaagataccctgggatatcaaaattagtgggagagaggagagcagggagtatgtcttactattttctagtaagacctttcttgcttctttaccttgggtcattatttcgtatttttaccaaatacctgtaagagtaaagacatttggggccgggcatggtggttcacgcctgtaatcccaacgctttggaaggccgaggcgggcagatcacctgaggtcgggagttcgagaccagcctgaccaacatggagaaaccgttttctgtaataaaaatacaaaattagctgggcatggtggcgcatgcctgtaatcccagctactcaggaggctgaggcaggagagtcgcttgaacccgggaggcagaggttgcagtgagccgagatcacgccattgcactccggcctgggcaactagagcaaaactctgtctcaaaaaaaaaaaaaaaaagacatttggttttgcttatctgacattgtctctgaattagtgtttgctttgctccaggaaacagccaagtcctcaaaaactctttgtttctatggaaacctactgagcacatgcatacataaacaggggtcttatagccctcagggatgagaatgacagatgatctcacatacactgacataatctgtctgtcttcccagcttcaactccccactggtcatggtcactgattctaagtgactctgaaaggtataaagcagtccaactcatgtagcctgctgtgatgagccactcttcctcttgacctcatctaattgaaaattgcaggggaggaaggatggctgagggaggattttctgctttctgtaggatcactggatgtgttattgaattgcctcagaacattgagggaagaatcaagatgaacacgagcttaagttgtgtatgtttttatagttgatatcattttgaaattgtataaagtttaaaatttttgtttgtgccaatttattgtcttgaatcttttgttatagatgcaaaactcatagatggccaggtcattcagttggaagatggttctgcggcctatgttcaacatgtacccatacctaaaagtagtaagtatttaagataacagcacgggaaaccattttaattctcagcttttagtatttgctacctgcagctccctcttactacctaaacttggtcttgttctcaagtcctccttctgtaaagggagattatagatgccacagagtggatcttaaccaagactttctcgtaaagataatggaaaagaagttactggactgcactgtggagataaatgagtaacagtcctgagtgaatgtttctgttttttgagctgaatcttacatgtctctcattttcttcatttttccccttctttcaactctctttaatactggtgtatatttctaaaaccaatattctaatgtctttttacctttaaacactgacgcagggaagctttactgaacttacttaaatgttcaaagactcatgaagcaagtatagattgttataatgtgttaatggtttattgactcttgttgctaagtgagttaattggaatgtgctagaaaacatgagatctaaatgtaagcattgttcttgagcaggggacagtttgcgtctagaggatggtcaagcagtacagttagaagatggtaccacagcatttattcaccacacctccaaaggtaaaataactttgaaagtatgaataaaataagggagaagtgggagtggtgggggaaagaagacctgtgtttagcttctgaattgttgtcatgggaaagaattgtatttattcattaaagtacaaggtggcagatttaagcatgatttaaggaaaaattttcctacaatttgagctgtccagtgacaagctggaacagcaaaccaaatgactggtccctggaagacttaaagtagaggccacattttgtttttttggttggcttttgttctaagagacagggtctcactctgttgccaggctggattgtggtggcacaagcacagctcactgcagcctcaaactcctgggctcagggatcctcctgcctcagcctcctgaatagctgggactacaggtgcatgctgcctctcccagctagttttttcattttttgtagagacagggtcttactctgttgccaggctaatctcaaactcctggcctcaagccagcctcccaaagtgctgggattataggcgttagctactgcacccagccttaatttcatattttaaaagcagccttggctccttttttaaatgattcagaaataaaatcacaatgtaacattgaaatggttaacttcatattttattcatttctgtattttagagataagatctttgttaggctagagtgcagtggtacaatcatagctcactatagccctgaattcctgggctcaaggggctttcctgcctcagcctcctgagcagctaggactacacgtgtgtgtcaccacagccagctgatttttaaatttttattttctgattaattttttttgttaaatatagggtcttgctatgttgctcaggctggtcctgaactcctggcctcaagcagtcctcctgctccgacctcccaaagcagtggggtcacagacatgaaccactttgcctaacctatttcttcctcttaaatgcaattttttgcctgggcatgttggctcatgcctgtaatcctagcactttgggaggccgatgcaggcggatcacctgaggtcaggggtttgagaccagcctggccatgcaaaaccctgtctctactaaaaatacaaaaaaatacaaaaattagccagttgtggtagtgcatgccttcaatcctggctactagggaggctgaggcaggagaatcgcttgaacccaggaggtagaggttgcagtgtagttgagatcgtgccactgcactccagcctgggcaacagagtgagaccctgtctcaaaaaaaaatatatatgtgtgtgtgtgtgtgtgtgtgtgtgtgtgtgtgtgtgtgtgtgtgtataaaatttttaaagcaaggtcctttgcctactatgtttaattgaaactaagtatacaatgtcaaaaatatttgaagcaaatacagcaaaatgttaatgcttattacatttgtttaagggaagttcaggggtttgaggtggaatgtctaggaatgatgagtacagctctgcaaccagactatgtatattcaaagctactttttttttgctgtgtgacattaagcagattacttttctgtgctttagtttcatcatctgtaaaatgaggattatagtaggtgtccatatcatacgtagggttgttgtgaggacagaatgcacaaacatgtaaagcacttagaaccgtgcttgtctcatactaaatgctcaataaatgttacctattgttactactttagagaatattttattttaattaattaattaatttattattttgagacagtctcgctctgttgccaggctggagtgcagggacacgatcttggctcactgcaacctccgcctcctggtttcaagcgattctcctgcctcagcctcccaagtagctgagattacaggtgcccgccactacacccggctaatttttgtgttttagtaaagatggggtttcaccatgttggtcaggctggtctcaaactcctgacctcaggtgatccgcccacttcagcctcccaaagtgctgggattacaggcatgagccactgcacccagctagagagcattttattatagaatgacataacacgttttagaaaggctgttttgttgtgaagccaaagggaggaatctttttttttttttttttttttttttttttgagacagactctcgctctctctcccagtctggagtgcagtggtgcgatctcggctcactgcaagctccgcctcctgggttcacaccattctcctgcctcagccttcggagtagctgggactacaggcacccaccaccatgcccggctaattttttgtattttttttagtagaggcggggtttcaccgtgttagccaggatggtctcggtctcctgaccttgtgatctgccctcctcagcctcccaaacaaagggaggaatctttaaaaaatttaaaatacttaaatttataaataaatttctttaattacagttggaaaaaagtaaagtctgcaccccttccttccttccttccttccttccttccttccttccttcctcctctcccttccctcctttccctcctttccctcccttcccttccttcccttccttcccttccttcccttccttcccttccttcccttccttcccttccttccttttctttcttttcttttcagcagagtcttgctctgtcaccaggctggagtgcagtggtgcaatctcggctcactgcaacctccacatcctgggttcaagcgattcttctgcttcagcctcccaagtagctgggactacaggtgcgcgccaccatgcccagctattttttttgtatttttagtagagatgggatttcaccatgttggctaggatggtctcaatctcttgaccttgtgatccgcctggcttggcctcccaaagtgttgggattacaggcgtgagccaccacaaaaggccgcacttttttctttatcaataagagttagtcacaggttcattgtaactggctagatttattatttcactatctctatatatatatcgatataaaatcactattttatatcaataccagtatagatatagatatatcttagtgtggacatttagaggggaaaaaaccaccatggagggactgtggagtcatactgacatgagttcaaatcctgatttctctacatattgattttgactgttaattgttagtgttttttctttgtttgtttttgtttttggtttgttttttgagagggactctggctctgtcgcccaggctggagtgcagtggcacgatcttggctcactgcaacctctgcctcccaggttcaagtgagtctcctgcctcagcctccccagtagctgggaatacaggcgcgtgccaccgtgccctgctaagttttttgtatttttagtagagagggtgtttcaccgtgttagccaggatggtctcaatctcctgacctcgtgatccgcccgcctcggcctcccagagtcctgggattataggcttgagccactgcacccggcctgttaatgttttttaaattttctgattgctaaggaaagtgatgttacttctccaaacctgagttcccatttatacaatgaaggcagtaaatgtacctgccttgcagaattattgtgaggattaaatgaaataacacatatcaagtgcgtggtccagtactcagagtaactactcaataaaagctcatttctctcttcctttaaatatgtaaatatttgtcagattttacctttaatttaatggcattctcttccactctctcagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtatagcatttcacaatgtcaagaatgttgcagatatagcttctttatttttcatgaaaagaaaagaaaacaaaaaagtacacctcatcaaaaaaaacctggccaattttggctgggcatggcgtgatggctcacgcctataacttcccagcactttgggaggccaaagtgggaggattgtttgagcatagatccctgtctcaaattcagaaattaaaaaaaaagacactagcaactcaaagtcaaaatcagttagtatcaaagagatcagcatttatcttaagtgaagtgtggaaagattggaaaaaaaaagggaatggagtaaagacttatagaagagaaatgagtggcaggtaattcaccgaaagatatacgaggatgaagggctataaaagaaataataaagtgtaaatggaactgcttatgaattaagaagtaggaactatagattaggaaaagtaaagtctcaagttttatatcaaaagagctgattttttttttcccctgcattgaacatgtatctctcatataacttaaaaggttttatttcacttttgttagggacattttctttttttttttctttacaaacaaaataaatagagacagggtcttgctcttttgtccaggctggtcttgaactcctgggctcagatgatcctcctgcctcagcctcccaaagtgctaggattactggcatgagccaccatgcccagcctattatggaaattttcaaatatacacaaaaataaatgataatgaagccccatgtacttttttttctttttctttttttttgcaagcttctccctgaaccatgtacttaaccagcctaaaccattatcaaaatgtaaaacattttaaagctttattttattcctataggtgtccattgatggaagtgaaagtgtagcaggtactggaatgattggagaaaatgagcaagagaaaaaaatgcaggtatgtaaagctactttttaatataaaaatctagcttagcatttctgtgcccttctgtggatgaaagcaagaataggtaactcactacctctctaggaaaatctcaccagttcagaaaaacaatgtatgtattgggcagcagctttctcaaactgcctgaggtcccagtgttcattggtggatgcaaaatgatgctaaagaaatggaagtatcacagaaatccaggtgaagcttgtgtgctggattccaaggcagttttctggacaaggcagttgtggagaccaggtgacttcctgactgcccccacccatggcatggcaatttgtggatactttttctgggacttcatcatgactctttctaaataatcctcactgctttgctttttgtatttttaaatttcttcttcttccagctgattccctccatattttccttttcaacttctgaagggagagtccagcctagttaatcttggacaaagctgtttatactttttctaccagactgcttcctggtctgcaggtggcctgtgggctggcttcccgtggttcaaatgttcaccctgggtccagtcattggctgccccttacctaagtaacagcccagagcaccagtgcttctaaaagttttgtagtaagtacaaagtagtcacaggtgcattcttgcatatctcctacaatcaaaaattcaaaacttatgttattcaagaattgtttttgtgttgggatgttcgtgtggagggtatgcttggagcttgtataatcattgtagtacattcctgctttaatgctgctctttattttctcagcaattttctctaatattttgttgactgttcctttatagtagtttttttttcattcttcagagttttattatatttaactcctaaagttactactcagggtcacatttataaccttgagcattaacatgaccacttagtgacattgagtgatactgttaggggttatcaagaagattttacatttatattaatagtaagtgataaaataacaggaatcactgaaatcacttgtagaaatatggttctggccgggcgtggtggctcatgcctgtaatcccagcactttgggaggctgaggcggatggatgacttgaggtcaggagtttgagaccaacttggccaacatggtgaaaccctgcctctactaaaaatacaaaaaattagccaggtgtggtggctagtgcctataatcctagctactcaggaggctgaggcaggagaatcgcttgaacccaggaggcagaggttgcagtgagccaagatcgcgctgttgcactccagcctgggcaacaagaacgaaactgtctcaaaaaaaaaaaaaagaaaaaagaaaaagaaatattatgcttctacgcgttgctgaatagccaatatttctgtttaccagctgaagtgatgctacaaagtggcaatagaataaacacagttttcagttcactaagcccatcagctttgatgctgtgtgattcgtagcaaaattttcaggtctcaattcatattcatattttgtgaatgaaatgagactttaaggcaggtgtggtggctcacacctgtaatcacaatactttgagaggctgaggtgggaagattgcttgaacccagaagtttgagaccagcccgggcaacaaagtgagactccatctctacaaaaaattacaaaattagcaaggcatggtggcacacatttgtagtcacagctgtttgggaggcgagggcaggaggatcccttgagcccgtggtttgaagttatagtgagctgattgtgccactgcactccagcctaagcaacagagcaagaccctgttctcccccacctcccaaaaaatgagacttcagtattttttatacagttctatgtcaaatccacctaagtcaacctctactaagatgcaaacacagggtaaatatgtgcgggagttataggtcagtggcttggagtgttggagtggcccaataagttctctgtcttattggtaactgacaagtacattttaaaataatagaatattttaaagaaaagcagttgtaggctgggtccagtgactcacgcctgtaatcctagcactttgggaggccgaggcaggtggatcacctgaggtcaggagtctgagaccaacctggccaacatggcaaaaccccatctctactaaaaatacaagaattagttgggtgtggtggtgtgcgcctataatcccagctacttgggaagctgaggcaggagaatcgcttgaacctgggaggtgggggttgcaatgagccaagattgtgccactgcaccccagcctgggcaacagagtgagactgtctcaaaaaaaaaaaaaaaatttcagaactcaaaacgtaactaggaattcagaactgctgaggcaaaatgtcattaaaaaaacccattactctttttttttttttttgaggtggagtctcactctgtcgcccaggctggagtgcagtggctcgatcttggctcactgcaagctctgcctcccgggttcacgccattctcctgcctcagcctcccgagtagctgggactacaggcgcccgccaccacgcccggctaattttttgtatttttagtagaggcagggtttcaccatgttagccaggatggtctcgatctcctgacctcatgatctgcctgccttggcttcccaaagtgctgggattacaggcgtgagctactgtacccggccccaactcttttttttttttaagacggtgtctcgctctgtcgcccaggctggagtgcagtggctcgatctcggctcactgtaagctccgtctcccgggttcacgccattctcctgcctcagcgtctggagtagctgggactacaggtgcccgccaccatgcctggctaattttttgtatttttagtacagatggggtttcactgtgttagccaggatggtctcgatctcctgacctcatgatccgcccacctcggcctcccatagtgctgggattataggcgtgagccagcgcacccggccaaaaaatcccattactctttatctgtagacatattaccatttggtattggtaccagtagacaaatagaagactactgaatgggattcttttttttttttttactgtagcttttttctcctttgccttttgtacctcttccttacagactagatctgcaatgtccaatacggttgccactagccatatgtggctgttaagcacttgaaatatgactagtccaaattgagatgtgctgtaagtggattttgaagacatattacgataaaaataatgtaaaatatcaataatttcttatattgataacgttgaaatgatattttggacatattgtgttaaacaaaataattactattaatttcacctgtttcttttaatttttttcaattggttactagagattttttgttttattttattattatatttatttatgtattttgagatggagtcttactctcttgcccagggtggagtgcagtgatgtgattttggctgactgcaacctccacctgctgggttcaaatgattctcttgcctcagcctcccgaatagctgggattacaggcatgcaccaccacacccagctaatttttgtatttttagtagagatgaggtttcgtcatgttgaccaggttggtctcgaactcctgacctccagtgatcaacccacctcagcctctgaaaatgctgggattacaggtgtgagccaacatgccttttttttttttttttttttttttttttttggagacggcatctcgctctgtcacccagactggagtgcagtggcgcgatctcagctcactacaacctccacctgctcagttcaagcagttctcctgctcagcctcccgagtagctgagactgcaggcacatgccaccatgcctgtctaattttttgtatttttagtagagacagggttttaccatgctggccaggctggtctcgaactcctgacattgtgatccgcccacttggcctcccaaagtgctgggaccacaggtgtgagccaccatgcctgacccctattttatttatttatttattttttgagactgagtcttgctctgtcgcttaggctggagtgcaatggtgcagtgttggttcaagttatcctcctgccttgacattccaaagtcctgggattataggtgtgaaccaatttgcccggccggaattcttttttttttttttttttgagatggagtctcactctgtcaccaggctggagtgcagtggcatgatctcagctcactgtgacctccgtctcctgggttcagcggattctcctgcttcagcctcacgagtagctgggactacaggcacatgctaccatgcacagctgacgtttgtattttcagtagagagggggtttcaccatgttggctaggatggtctgaatctcttgacctcgtgatccgcccgcctcagcctcccaaagtgctgggattacaggcgtgagccaccacacccagctcagtaaatttttaatcacatatgtggcttgcacttgtgacttattatatttctcttcattagtgctggatcagaagttcatgacttcaccattctctaaaatgattaattaccgtatttaaggttgagaacctagtacttggttttttgtggtttttgttttttgagacagggtcttgctttgttgcccaggctggagtgcagtggcctgatctcagctcactgcagccactgcctcctgggtttaactgattcacctgcctcagcctcctgagtagctggtatcacaggagcgtgccaccatgcccggctaattttttatatttttgttaaagaaatatttaaaaaaatgttttttatatttcaccttgttggccaggctgatcacaaactcctgacctcaagtgatccacctgcctcggcctcccaaagtgctgggatttcaggcgtgagtcaccgtgcccagcctgaaccttgcttttctaagtctctttttttctacctctaaaagaaaggtattaattagatccatggttatcttaggggcaaaagtttggtgtttttttttttttgtttattttttgttttttgagatggagtctcactctgtcgcccaagctgaagtgcaatggcctgatcttggctcactgtaacctccacctcccagttgaactcctgacctccagtgatccacccacctcagcctcccaaagcactaggattacaggcgtgagccaccgcacctggccaaagattttttttttttttttttttttttttttttgagacggagtctagctctgtcgcccaggctggagtgcagtggcgcgatcttggctcactgcaagctccacctcccgggttcacgccattctcctgcttcagcctcctgcatagctgggactacaggcgcccgccaccacgcccggctaattttttgtatttttagtagagacagggtttcactgtgttagccaggatggtctccatctcctgacctcgtgatctgcctgcctcggccttccaaagtgctaggattacaggcgtgacccaccgcgcccggccgccaaagattttttaagataatatttttagtgttttttttaattcaggtaaagtacaaagaagaaaacccaaaatgacccgtaatcttactctacgtatctattttacatatttttaaatataaaagtaatcatgtttatgtttagaaaatccaaatagtatagattagtaaaaataaaaagtgagggatctactgcctgatagtaattattgttagaaatctgctttgttgttgtttttttctctctctctttttttttttttttttttttgagaagtctcgctatgtcacccaggctggagtacagtggcacaatcttggctcattgcaacctctgcctcccagattcaagtgattctcatgcctcagcctcccaagtagctggaattacaggcttataccaccatgcccagctagtttttgtatttttagtagagacaaggttttgccatgttggccaggctggtctgaactcctgccctcaagtgatccacctggcttggcctcccaaagattataggcaggagccaccgtgcctggccttgtttttgtttcttaatcttcctggcagtgctgatgtgtctcatggttctttaaaaattcctctggtgccacacttctaggattgtttcctttcttcaaagagaatacatttttaaaaattcaagttgtttttattttatcctcccccaagaatatagattatttacatcatacaagttaacaaacaccagattgtaagttatagctgccatgtgcattaggccgttacagtaaatgggattataagtactaaaccagacaatacaatgcaatgtttatcctcaaccctactgagtctctcactctataattacagaagctctgccagttaggttccactggactacagcatcctgaaacctggttggttaatagcttgagctctagagccaaactccttcaaatctcacttcccagcttttgaccatgggcaagttacattactaagcccctctgagtctcattttttctatttgtaaatcatagttgatattgaattcattggatagccatgggggccaattagacagtgtacgtaaagcagccaccacagtgcatcacataaatgcaactgctcaataaatgtcagttagcctctttattatgaggtcaccttggaatttaatcttagctccagtcttgtatctacctctggaatttgcacctccttagaatataatggtcctaggcgctaattatattatatatatatatatataatatataaaagccctgttttttgaggtatcaggaatcctgtcagggactagcagatctctgatccaccctcatctgccaaggccagcagctccagttcctttttctgtgtgttttacacagtagaatgccatgtaagattttatctgcgaaagacgtttgactccttcagaaaagaaaaaacattattgacttagaacaatgtgttttgttttgtttttttttccctgagacagagtctcactctgtcacccaggctggagtgcagtggtgtaatctcggctcactgcagcctttgccacccgggttcaagcgattctccttcctcagcctcccgagtagctgggactacaggcacccgccaccacgcctggctaattttttgtatttttaatagagatagggtttcactgtgttagccaggatggtcttgatctcctgacctcgtgatccacctgcctcagcctcccaaagtgctgggattacaggcgtgagccactgcacctggccctttttttttttttttgagacggagtttcactcttgtcacccaggctggagtgcaatggcgtgatcttggctcactgctacctccacctcccaggttcaagcaattctcctgcctcagcctcccgagtagctgggaatacaggtgcctgctaccacgcctggctaatttttgtatttttaatagagatggggtgtcaccatgttggccaggctggtctcgaactcctgacctcaagtgatctgcctgccttggcctcccaaagtgctgagattacaggcgtgagccacagcacctggccacagtatgtcctttatagacaggcagataggccctatgtatcttgcacaacgttacatggtgagtttatggcagagctaaggttatgtctttttgtttgtttgtttgttttgagacggagtctcgctctattgcccaggctggagtgcaggggcatgatctcagctcactgcaagctccgcctcccgggttcatgcttctcctgcctcagcatcctgagtagctgggactacaggcgcccaccaccacacctggctaattttttgtatttttagtagagatggggtttcaccgtgttagccaggatggtctcgatctcctgacctcatgatccgcctgcctcggcctcccagagtgctgggagccactgtgtgagccaccacgcccggccaaggttatgtcttaattctcagaacatacattaagtttaaataccagtgaagtcattttctatacatggtttttagaagctgattagtatttcactggtgttagcttcaaaattgcccttgagagttttcacttgtgatgacatatcagattgctgtttctttgacagagactgcacatatctcatgctgcataaccctgaaatacctgttatagttttggtcttttaatttagcttttgagttttggattctgtccattttttcccctaaaacatctgtagaatcagctattgctttctattccacagtcattatcctaggtttgtttttatgacttctttcctgcatatttatgattatacaaacttcttttgggctccctacctcatttgtcttttcagtctgttccccgctattactgtagttctctttctaaaacgcagatagccaggcatggtggcacatacctgtagtcccagccgttggggaggctgagacacaagaattgcttcaacttgtgaggcggaggttacagtgacctgagattgcaccactgcactccattgtgggcaacagaacgagaccctgtcttgaaaaaaattaattaattaactaattagaataaaacacagaggtgatcttggcttgtcccttacttaaaatattttaataccttcctttggctttcattgtctaggcttgctgttcagggtagtatttattgcttttcacaaacttggtcctacactttcattttcatgaaactcattctattatgtaaacataatactctcatgttgtttccacttcttctagataacactccaaacctttgaccatactattccttctgcctagacagcactccccagtcctcttcttcagtcttcaaatttcacccctagacagcttgccctaacctacatctccctacttttgcattttgccctgttagatcttttcatagactcctgtgataacaattattatattctattataatccttcattaatagcacagttttactagctagactgagagccctacaaaggcaggaacagtattttatttatcattttagaaagtaggtattttgccaatcatttattaaatatttattattttagaatgttgtgataggaagtggtagggagttatgatggagggataggtataaagggtagttaattggaaatagaataagaaggtagtagtgcaaagcaggttccaaatagaaaaaaaaaagatttatttgggaattgagaaggtaaatgttagcctagattggagataaagatctttgcaaggaaacatttccaatacaaggggagggaatcctatcacacccaaatactctatgcattgaggtaaaagccagaatggctttttgactgtgtctccctggccttttatttttccaactactgtatactgtaggtcattgctatttttgtagttttctttccagaggttccttttgttagttgggtgtttgtacaggtattcatcttactgtactttgtgagaatgcctttaagagaggtctgttttgagtaattagatactagtggaaataattctgttggacactgcccttacttataattctcttagcatgccaaatgctagtgacttcagctggcttagaaataagaaaccttgctgttgtcacccatgtccccaccccacaggcacacattcagagacctcagtagttctccctaaactgaattttctgacccttattttactaccctaagttcttaaagtctccactatagacattaagaatgggagcaaaaacaagtacatttttggaaaaaatgtccaatactcatcattggttaggaattcaacattgtttcgttggcttaactaaattagatgccaaattcctggtatatgtttcataccagaatcgaagctcctaataaattggcctaggaggaagcaatagaataacagaaaagattcagatatgagtctctctggagttatttgctgccgctacctagtctgaaggtgtgagcagctgggcttagtttggcagatgtggaaagctggtaagcactttcatttcatagtgctgttagaaaggaggggaagagaataggaagaagagtccttttctcttaatttggagtcttcaattgaaatctgcctttacaaatcatataaagcttgatgccaattctactaaaataaaactctacacttgtatatgtatttaaaaaacactgggctgggcatggtggctcacacctgtaatccaaacactttgggaggctgaggcaggaggattgcttgaggccaggaattcaagaccagcctagacaacatgacaagactccatttctacaattttttttttaaaaacaagctgagtgtggtggtactcacctgttgtcctaactacgtgggaggctgaggcaagaggatcacttgagcccaggagttggagggtgcagtgagctgtgattgtgcgactgtactatagcctgagtgacagagtgagaccctgtctctaaattaaataaaaataaaaaatactgaatggaagtagaccaagaagttaacagtgattttccctggatggtggaattataacacacttaagcttttttttttttttttgcttttttttttttttgagacagggtctcatttgttacccaggctgggtggcagtggcacaatcttggctcactgcagcctcaacctcctgggttcaagcagtcctcctgcttgatgacagcctgggatgacaggcacgtaccaccatgcccagctaatttttatattttttttgtagagatggggttttgccatgttgcccaggctggtttccaactcctgggctcaagtgatccacctgcttcaatctctcaaaagtgctgggattacagacgtgagctaccgtgcctggtagaactttttgttcttcactatggtatccagactcctccagagtacatgtgttgctgttataatacatgaaaaaaaaatgaagttattaaaataatagttgatttttaaagggttcatagaggctcttctgttttcatgagcaataaacagaaactgatctttttgagacaggatctcattctgatgcccaagctggagtgcagtggggcgatcatagcttactgcagccttgacctcccaggctcaggtgatcctcccacctcagcctcccaagtagctgggaccacaagtacataccaccacactcagctatttttttatcttttgcagagatggggttccccccatgtttcccatgctggtctcaaactcctgggctcacgcgatcctcccaccttggcctcctaaagtgttggaattgtaggcatgaaccactgcacttggcctaagaaaattttgttctaataatatttgattcccatttcttatagttttattaagatatatttcacatactagctgggcacagtggtacatgcctgtagtcccagctattcaggaagctgagacggaggattccttgaacccaagaacttgagtctagtgtggacaacatagcaagactccagtctcttaaaatgaaacaagaaaaagatacattttacatacttttttttttttaagtttttgagacagggtcttgctttgtcactgtaattttttctattttatttctgtattacttttttgtttattaagacaggtgtcggctgggcgcggtggctcacacctgtaatccctgcactttgggaggccgaggcaggcggatcacgaggtcaggagttcaagaccatcctggctaacacggtgaaaccccgtctctactaaaaacacacaaaaaaattagcccggcatggtggcgggcgcctctagtcccagctactcaggaggctgaggcaggagaatggcatgaacttgggaggcggagctacagtgagcggagatcgcaccacctcactccagcctggggaacagagtgagactccgtctcaaaaaaaaaaaagacaggtgtctcactctgtcacccaggatgcgttgcagtggcacaaatacagctcgctgcagcctaacctcctggactcgcgcgatcctctcacctcagtcctctgagtagctggaactacaggcaggtgccaccatgcacagctgatgtttttgcatttttgtagaaatggggtttcaccatttgcccaggctagtctcgaactcctgatctcaaacgatctgccttccttggcctccaaaagtgctgggattataggcttgagccactgtgcccagcctacatactatttatttatttatttgtttgtttaaaatggagttttgctcttattgcccaggctggagtgcaatggcacaatcttggctcactgcaacctctgcctcctgtgttcaagtgattctcctgcctcccaagtagctgggattacaggcattcgccaccacacctggctaatttttttttttttttttttttttgagacggagtcttgctctgtttcccaggctggagtgcagtggcgtgatcttggctcactgcttcttctgcctcccgggttcaagcaattctcctgccgcagcctccctagtagctggaatcacaagcacatgccacagcgcctggctaatttttataatttttagtagagacagggtttcgctgtgttggcaagacgggtctcgaacttccgtcctcaggtggatccacccaccttggcctcccagagtgctgggattacagtcatgagccactgcacccagccctaattttgtatttttagtagagacagggtttcactgtgtttgtcaggctggtcttgaacttgacctcaggtgatccacccaccttggcctcccaaagtgctgagattacaggtctgagccaccacgcctggcacagcctacacactttaaatttacccatttagagtgtacagctgagtggtttttagtaaattgaaaaaattgaacaattatcacaatcttaattttagaactttaaaaatacccctgaaaagaaaaatttcttgtaattctgttcatatattttagtggtatgaatccttttataaatcttgtgacattttcagggtgaacctagcactgtgagttatgaaggcatataagacacagttcttgacttcaagtagctgatagactaatagggaagaaaaggaaatataaatgtctttacaacaagacagttgattaaagtttcacaccagtgatataagctatatatcacaggtttgctgaggaattgaagaatcatctgtgtttggaatgatgacaacaggcctcatggaagtagggagatggaattttctagccagaaaaaatgtggaattatattattctttgtataggcacttttcagtctataataaacattttctttttgcccattgggaattatgcctactttttttttttttttttgagacggattctcactctgtctccaggctggagtgccgtggcatgatctcggctctctgtaacctccgcctcccaggttcaagcgattctcctgcctcagcctcccgagtaactgagactataggcacgcgcaccaccatgcccagctaatttttgtatttttagtagagatgaggtttcaccatgttagccaggatggtctcgatctcctgaccttgtgacccgcccgcctcggcctcacaaagttctgggattacaggtgtgagccactgcgcctggcctatgcatacttttatacaaatattttatcaacagatctacctttattcagaaaattatggtctgcaacatttaatgaacatacagtatggggatgacaaaataaatagcttgtaatttaacaattacactgagatctctactgcttgttttttagttgatttatattacaaggaaaagtcaaagtctttctatattcttgtcatctaatgcagggtacttctcaactcccccaccattattctagcctctgtaactcctcctttctctgcctttaccgttctgggatgtgtgtaattgtagtaggtcattacccagaattatatgccatgtgtgacagtctgcagagataggatgttgcaacactgtcaccacatggctcacagagtagaaagtcattcttcaatttttatgataccttaatttctattttaaaaagcctttaaaaatcagcatttggatttttatgttattacatcccagaaaaatgatcttctagtgaatataagtacagagtagtagtatcatatggattgtaatgtttcctttaggtgactgaaatgacctacccctttctcattgcttttgaaattgaaaacacttttgacattgtttttgggacacaggttctaaaaaaaggcaggtagatggatcacttgagtatatcaaggaatacctgcatccagtgaagatgctacttaggttgtttttctagagtaggaatagatctgtgagctccagctgtgtatttctgtgactgtccttttgactactgtactttcagagtcactgacttcaaccatgcaatggaattaacctgaccgactcaggctgaaagagtcctaataaagtgatgacctgagattggaaacccacataacagttttgtctttttaattctgaaaatcataatttatctgttttatttctgtattattgattgattgattgattgagacaggtctcactctgccaccacccaggctggagtgcaatggtacaatcacagctcactgcagccttgacctccccgggctcaggtgatcctcccatctcagcttcccaagtacctgggaaccacagatgcaccactacacctggctaactttgtaatattttgttgtatagagacagggttttgtcatgttgcccaggctgctcttgaactcctgggctcaaatgatccgcctacctctgcctccccatgtgctaagattactggcatgagccactgtgcctggcttaagtaatttaagtaatactatttgttttatttagattgttttacaaggacatgctacaagagtaactgctaaatctcaacagagtggagagaaggcatttcgatgtgaatatgatggatgtggaaaattatatacaacagctcatcatctcaaggtatatataaaagaaatgttctatctagttatgagaatacctaggatattaaatactaagatcatatttttgtgtaattcaaatgccactgttttctcccagttatcaagatactggcacttggtcacactcatacacagacatgtaaaaacctatgcggactttagagactgttaattttttgagggcttggactgtgtttttttcatctctgtattcctaatgtccaggatactacctggcacatggtaggtactctacatatttgaatatatgttgtcaagtatgaaatccatttaattatatgagagatatgtgtgtaatcacacatctctgttaattcactgaaatctagcaaaagttggtgttaatttggcttttaaatatttgggctaaggctgggcgtggtggctcatgcctgtaatcccagtgctttgggaggccgaggcgggtggatcacctgaggtcaggagttcgagaacagcctgaccaacatggtgaaaccctttctactaaaaatacaaaattagccgggcgcagtggcaggtgcctgtaatcccagctactcgggaggctgagacaggagaattgcttgaacccgggaggcagaggttgcagtaaaccaagattgcaccactgcactccagcctgggcaacagagcgaaactccatctcaataaataaataaataaatatttgggctaagtatttttatttcacttgctgctatacataacagaacataccatgactcaataatagctaagatttgttaaagaactttcaatgtgtcacgaagtatgcacttagcatatctggagtagtggccctggggcccatcttcactatttatcagtaaccttgggatgttagttgacctcttagtacctcattttcctcatctataaaattggatcctaagagttatctccctctcagagtggttgtaaaaattaaataagttaataccttacacgtaaagtactaaaaagagtgtcctgatgtggtaaatgttcagtaaatgttagccattgtcattgttactcatttgtcatggcaaccctctatggtagatactattgtgtccccacttttcagagaggcctttgaggctcagagaaggcaagtgcccatggccacaccactaggcagtggtggatccttgcctcagatccaggcccctctagcagcagcctccacactcttaaccttacattgtgtagtctctcccagccccctgcttctagtttctcatcacgtgtatgtttcatgcagacacctttgaccactcgagaaagctcagacctcaaacgttcctgttccctacttaaaacattagtaactatctcttaatatttaacatttaggtctatattgagaactattgggctatcgtttttgtgaagttatcttttttataagaaaaaagcatacaacaaaatcatttagcagtgtgggaaaaagtagttctgtgttgcaaccatcttcctgaggaatacgtaaaggaaatagaatcatgcctgcattttaatcacaggtccatgagaggtcacacacaggagatcggccttatcagtgtgagcatgcaggctgtgggaaggcatttgcaacaggtaaaagtatgaattttgtttttttcttggttccaattaggggtcaagtagagacaggctagtggaaggaactgaccccttggctgtgtctgaatctgcagaagcacatgatcagtttttcagtctctctcataactgcctttcgtcctgcttgctccagacccctctctgttcttttctccactgacctgtctctgcctgctgtgttttctttttctttttctttttctttttttttgagacagtttcactctgtcactcaggtttgggtgcagtggcaggatcttggctcactgcaacctccgcctcccaggttcaagcaattctagtgcctcagcctcccgagtagctgggattacaggcgctcgtcatcatgcccggctcatattttgtatttttagtagagatgaggtttcactatgttggccaggctggtctcaaactcctggtctcaagtaatccgtccgcctcggcctcccaaaatgctgggattacaggcgtgagccactgcacctggcctgcctgctgtgtttgatacttttcactcctccacattctgtttattttagcgggaaaataaaagccaagctttaaaggctgtcatagactctaacatcaggacaggccttagcaatgggatgaggcctttgcatccagcagggctgggactggcaccaggcctgctgacttccattcttcattccatgtcttgattccactttgagctcttggggtatgagaacaactgataaaactgaggcactttagaaaagaaacacacaacctcttttagacagaaatgaaactattgaattttcagcatggcagtcccgagctatgatacttttgtacatttttttgtttgtttttgagacagaatctcactctgtcgcccagcctggagtgcagtgacgtgatctcggctccctgcaacctctgcttcagggttcaagcgattctcctgtctcagcctcctgagtagctgggactacaggcatgcatcaccacacccagaaaattttttgcatttttagtagagatgggattttaccatgttggccaggctgagctcgaactcctgacttcaggtgatccgcccgccttggcattccaaagtgctgggggtacaggcgtgagccaccgtgcccggcccttttgtacattttaaatagttattctgtgtatttgcctgatattttatacttggtattgactatatttttcagtagcttattctcagtgtgcatgtttagagcagtattgtgtaattaaatttcttttaattttttcttaaaggttatggattaaaaagtcacgtcagaactcatacaggagaaaagccatatcggtgttcggaagataattgtactaaatctttcaaaacttcaggagatctacagaaacacatcagaactcatacaggtactagtggaaacagagtgtcaaaatcttttttttttttttttttttgagacggagtctcgctctgtcgcctaggctggagtgcagtggtgcaatcttggctcactgcaagctccgcctcccgggttcacgccattctcctgcctcagcttcccaagtagctgggactacaggcacccaccaccatgcctggctaattttttgtatttttagtagagacggggtttcactgtgttagccaggatggtctcaatcttctgacctcgtgatccgcccgcctctgcctcccaaagtgctgcgattacaggcgtgagccaccgcgcccggcctaggccaagttaatctgcagggacgggacttgaggaatgagtttctggaagagtttcaggaagtcaatatcaagggcttctcttgaaaccctgaaattccatatgacttgctgtatatgcatgtctgctgcttttcagggtgagggctcatagctctgttagattctcagaagggtccacgtcccagaaaagattaacagtggccctagaccacgagctctctcaggttttagttgtctgggcaacaagtttatttacctaggattacacatctaattagtagccgagctgagacagaacctaaggcacccagttgtttctcctgcattaagtagctgctaaagaaagtgtctgaaccccaacaggcccacagcaagaaagattcattactttttgtgatcatttctccttctctttaaattttatcttcttttcctaaatagtacgttattcttacctccccgaccatctcctctcctccttatatttgattacttgtggagttggtattaataagataaatatttgctttggattggagctaaaaaaaagttcagcagctgttgataagagatgctattataagctgttgactaaataatacagcattaagataatttagtttgggattttagtatagatgttttaaacgtggtgtgataactgtgtccccatgtatggaaatatctgaaatagtttagctaatttccatgtaggattcttgcagctattaatgtttaacctgcagcttaactatgaccccagattggctttactttacaacattgaggaacagagctgtaggtctctacttccatctcattcatgcactttttatttattgtatcagaggcgagtatttccaagctcccataaattctacttgaatttggaaataaaaccaacttgttatataaaagctatatcaaaccaataatctagttttataaatattgattaaaaaacatcagaattgtgatttatttcatagtattcatttgtcaaaccacatgttcatataacagctttaaaatcatgatattttcattggtatagtgtgggattgagtaagggacatagggacttctgtaacaaatacagaagattacagtgcaaaaacaaagcaggatgttacagaatcagagtagtaatacagtgaaaattatcctagaacagttgattccctatcatagcatgtcagagctgggaagactttagaggtcatctagatccaagagaaaagacttgcccaggataaactctttgttctccttaggctgacataatgaataaaacttactagagataggatcaaagattcctgctccttttaaaatgatttcatacttaaggggagaaatcttttggaatggtttccaccaatagagaaatcataatttcatttgaccaaaagaaaaacaacaaactagccagtcgtggtagcatgtgcctgtggtcgcagctacccgggaggctgaggtgtgaggattgcttgagggcaggagttcgaggctgcagtgtgcaaccatcgtgcctgtgaagagccactgcattccagcctgagcaacatagtgagactcatctcttaaaaaatttaacaaacttactatatatagataaatatctgtatctgtctatataaagagagattttttccccttccccagaagttgtttgcctaatttgagctcatcctagaaaagggtacatgagaatcaaaagcaaaggctacttcttgcttgacagtttaaaggcctttcgtattccaagattgtataaagcaaatatgaaggaaagaaacataattggtaaagcagatttttttgtttttgagacagtgtctcacttcagtgcccaggctggtgtgcagtggcacagtcacagctcactacagccttgacttcttgtgctcatgtgatccccccatctcaccctcccgagtagctgggacttaccactgtgcaccactacacccagctaattttttgaattttttttgtagagacggggtttcgccatgttgcccaggctggtcttgaactcctgagctcaagtgatccgcctgccttagcctctcaaagtgctgggattacaggcatgtgctactgtgcctggccagactttttataagcttagattatgagggtagtagtagtatgtccagcaggtatttttgacatatgtgctaggcactagattttctttttttttttttggttcaataacacaagtatgtattgaacacctactatttcctgacacagttaatattaggcattatcttgttgaacattagttaaaacaccatttttttttctcttgagatggagtctcgctctgtcgccgaggctggagtgcaacggtgtaatctcggctcactgcaacctccgcctcttgagttcaagcgattctcccgcctcagcctctcgagtagctgggattacaggcgcccagcaccacgcccagctaattttttgtatttttaatagagaaagggtttcaccatgttggccaggctggtcaaaacaccatatttttaaagagcaaaaattattttcctgcaagatattgtagaataaatcaagtaggatacaagcttttagggaattctgggtttgttctaatttaattcatattcctgactgtacttttcttttatatttcttatgtttttctctctgcttttctcagctcattttttgcctacctggatgattccatcttggagagctatgtaatcagtgattagttttgaataccattcccagtttcttatgtagatttaagtttggagtggaagatgctgtttccccaacccccgcaaaaaaatgcctgaaagggaagctcagcacaagaaggctagagtcttgagcataatcctaggcaggactgaaggataagacattttaatcctctatatatttttgcaccatttaatgtattaccctttatatttgcaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggtaacaatctctgatcttttggtcttttatctttcaaggctcagtttaactcctgccttttccagaaaccatttccaactaatctcttccctcctttctatcacttggcatggtggaaagagattaagcaacttgaaaaagtttcaccttaacagtcatacattcatttattcaacaaacagttattgagtatctcctgccaggcatcaaacatagagagataagacattgtcaagggcaggctacttgggaagagatagtagacatacagttgctgcagtgtctcccattatatggacaagatgctgtgggagcagagaggggagcagtcacttctgcaggaatgggagaagcattttgggaggggtttctgggagatatttggcatacagactcaatcctgaagtttgccacataagagagaagggtattcctggcaggggaaatgtcatggggaaaggcacaaaggtatgaaaaagcatgatactcagtggttccatatgacaggagcattaagtacatgtagaagatttgtacaaggtgagttctgagaggtagccagaggccttgtgtgttgtgctgtcaaagttaaggtacttcttaaactggactttgtgaagcttgtgagggggcggggtggtctatggatatattctttttttttttttttttttttttttttgggatggagtttcgctgttgttgcccaggctggagtgcaatggcgcgatctcggctcactgcaacctccgcctcccaggtttaagcgattctcccacctcagcctccctagtaactgggattacaggcatgtgccaccatgcccggttaattttgtatttttagtagagacggggtttctccatgttggtcaggctagtctgaaactcccaacctcaggtgatctgcccgcctcggcctctcacagtgctgggaatccaggtgtgagccaccgcgcctggccatattctttttttttttttttttttttttttggtaaactgctttattgaaatataattcacatactatacaattcatctatttaaagtgtatgggccgggcgcggtggctcacgcctgtaatcccagcactttgggaggccgaagtgagcggatcacgaggtcaggatatcgagaccatccttggctaacatggtgaaaccccatgtctactaaaaacacaaaaaattagccgggcatggtggcgggtgcctatagtcccagctactccggaggctgaggcaggagaacagcatgaacccgggaggcagagcttgcagtgagttgagatcgcaccactgcactccagcctgagcaagagcgagactccatctcaaaaaaaaaaaaaagtatgtgtttcagtgttttttagtatattcacaaggttgtgcaaccatcaccacaattcaattttagaatattttcatttcccctaaaagaaattccatactcagaagcagtcctttccccaccccgccccccaggtgtaagcaatcacgaatctactttctcttctatgggtttgcccattctggatattttcatataaatgaaatcatgcagtatgtggggggtttttgtctgacttcgttctctttgcataatggagtgcagtggcgcaatctcggctcactgcaagctccgcctcctgggttcacaccattctcctgcctcagcctcccaagtagctgggactataggcgcctgccaccatgcctggctaattttttgtatgttttagtagagacggggtttcactgtgttagccaggacggtctcgatctcctgacctcgtgatccacctgcctcgacctcccaaagtgctgggattacagacatgagccaccgctcctagcctgcataatgtttttgaagttcaaccatgttgtagcaacttttaaattctttcttttttcagtaactgaatagtatttcattatatggatgtactacattttgtttattcaccgttgttttcacttctggctattaagaataataatagattacatatgtcatatgtattccttatatgcaatgagcattcatgtacaagtttttatgtggacatgttttcatttctcttggatgtgtacttaggagtggacttgctgggtcatatggtaactccatgcttaacattttaggaacttccaaactgttctcccaagtggctgcaccattttacagtctcatcagcaatggatgagggttccagtttctccacatcccagctaacagttgttattatcccagctaacagttgttattatctgtctttttttattatagccatcttagtaggtgtgaattggtatctcattccgacttttgatttgcatttttctgatggctaatgatgtgaagcttttttttttttttttgagacggagtcacgctctgtctcgcccaggctggagtgtagtggtgtgatctcagctcactgcagcctccgcctgccgggttcaagcgattgattgattgatcctgtttcagcctcctgagtagctgggactacaggtgtgtgccaccacacccagctaatttttgtatttttagtagagacagggtttcaccatgttggccaggccggtctcaaacttctgacctcaggtgattcacctgccttggcctcccaaagtggtgggatcacaggcatgagccaccacgccttgcctttttttttttttttttttttttttttgagacagagtcttgctgtgtcactcaggctggagtgcagtggcgcaatcttggcctgctgcaccctccacctcccacgttcaagcaattcttctgcctcagcccccacaagtagctgggattacagacacctgccaccacacccagctaatttttgtatttttaatagagataggttttcaccatgttggccaggctagtctcaaactcctgaccttgtgatcctcccacctcagcctcccaaactgctgggattacaggtttgagccaccacacctggccaaagcatctttttatgtatttattagccatgtgtatatcttctttggagaaatgtctattcaaatcctttgcccgtttttaaaattgggttgtgtctttattactgagttgtataactttaattcgagagacttgaatccaagtctcttattagatatattagttacagatattttcttccattctgtggctggttttttaattctcttaatgatatttgcagtatagaagcttttaattttaatgctccattttgtggatgtatttttggtgggtgagaatggaaaggcaaatgtgagcgtaaggcaggatatgcattagttttataagaaaaattttaatatattgttttattactggtattaagagtaaacttgtgttaattcaaaattaaaagacatttttttcttttttctttttttttttttttttttgagacagcgtctcgctctgttgcccaggctggagtgcaatggcgtgatctcagctcactgcaacctccgcctcctgggttcaagcgattctcctgcctcagcctcctgagtagctgggactacaggcacctgccaccacgcccagctaatttttatacttttaatagagacgggatttcaccatgttggccatgacagtctcaatctcttgaccttgtgatccacccgcctcggcctcccaaagtgctgggattacaggtgtgagccaccacgcccagcctctttttttttttttttttaagatggagtcacgccctgtcacccaggctggagtgcaatggcacgatctaggctcactgcaacctccgcctcctgggttcaagtgattctcctgcctcagcctcctgagtagctgggactacaggcgcataccaccatgcccagctaatttttgtatttttagtagagacagggtttcaccatgttggccaggatggtctccatctcctgacgttgtgatccacccaccttggcctcccaaagtgctaggattacaggcgtgagccaccatgcctggccaaaagactttttttttgagatggagtctcgctctgtcgctcaggctggagtgcagtgtcgtgacctcagctcactgcgacctctgcctcctgggttcaagtgattctcctgcctcagcctcccgagtagctgggattacaggcgcatgtcatcatgctgagctaagttttgtatttttagtagagacagggtttcaccatgttggcccagctgatcttgaactcctgacctcaggtgagccaccacgcccagccctgatatgcaatttttgtgtgctatacataaacatgtacctacgaatgagttcacttactgttaaataattatggccaggcatggtggctcacacctgtaatcccagcacttggggaaggtcaaggtgagcagatcacttgaggtcagagtttcgtgaccagcctggccaacatggtgaaaccctgtctctaccaaaaaatacaaaaattaggcctggtggtgggcacctgcaatcccagctacttgggagactgaggcaggagagttgcttgaacctgggaggtggaggttgtagtgagtcaagatcatgccactgcactccagcctgggcgactgagtgagactccatatcaaaaaaaaaaaaaaaaaaaggaaaagacaattcatcttttaagtgcttcttattaaaatatatgtgcttaagtgcctttttgtaatatttggagaaaatggctggggctttttggatgggctgggaaaacattatttttcccatttaaattaatggaatatagatagagcttggcgcagtagtagctcatgcctgtaatcccagcactttgggaggccaaggtgggtggatcacttgaggtcaggagttcaaaaccagcctggccaacatggcgaaaccaattctctaccaaaaaatacaaaagttagctgggtgtggtggcagctgcctgtaatcccagctactcaggaggctgaggcaggataatcacttgaatccaggaggtggaggttgcagtgagtcgagatcacaccattgcacttccagcatgggtgacagagcgagactccgtctcaaaaagaaaagaaaaaagcaatggaatacagactaattatctgaaagctagccattcaacacattttatgggcaaattagcattcaataagagagatgcctacattaagtttggccatactgatgtctttggaacatttaggtagagcagtgctctcaaatgagtctgcatattggatgtatctctttaaaatagactgattgcccagatcctgtctgcaaagattctgacataattgtactggggtgaggcccaggcatcagggtgtatttaaagctccccaggtcttttagtagactgttttgagaataattgaagtagagagagtatgcagttataaatgttggtctgacctaagaggtgggtctgggctggaagaaaagattggctaatgatcaggtaattgctacaataactggtcacaatatccagtagagtaaagattcagacctgtgaaatgcagtccttttttcttttctttttctttttttttctttgcaaggctcgtcagatgacccaggtgaagctatgtaactagccagtaagggagctcaaaagctcaatccaaatccattcgcctcttggctgtggtttggtgccacctagtggcagtttctgctctagcctaaatatcaattgggctgatttttccaagttgaaattggctgccctttctcttgccctcaccacatctcagcaactatccaccaaaataagaacattaacctgcctgctttgggaatgggaactgggcagaggacaggaagaaatcgccaattactttatgtgtaagacttatgttacggtacattagtgtggtatcttatttttgggggggtttactgtgtttagaaccactgcgaaaggtgcagttacccaaggaatgtgtcgaatgagaataaaccaggacatgcatatgtatacacactttcatatgtacattttaaaaatctgagttcacaccaatacctccaattccatttcaccacagggttctttttgtttttcttcccccattccatatttgtattctcctttttccacagctggagcccttccagcagcatttgaaatatttactcatttgctcagtcttttattccatctaaaatagtttcagaatcccttcacccataccactacagtaaacaagcctactacaaatgagctgaatatttgtttgcaattcttcccctcactctcgccactgagcccaagactgagggcataagtcaaatactgtgtaaatgagctactttaattaatttatttgttcccccaccccagccccttcagtgtagttaaaagtattcatttaaacaattaggttaatttgttccagtttgctttcagttttaggtccctacaccaccacatgttagcactgtctagatattttgtgatattaagtaattattattaattttgtttacatattttttaaactgggacccatctttttggtatacagcctgaaagaaaaagaatgttacctgcaactgtttcggaataatcctggtcgggaagaagggggaaatgggtagtaaatataagaaacaatattggtcatgaactgatagttgaagctggatgattggtacatggggaactgtttctctatacttttgtgtatatttgaaattttctgtagtaaaaagttctaaaaatatgtgtactgcctataatgttctcaagctgtttcatgggacaaaaattaaagtatttacttccctatgtattgcctgcttgctattagtgaatactcagtagcttttgattggatgtaagaagtcaggttaagttaaatgaaacatgtttgtccttttagttgtattgacatatctaactaggtttaatagacttttaaagacaatccttttttattatctttataaaattcttaggaagctgcataagttacgataatagcatttattattattaatagactataacagtatctagattatctaattatgggaaacaaattacagtttcattaaagttagagttaaactgggcaacatctccatccttttctcattccttgagattaaggagaacctggtgttgatgcatggagacagcactaaggatcatactaccttttgagtcaagtcaaaaccatagttagggaatcttttcttgtgtgctgcctcatggtgggatgaggaggggtttggcaattctttatttttagaggtattttaccccctgggggggaagtatggaatgattttgcctacatatgtaaaagttgaacttttttttggtgttgctctttaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtgagagttttgtctactatattttgtttctgagtttgagaatcaacagttatgaacataatttatgattcatagcattttctgaaatcctaatgtgtcattcgtataatcacataaacataatttacagctgcagtaagtgctattgaagaaaagtatgtggtactctgggatgtatagaagggaatgttagtttgggaggtcaaggaagggatttttggagagatcttgaggttgaataggggttaactgggtgaagaagcagaggttgctgggaagggaagcaggaagcaaaggcaagagaatgttccaaatagagagaatggcacatgcagaaagccaggaggttggagagaccaaagtaaattggagatactgaatgaagcctggccagttagggcagttctgcctgggaaggtgatatgaaacaaggctggagagcgaggcaggggcagccagcctgtttgggtccattaagcatgttggtcttaatcgtaacactagagaagtactcccaaataactcttcattgattcaggtgctattaagtatgttattgtaagagacaaaattatttgtttcagtaaacccttggaaaaatattttagagaattacattgaattatttcagataaataagcataggtaagtaggtaaaaggaagtcggtttttctaaaacacaaaacaaagcaagttgtcttacagtttcattgagtacctcctaaatgaagtaaatttgaaaattaagagaagacatcttttttcatttttaacaacatatattgaagcattgaaaaacatttaggtggaaaaggtttgttggagagtaagggaaagaacagatcatctgctcagatgattccttgtagtcctgatttgtcttttcaggtatttgttaggtggtggtaggttaatagcaattccatcagtcttcatggtgattattttctagccagaacactgtaagtgtgcatggttaaatattacatcaattggggagatactggtcaaagagtacagtttcagttaggaggaataagttctggagatctgcacagcatgtgactacagttaataataatgtactgtatatttgacaattgctaagagaaaggaagtaaataagaagatcctacaacaactgctgagtctttttagttagaaagcaggctttaatgatatcagacttaagtttgcaagactctttttctaagcttcctcaagtctcttccttaaatgttgatatttcaggttatcagaagttcctatattcttttttttttttttttatttttgagatggagtctcgctctgttgcccaggctggagtgcagtggtgcgatctcggctcactgcaagcttcgcctcccgggttcattccattctcctgcctcagcttcctgagtagctgggactacaggcgcccgccaccatgcctggctaattttttgtgtttttaatagagacggggtttcaccgtgttagccaggatggtctcgatctcctgacctcgtgatccgcccacctcggcctcccaaagtgctgggattacaggcgtgagccaccgtacccagcccagaagttcctatattctagaaaatagtctataatataataatatacattttatttaaaaacaaaactaaactaagattgtttttccaagaatagggatggatttctgttttctctcacatgatccactgggttttgtaacctgttggaataatggtatataaatagctgtggaacagaacaaaaaggaatgaagtaatgtctgtcatggaaattacacgttgatgactgtagccatatgagtgcatggattaaccactgaattgagaagtactcttagattagcatattatgtcctttgagggggaaacattttttttttgctctctttctgacttcatgggaggtagaaagtgatgaaagacgagagggaccaggaatcttcctggttgacaattatagtagtaatggattgttgaaattgctgtttacttactggttctttatgaaataaagaagtgatggaggttccttttatgtcactaaattattaaccatacctcagataatatgccatacattgtctttacacagtgaggtcattgtgtactgatggtttgcaatcaatcagttgtgctaaagaccaagtttagtatcagtgggtgtgtttgcaaaccattctggctttgtggttaatgtttatgaaaatgaaaatagtcttaaccacttttaacagcttctttttttttttttttttttttttttgagacggagtttcgcccttgttgcccaggctggagtgcaatggtgccatctcggctcaccacaagccctgcctcccgggttcaagtgattctcctgcctcagcctcctgagtagctggtattacaggcatgctccaccaggcccgcctaattttgtgtttttgtttgtttgtttgtttttgttattgagacagagtcttgctctgtcgcccaggctggagtgcagtggtgcaatctcggctcactgcaagctccgcctcctaggttcacaccattctcctgcctcagccccctgagtagctgggactacaggcgcctgccaccatgcccggctattttttttttttttgtatttttagtagaaatgggtttcaccgtgttagccaggatggtctcgatctcctgacctcatgatccgcccgccttggcctcccaaagtgctgggattacaggtgtgagccaccatacccggccttggttttgtatttttaatagagacgtggtttctccatgttggtcagactggtcgcgaactcccaacctcaggtgatctgcccaccttggcttcccaaagtactgactgggattacaggtgtgagccactgtgcctggcctttaacagctttttttttttttttttttgagacggagtcttgctctgtcgcccaggctggactgcagtggcgtgatctcggctcactgcaacctctgcctcccgggttcatgccattctcctgcctcagcctcccgagcagctgggactacaggcgcccgccaccatgaccagctaattttttgtatttttagtagagacggggtttcactgtgttagccaggatggtctcgatctcctgacctcgtgatccacccacctcagcctcccaaagtcctgggattacaggcatgagccaccgtgcctggcctaacagcctcttaagtgaatgcgagaatttagtgcatacttgctgtatttgaagggttatttgctagttttcctgtacagttcctcccctctccgcccctaatgcacatatagtatcaagtaattactccaactaagagaataaaacaggtccctgaaaatcagaacacttaaatttgatgcagaaagattttttgtttggtctgctttgatgtagtttgcctttgcaaaagtggaggtggaggaattggaaggaggtcctggaagccattttcgtgacttagaatataatacatgtacattttaattatgtaattttctctttaatatttaaaatgtcctattttctaaacaaattggttggttggtcaaataaatgattcatttgttttaaacaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtaagtatccaccaaaagccaaacaaattaaatctttctgtgaacctgggcttgaaaggcaggctgggtccccattgaggaaagctttgaaatatcagggcacaaagtttggaaaccctgaggtttttcagtagtctgcttacagagactacgtgcagagagattaggagagagagaaggtttgtgactgtagaatccgaatggtattcttggtgtagttcaaaggtgagatgataaaggtcagccacagagaggctcagggcttcaaaagtactggatccatgtgaaacacagatcagaaaagggataggatttggtggctgattagatgcaggaggtgagattgagaaaacagagatttggctgaggtgatcagcatatgatggcaccattaagagatcaggaatcatgagagttcactcaactagcctcacagagtcggtagaataggtatcttgatttccccccaggaaaagcacagtgtaatggttgttctctgttagccaaacttgttattattttctagatgtcactagcctaaaattattccaccttgattccatttttaagctctagcaaagactgtcttaatacctggtggaaatatgcacaatgtgcttctttacccttctgtgtcttcctctttcatggagaacgctctccttacccatctctcagagtttaatgattaatatgctctgttttgatactcaggattagaaaatacaaagctcttacaccttctcatttatctccttcctcactttgacgtcactaatttcacactatactctctgtcctctgactggtatgcaagattattaaccaagttttaattctgcatcagccttaacactttttcttgaattagatcatcacatacagaggtcctctggaggttgttttatataacctccctgttccctatacaggaaaaattcccactatagcaggtctgaaatagccactactgagaaacccccagtgattaggcaatttctgtcttaggcaatctgggtccaggcgcggaggcttacgcctataatcacagcactttgagaggccagagcgggtggatcacttgagatcaggagtttgagaccagcctggccaatgtggtgaaaccccatctctactaaaaatacaaaaattagctggtgtggtggcgctctcgtgtagttccacctactaggtaggctgaggcgggaggatcacttgcacccaggaggcggggtaagacaacattgtgccactacactccggcctggacattggagtgagactctgtctcaaaataaataaataaatacattttaaaaagaggcaatctgttccattgttggataattctagtgtttgtttgtgtggttttagagatggtcccactctgttgcccagggcaaagtgcagtggcagaatcatagctcaaaggactacaggtgtgtaccaccacacctggctaattaaaaaaacatgtttttttcagaggtgaggtctcactgtgttatccaggctggtcttgaactcctggcctcaggtgatcctcctgcgtcagcctcccagagcgctgggatttcaggcataagccaccataattctactatttatcagaccagaacccacccctgtatcatcctctcatggctcctctccgaccatacagaataagtcttatccttcttcatatattccaaaacaactatctttcccatcccaatgttgtactttctctacacttaaccttctcatttccttcaggaattagatttccattccattcctttcatcagtcaaatgatagacatttatagagcacctaccccatgccagacattttggtcagtggacttagtgttggaatcacaggaagggcagtatcacagtctagtaggagagagacccttttagaatgaataatttttcataatgacgtgtatataattgagagatacagaaagtgctgtggcaccctggaggagagagtaaatttttcttcctaaagtaatcttgcagatcctaataagagaatgggtgttcagttgggtcttgaaggattttcatgaactcaccagagagtgaagggaagagcaaagtcataaaaatacaagagaatatgacactttctgggactgcaaatgactagttgtggctggagtgtcagttgctagtttaaaagcagtggaagatgagcctggggaagttggtaaaggccaggtcatgaaaggtcaggaatgctatgtaagaagtctgggctgggcacagtggcccatgcctgtaatcccagcactttgagaggccaaggcaggcggatcacctgaggtcaggagtttgagaccagcctgaccaacatggagaaaccccatctctactaaaaatacaaaattagccgggtgtggtggtgcatgcctgtaatcccagctactcgggaggctgaggcaggagaattgcttgaatccaggaagcagaggttgcggtgagccgagatcatgccattgcactccagcctgggcaacaagagtgaaactcctcaaaaaaaaagtctgaactataggtgatgggcagtcacaggggatttcagcagcagagagcataataagattttgttttgttttgttttagaaagatgtcaacatagaggatggttagggaagggttagactggatacctggagagaagttggattctcgtagaaattcagatgggagaaaaataaggatctaacttagcaacaggaatggagaggaggaaatgcaattaagaaatactgtattgccgggtgtggtggctcatgcctgtaatcccagcactttgggaggccgaggtgggcggatcacaaggtcaggagatcgagaccggcttgtctaacacggtgaaacctcgtctctactaaaaacacacacaaaaaaattagctgggcgtggtggtgggctcctgtagtctcagctacttgggaggctgaggcaggacagtggcatgaacccgggaggcggagcttccagtaagcagagattgcgccactgcactccagcctgggcaacagagcgagactctgtctcaaaaaaaaaaaaaaagaaaaagaaaaagaaaagaaatactgtattgccgggcacagtggctcacacctgtaatcccagcacttttgggaggctgaagtggtaggatcacttgaggccaggagtctgagaccagcctgggcaacatgttgagaccccatgtctacaaaaaaaatgacaagtaattagtcgggagcaatgggtcatgcctatagtcacagctacttaagaggatgaggctagaggatcacttgaacccaggagttttagacttcagtgatttatgattgcatcactgccctccagcctgggcaacagagtgaggccttgtctccaaaaataataataataaaaaaataataaaaatataagaattgttaaaagaaatattgtattgatttttctgatgactgaatgagtttatttcattctaaaaggcttatttacatccacagggcaaacttatacaaggattagtcctggtccttatggaagattgtcagctataacaagaaacattgactgctttgtaaaattcactgtattgcaggtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggtaattacttttttctgttatgtcaatcaatacatatatcagtaccaaaacagttacataggtatgcaatgtggtacaacagttaagcacacaaacttgggagtgactaatattttgtaacttcttagctacttaaccctcagagcctgtttttcctcatatgtaaagtagggtgctagttgcatgtaccccataaggttgatataaggattgaatgagataatgtatataaggtactcagcccacatatatattaagtgttcagtagtggtagctattcctattatcatcattatcagatacttaggaaatacttgcaaaacttactatttaattttttgaatatgtcatatattcatatggtttaaaactcaaaaaatatatacaggtatgtaatgaaaagtcttcatcccacccctgccttcatcaacttgttcttgcctccacagataatcaacttttatcagttttttgtgtattcttccagtcattaagcatatacaaacaaatacaaataagtaaatagtcatctccccctaccttttttgttaactagcccacagctaacataatagctctcttctggtttttgagacaggctggagtgcagcggcacgtcatggctcactgcagcctcaacctcccaggctcaaacaatcctcccacctcagcctcccgagtagctgagactacaggtgtgcaccaccatgcctggctaatttttattttttatttttattttttgtagagaaagggtctcactatgttgcccaggccttggcctcccaaagtgctgggattacaggcatgagccaccatgcccagcctccattttttttttaatgatagtaaactagtctgttctgcatcttgttgttgtcttttaaacttaacatcttcaaaatctttctatttcattatatagagaacttcctcattctgttttttttttaagctgcattgtattccactgtatggatgtgccgcaattaaagtcttttgctatttcaaacaacacataaccttgtgcacatgtgattttgcatatatatgtgtgagtagatatgctagataaattcctagagcaggattgctggtgcaaagatacatgtattcgtaattgtgatcagtgttgccaaacttcccttctagggttgtgccagtctccattcttacctgcagggtttgatagtgcctcttctccttcagcatagtcaccatgatagtatcaaacttttgaatttttgccaatctgatgtatttttcgtagttttaattttcatttcccttaaaataaataatgtaatatatttaaaaactgttcttgtactgtgctaaaggccaatgttgagtctcactcttgaaaaaagaatgaagttggtggtctcatacaccctgaaatgcaaaactcagaatcataaagcctctagaagacaagagaggcaaatacttctgcaaccttaaagattacttggactgtattcaaaatgtactaacaatgaaagaaaaaactgataaattggacttaatcaaaattaattctgctcaccaaaagacactgttaagaaaaagatcagacaacccccagactgaggaaaagatattcacactatatacacacactatattgaatataagtctaaaaacggactgtattgagaatgtgcaacaaacttctacaaatcaacaatgaaaagatgaacaaccgttaaaaatgagccaaaaaagtgttttaaaatgtacaaatcattccattgctcattgaacagacctcccacaaaagattcataactcaaaaagtgcacatcttttatcatcaaagaaatgcaaattaacatcacaatgagagagcatttcaaacccaagaagatggctaaaatcaaagactaacaaaaccaaatgttgatttctcctaagaaactggtgaggaaacaaccaccaccaccacctccaaatgttggcaaagatgtggagcaactagaatattcatatactgctagtgggaatgtaaaatgatcaataagcacatgaaaagatgttcaacatcattagtcattaagaaaatgcaggctgggtgcggtggctcacgcctgtaatcccagcactttgggaggccgaggtgggtggatcacctgaggtcaggaattcaagaccagcgtggccaaacatggtgaaaccccgtctctaataaaaatacaaaaacattagccaggcgtggtggcagggtgcctgtaatcacagctactcaggaggctgaggcaggagaatcgcttgaacccaggaggcagaggttgcagtcagccgagattgcaccactgcactccagcctaggcaaaaagagtgagactccgtcttaaagaaaaaaaaaaaaaagcttctggttattttcataggaaacaaatttttgtattaacggtttaagctattttaagctgcttgttacatattgccaaattatttttcagaaaggtttagtaatcgtgttatggatctaaaagctttctttttcactgtactcttgcattgaggattttttaaaatatttacagaattaacaagcaaaagttaaattctgtttattttcatttgaccactggtgaagttaagcctgtttttcatatttgcctgcaatctggttttttcttaattgaggtaaaatttacataacaatgaaatgcacagatcttaaatttacaattcaatgagttatgttaaatatgcacccatataactaacatcctaaacaaaatgtagaacatttctatcacgctagaaagttaccttgtgattcctttatagtcagtactcactctccttaggcaaaaactgttgtgattgaattagttttgcctatttttttttttttgagacagagcctcactctgtcaccctggctggagtgcagtggcacgttctcagctcactgcaacctcccgcgcctggctaatttttttgtatttttagtagagatggggttttagcatgttggccatgctggtctcgaactccggacctcaagtgatctgcccgcctcggcctcccaaagtgctaggattacaggcgtgagccaccgcacccagcttggttttgcctattcttgaacattacataaatggaaccacagtatgaactcttttgtgtctgggtttttctacttaacgttttggatatttattcacattgttggcatgtaataacagttcattcttttttattgctgagcagtgttctattgtaagaatataccacaacttgttgatatattctccccttggtgaacatttgaaatgcttccagtttttgactattatgaataagatggcagtaaaaatatgtttgtagacatatactctcatttgtcttggataaatacctatttgtggaattgctgggtcatagaatagaggcatatttacctttctatgatagtaccaaacaattctccaaagtggctgggctgtcatacactcccactagcaatgtctaagagttccatttgttcagtgctgcttcttgtggttaaaacgtttttaaaaaataggctgggcgcagtggctcacacctgtaatcccagcactttgggaggccaaggtcggaggattgcttgagcccaggattttaaaaccaacctgggcaatgtagcaagacactgtttccaccaatttttttttttttttttttttttttttttgagacggaatctccctctgtcgcccagactgcagtgcagtggcccaatctcggctcactgcaacttccgccttccgggttcaagtgattctcctgcctcggcctccttagtagcaggattacaggcacccaccagcatgcccagctaatttttgtatttttagtagagagggggtttcaccatgttggtcaggctggtctccaactcctgacctcaggtgatccacccgcctcggcttcccaaagtgctgagccactgtgcctgtccaatttttttttttttttttttttttaattagcaaagcatggcagcatatgcctgtagtcccagctactcttgaagctgaagtgggaggatcacttagcccaggaggttgaggctttggtgagccatgttcattgtactacagcctggatgacagagcaaaaccctgtcttctaaaaaaaataaaaaagaggccaggcacagtggctcatgcctgtaatcccaggaatttgggaggctgaggcaggtggatcacaaggtcaggagttcgagaccagcctggccagcatggtgaaaccctggctctactaaaaatacaaaaaattagcatggtgtggtgtgcacctttagtcccagctactcaggaggctgaggcaggagaattgcttgaacccggtaggtggaggttgcagtgagctgagattgcaccattgcactccagcctgagtgacagcgagactccgtctcaaaaaaataaaaaataaaaaagaattctgtttgtttcatattatcaccaacatttggagttgttttaaagttttagccattctactggatgttaagtggtctatcattgtggttttaatttacatataaaaaagctaatatatcacttggttatgatgtatttttgtattttgctggattcaattagctaatattttttaaagatgattttttagagctgttataggtcaccacaaaattgagaggtaggtacagagacttcccttacactccctgcccccacacatacatagcctcctgcataatgaacacccccaccagaggaacacgtttgttactgttgaaacctacacgtacacatcacaatcacccagagtccatcatttacatcaggattcactgttagtgttgtacattctatgggtttggacaaacgtatgatgacatacatctatcaatagaggatcatactctattagagtatttttactgcccttaaaatcctctgtgacaatttgctaatatcttgttaaggattttggtgtcaatgtttatgaaccatattgatctataatttattatgaaattataagaaaaagtttcatctcctgtttcaatatcagggttaggcttgcctcataaaacaagttgggaagtgttctcttctgtactattttctgatagttgtgtaagattggtattatttctccataaaagcttgatagagttaattaggacaccaccatctatgcccagagttttctttttgcggaggtttttttttgttttttttttgttgttgttgttgttgttttttactatggattcaagtttttaagtggatctatactattcaagttatctatgtttttttgtatccattttgctaagttttgtttttgtaagtttgtctgtttcatctaagttttcatatttattgatataaagatgttcatactatttccttattatctctttaatatacataggatctgggggccgggtgcggtggctcatgcctgtaatcccagcactttgggaggctgaggcaggtggatcacctgaggtcaggagttcaagaccaacccagggcaacatggtgaaaccccatctctactaaaaatacaaaattagccaggtgtggtggcgcatgccagtagtcccagctactcaggaggctgaggtgggaggatcatttgagcccaggaggcagaggttgcagtgaactgaggtagcacagctacactacagcctgggcgacagagggagaccctgtctcaaaaaaaaaaaaaaaaaaaagtcagtggaaggtaaagcaattcttagaggaaaatttcttttaaatgcttgtattggaaaaaaaaggtttaaattgaatgatcttagtttctaccttaagaaaaattaaacaaaaaaagtaaatggaaggaaataaggactgggcgcagtggctcacacctgtaatctcagcactttgggaggctgaggcaagtgttcccgagtagctgggacccaggctggcctcaaactcctgggcttcagggatccctcagcctcagcctcccaagaagctaggactgcaggtacaagccactgcttctggggaaaaaaaaaaaaatttaaattgtctactgcccttctggaactctagttacatgtatattaactaggtgttgtcttacaagttgctgggaatctatttggcttttttgttttttgtttttttgagacagttttcgcttttgttgcccaggccggagtgcaatggcacgctctcggctcactgcaacctccgcctcccgggttcaagcgattctcctgcctcagcctcccaagtagctgggattacaagcaccggccaccacacctggctaatttttgtaattttagtagagacggggtctcaccatgttggtcaggctggtctcgaactgctgacctcaggtgatccacccgccttggcctcccagagtgttgggattacaggtgtgagccaccacacctggcctatttggggtttttaacaatctttctcaaggttcttcagatggagaatgtatattaatttgtctttgacctggttctcctccctcagcctcccgagtagctgggactacaggcacccgccaccatgcccagctaattttttgtatttttttttttagtagaggtggggtttcaccatgttggccaggctgatctcgaactcctgacctcaggtgatccacccacctcggcctcccaaagtgctaggattacaagcgtgagccatcatgcctggctaagcaattgtaattttaaaattgcattctggaccttgtggatgacacattatagagattctgaattttgttatctttctctggagaatattgattttttttttctattagctagttaaattacgtgttgtggctgggttttgtactttgttaaggcaggtctgtttcagtgttgctataaggtcttagggtgaatatttagtcctgggacgtaatcttacctcctaacttggtaagattgaaacttcaaattccgtctctctttggtgagttgcactgaaagctctccttagtttctcagccttctagatgctgctttgccagtcttgttggaatgttgttggaaaccggaaatatttgtgttgaggggtcttaaggatttgaggccgggcgcggtggctcacgcctgtaatcccagcactttgggaggctgaggcgggcggatcacgaggtcaggagatcgagaccatcctggctaacacggtgaaaccccgtctctactaaaaaatacaaaaaattagctgggcgtgatggcgggcgcctgtagtcccagctactcgggaggctgaggcaggagaatggcgtgaacccgggaggcggagcttgcagtgagccaagacggcgccactgcactccagcctgggcgacaaagtgagactccgtctcaaaaaatatataataataataattattattctggctgggcgcgggggctcacgtctgtaatcccagcgctttgggaggccgaggcgggtggatcgcctgaggtcaggagttcgagaccagcctgaccaacttggagaaaccctgtttctactaaaaatacaaaaattagccgagtgaggtgccgcatgcctgtaatcccagctactcgggaggctgaggcagaagaatcgcttgaacctgggaggcagagtttgcagtgagctgagatcaagccattgcattccagcttgggcgacagagcgagactacctcaaaaaaaaaaaaaaaaaaaaggatttgaggacagtttatacaaagatttgggggcttcccactcaaattctttgctttctgggctattcttctctgtactgctattctggcagccctggactccattatctttaaccttaagttgccccaggctgctcaaactgggtagtgccctcagtgtgaaatctatttaaacacagatataacacagtgtgactcccttcttttgagaatcccctctagtttcttcctgcttttcattgctcctcaaagccttcatatagttgctttttcatatttttgtcaagggtttataattgttatctgcaggaaggttagcccaatataagctacttagacattgctggaatgaaatctgtttttcttatagaattagggaacattattgggattgatccaagctaaatatctattagcttaaaatgtagcatttttagtggatgaatagccaagtaaaacagcagttttcatttttaatctattctttctctgaatttggctgagtaaaattttagaatatcatctaacagaaatagttaattgccattttccatgttatctgcatttttttaaaaagttgtacttgtggtataagagccacaaaagcccttttaatcctcctggctagatgctgcaagaggagtatgggaagattccatggagtctaaaatgggaaatgagtatgagatgagatgctgtttgtcagtagtaccactggtcctttcagttttcctagttaaatggaaatctaattttaaatacgacaagtaaagaggaaaaaaatcatttattttctcctatgagccaatctcaggaaaaaaaaatggacatttgaggtgcaaattagtccacatacataacttcccaagcagtcacttaggggtaatagaatctaggtacagccacatctccctggctaatggggcctggcatagcagatccatttctccagtgttctctaccctattttgccattggctcacttcataaccttagataatgagcctcaacttcctcaaataaacctcctttcaatataggctttgacaagtctatggtcagaggagtttttccttttcaatttgaagaaatccattgtattaagtggactttaacctatttaaatcgcaggtttaattctttatgtgtatggtttgttttgttttgcttaaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcaggtgagtaccaaggcatactgtcctcagtcgacagcagtgctgctcatagctttcaactttgtacactgtgcttcgtgtataacctttacaggaggcaaggtgtagaataatctctatcacctagcctactttaaggaaatcggtgtatttgaggtggactcaaaaagaccagcactttgttctctacccatctttgcatattctaggggaatttatagcaagaaaaaaaaccttcaggtatatatccctgtgtgcacccacccaggcatctttactctcaaaataaaagtctaattaggcaggggtctgtaaagcacttaagagctactccttagagaaaaacctagtggaaacacaaatcctaaataagtcctctgagaatccttgcacagcccccattttaaagtggggaatgtcagaagacttagaaggaatcattctctgggaagcagagaatttagaatcttaggtgcagccgggcatggtggctcatccctataatcctagcactttgggaggctgagacaggtaggtagcttgagcttaggaattagagaccagcctgggcaacatggtgaaaaccatcactacaaaaaacacaaaaattagctgggtgtggtgacggctgcctgtagtgcccagctacttggggggtgctgaggcaggaggattacttgtacccaggagatttgaggctgcagtgagccaagattgtgccactgcactcccgcctgggtaacaaatgagaccccatctcaaaaaataagagaccagcccaggcaacatgacgaaaccccatctctacaaaaatacaaaaattagccaggtgtggtggtgtgcacctgtagtcccagctactcaggtggctgaggtggaaggatcacttgagcaagggaggttgaggctgcagtgagccaagatcgcaccactgtactccagcctgggcaacagagcgagaccctgtctcaaaaaaaaaattagaatgtaaagtaaaatagaatcctaggggctaggtgcagattacctgtccttagggagattttttttccgcccacgtgtttacttgataaagagttagaacacactccaggaaatgtcagctgttggctttatgtagtttatgggtatagaagctaaaggctcaagaagctctcttttgttggctgaggtaagcatcttttgtctcttgcatgtatgaattttttttttttttagtttttatttatgtaaaaataaatagagatggggtctcactatgttgctcaggctggtcttgaactcctgggctcaagtgatcctcctgcctcagcctcccaaagtgctacgattatagtcatgagccaccatggccagactgtatgaagattttatcaaaatcccaagtaaattgcaggccaggcacggcaggctgggagtacaggtgcacgctgccatgcgcagctaatttttgttttttgagacggagtctcgctctgtcacccaggctggagtgcagtggcaccatcttggctcactgcaagctccgcctcctgggttcatgccattctcctccctcagcctccccagtagctgggactacaggcacccatcaccacgcccagcaattttttttttgtattttttagtagaaatgaaatggggtttcactgtgttagccaggatggtctcaatctcctgacctcgtgatctgcccgcctcggcctcccgaagtgctgagattacaggcgtgagccaccgcgcccagccaatttttgtatttttttagtagagatggggcgttttgccatgttgctcaggctggtctcgaactcctgggctcaagcaatctgcctgcctccacctcccaaagtgttgggattacaggcatgggccaccatgccccgctgagacctcatcatatcaccaggcctggctgcacataggatttgaaattcaaaaaagaaaaagaaattgcattgcattattctcccctgcaggaaattgttttgttctcttaatgtttgagttagcagtagtattttaacaatcccaagtgtcagaattacagagagaagtttcacttctggcatataacatttctttggcattttcttgactgtggcttttgaattgttagcgtttgatgtgtgtgttcctgtttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttccccagttagtagagtgtctgcggtttttgttctactatatgcttgtccatttttatttgtatctcatggtttgcagactgtttgaataatttatagtttcccatccctgttaaaaaccagctcttcaagctgaaatgctaattatattggcattacattgaattatgtacaaaattataaaatttggttatttaaaattaaaaagttaaatccagtggttttgttaaagattttgcttagtattcaatttttattactgttttttaaaaataatgaatcatcaaagtttaaccacaggctggtgcccgggataacagtactgtaattggaaatggctttactctgaaaattaggttagtgggttggtgtaaattatttatttttgcttatgtacttttgttttaaagcttatttaccccaaagtttattattaattttgaatacagcaatttttaaaatgttacttttatatttatttatttatcatattggtggggggttggggggaaatggtgcagaaaatatcgcaaatgtaatggaatgtaacctaatacacatattgaaaggatgttgtttatcaagtacagagtaagtgcttttccatatatttttatatattcacaacaattttgtgagacatatgggatttactacctccgttttttacatgaggaaaccaagagtccaggagggaggctgactgtcgtaccagccctcacagctatggagaggcaggaccaagacgagaacccagactttctggctccaagtctagtgtgttttcactgcaccacagttacctcctcaaatgctcatttgtggcagagattatcaagatgaactttggtgatttctgattgcctaatgaattgagcagtataaaaaccattttctaatgctggaaaatcagcgttcaccaaggtcaaaaaaaaaaaaaaaaagatggtgtgttccgcagcagcccctcctgcactgtagttcagcgagctttatttgcagagagctgaaatgtggctttttcatttcaagctttacagtagaaaggggaaaacgttgtgctgttttattttacataaatgttatctttgatcaggttctatgatcttgctaaaaaggatggtgacttacttgaaatcggaagcccttcagggttgggcagaacttttcctgcagaaccctttacagatgcataacattagcaaaagccctagtcaaccaccgatcgagtcttcattcttgacagagacacagacccacacagaactccccccggaagcccactgaggctcagaaaggggctgttgggcggggtagaagaccagaatctgcaaaatcgcaggcagggtggcgcccagcctcccagtgctggtcctggctgctggccaggagctcctccccactgggcccagccaggctgctgtacttcccaggaccaaaaaccaagctgtcagcctcccatggccccttagatctgactttgctcaaattccagggtgtttctctttactcccagcacctttgccagttggattgggcagggcttaacctggactgttttggttagcctgattatccctcagctcaaaagaaaatgacctctggcacccagagaaaagggcctagggtcgctgctagtttaacctgacctgccttcttgggaatggggcctcaggagcctggcaaggtggcctgtttcctccaggggaagggtgcagttggtgtgctgacaattgctaggaaagctgctatagggtctcttcacagtgcaggacatggaaacgtccaaggttgaaaaatcccaaaaagacacttgaaataagagtaaacgctagcaaacagaaccaggtggggcataaccctctggaatttgatccagacagtgctcaaggaaaacctctccgtccaaaaaaaccaccctgctttgccc

SEQ ID NO: 13780 - DNA, 49399 bp, Human
  misc_feature (1)...(49399): n = A,T,C or G
ttgggtggggacacagccaaaccatatcagtacctctctcctgacatttactgcactctgctttgtatcgtaagtatcctatgaatatataaaaacgatgagtgactcattgaatgcttaccatatatgtgctaaggtaggcactgtgttggtggctcctctcctagggccaggattgtttctttttcatcttcgtttccctgcatatcttcagttgaagttagtagatcctcaggaaacatttgcaacattaaattgaaatgtatgcaggtgaaattagcacgtttggaaagctgatttccttgaattcccttcctatgccctgagaacttaagaccgaagttgccccctcagatctgtaaatcaaagcagtttttcttaatatttcaggaagcataaagatcattggtcacaagcctataaagaggacataatgccaacgaaaacataggtttgcttgtggctgaaattacattccatcagtatggaactgaagggtggatagaacagaaatatttgctcattggttgagcagacatttattgatcatctgcctctgtgcaattgctgtttgtattagttcattctcacactgctataaagatactacccaagtctgggtaatttataatggaaagaggtttaattgactcatagttctgcctggctggggaggcctcaggaaacgtaaaattgtggtggaaggggaatcacgcatgtcttacatggcagcaggagagagagggcaagtgagagcagggaaaactgcctcataaaaccataagatctcatgagaacccactaactatcatgagaacagcatggggaaaactgtcgccatgctctaatcacctcccatctgttccctccctcaatatgtagggattatggggattacaatttgagatgagatttgggtggggacgtgaagccaaaccatatcactgttatagcttagagttgtacctagtgttccaagtatgggaatggagttagttatcaaaacaaaatctagttacaagtacaactctccttttcatcaattatggtgttgactttcccaggcaggtgtccaggcaggcagcagaccagagcaaggcaagggctagagtcagaatggaaaagtctctgagctccctgctagtggctgtcagacctttttctgttataactaccttttttttttttttacaccaaacaggctaggttagaccatctaaaaacaggtatctgcactgattgtttgtttgagacagaattttgccctgtcacccaggttgcagtgcagtggcaccatctcagctcactgcaacctccgcctccccaattcaagtgattctcatgactcagcctcccaagtaactgggattacaggcatgggccaccacgcccagctaatttttgtattattagtagagatggggtcttgccatgttggccaggctggtctcaaactcctggcctcaagtgatccgcctgtctctgcctcccaaagtgctgggcttacaggcatgagccactgcacctggcctgattcttttcaactctggattaacaaaacgtggtagccaaaatcaagacttttcttggagagtctaccgtgtgatcttcaaaggacctggggagacttgtgtgggaaataccttttagatatactgtattgttatttgtgcaactgaatcatacagcctttctgtgattcaaagtttatttaaaaattaaacggccttagcaagaaattcctgaggatggtctatacatttaaaacatttacctaagagccattatccagttttacttcttataaaggaagacctatggccatgagtcacttgcagtaactttactaagtatttttagttttctgattttcagttgacttccaccaatgcagataggaaatgtctttggagatgaagtcacttgctgttatttttttatatgctcaagattctggctcttacactactgtccccttatccatggttttgctttttgtggtttcagttacctgtagtcaaccacagtctgaaaatattaaggtattttaagacagaaagagagagaggagagaaaccgcattcacgtaagttttattccagcatattgttataattcttctattttattattagttattgttgctaatcttttactgtgcctaaattataaattaaactttatcataagtatgtatatatgggacaaaaacatagtatctacagggttaggtactatttgcggtttcacacatccactggggcccctggaacagattttctttggataagagggcactactgtggatagtaagggaaagttaaaaaaacaaaaacaaaacataaaaaggctatgtattcctatgtagttgggtacagaataataatctaaaatagcacatttgctgccgggctcagtgactcatgcctgtaatcccaacactttgggaggttgaggtgggtggatcacctgaggtcaggagttcgagaccagtctggcctacatggtgaaacgcagtctctactaaaaatacaaaaattagccaggtgtggtagtgggtgcctgtaatcctagctactcgggaggctgacgcaggagaattgcttgaacctggaagatggaggttgcagtgtgcaattgcactccagcctgggttacatgagtaaaattatgtctcaaaaaataataatagtaaaataaaatagtatatttgctgccttctgagaacttggagtgtgaagatacaggaaagttgaaaaagcaaacctggcttcaaaatccagagcccaaacactttgggaaaaacattttccatgctttttaataatttttagctcttccgatttgggaaaataatgtcatattccgtaaaagggctgtgctgtgatctcagaattatctattgtcagaaatatattaaataaagattccaagaaaatggccaggcatggtggctcatgactgtaatcccagcactttgggaggctgaggcaggcggatcactttaggtcaggagtttgagaccagcctggccaacatggcgaaaccccgtctctactaaaaatacaaaaattagccgagtgtggtggcagacacctgtaatcctagctactcggaaggccgaggcaggagaatcacttgaaccagggaggcagaggttgcagtgagccgagatcaaaccaccgtactccagcctgggtgacagagcaaaactccatctcaaaacaaaaaacttccaggaaaatgtttagctcttttttttttttagtgacttttaacctctattaactacacatttttgttgttcttttctagtgctaattccacttctatttataattctttgcttctgctttaatttttgttttcttactttattgtatgattcctttgtgcgagtctcctcaaaccctttgtggataaagcgggactaaaacaagcaagcatctagatgttcgctaaatacatactgtgtaccaggcactgcagggaactgaggactgagaggcaaagatgtgactcaccgcaacgagctcaaagtctgatggaaaagacataaaacagaagaaggtagctaggtgcaatggctcatgcctataatcccattactttgggggccaaggtgggaggatcccttgagtccaggagttcaaaaccagcctgggcaacacagggagacccctttctctatagaaaataaaaaaaataattgggtgtggcaacgtgcacttgtagtcccaactactcaggaggctgaggtgggaggatctcttgagcccaggagtttgaggctgcaatgagctacgatcatacccctgtaccccagcctgggtgacagagtgagaccctgtctcttaaaaaaaaaagccaaaaaacaaaaatcagaagaagtgcattattaaggtgaaattgaggtgctatgagagtacctagaattgacatcttacctgtattgcttgagcaacaaggaggaaccacaggacaatcttctagttaggaagagtgctgaaggccgagtagaagttggccaggactgggaaagggttagggaggcagagtgggagtgggctggatttgcaagctgagagcaaagaggcagaaacctgctcagagaccttgcgacaggggagaagataaaaagtccaggaaagggcaggtgagtgcagagtgggttcatagggtactatcaggctctatgttcagatttgttttttaagattagaagaagactcagggagagacacattcttgtctgcgatttagaaagagcgctgtataggcttcctaaggtggattgcaaagccagagagacttctgagaagcttttactggaatccatctgtgagatgatggtggttcctactaagatcgtgactgtgagaatgaaggggaaaaggaatcaaagagctattaaagtggtggaatttacgggatttagaaactgagtgggtgtgggtgaggcaggagtcttggatgaaatctgagttcattctgttgtttgtttgtttgtttctgagagcatgaacttggctcatagcctcgagtccaggctcaagtgatccttctgcctcagcctcctgtgtaggtgggaccacaggtgcatgtcaccatggctgactaattttgggatttgtttttctagagatgaggtctcactttgttgcccaagctgattgcgaactcctgggctcaagcagtcctcctgcctcagcctcccaaagtggtgctggggttatagcatgagccaccgtgcctggctgttttttttgtttgtttttttgtttttttttttaatttaaataagagcatttgtagatgttgcatcagagagaatgtgaaaaatatagaaatgtcatgtaaattaccgagtgctgggcttggcacatggtaattttacaataaggttgctatctattgttattgtcggctaaactagtctaattaatcttagcagaactgtgtatgaagtgctgttcatagtcaatatttggcattctctaagcagacttaggttggaattgcagcctttcagtccaggggcaagtttcttaacttttcttggccttactttcctcatagaatatcaagccagcaatgcattcgtgaaaatttgagataagagatgtaaagtgctttaagcaacacatagtagaagcttagtcaatgaacaaaaggcattattgttggttcccagcctccaagtgaggccacaggactcttatctatctttgtatctcccatagaccttacctgcctcgaataacatcttacacttattaactgcttaatacatatttatcaaatccatagtaactttttatttcatcctgttgaggcttttcgccctccattaaaagggtttcttgggagggagcggtggctcacgcctgtaatcccagcactttgggagatcgaggcaggcagatcacttgaggtcaggagttcaagaccagcctggccaacagagtgaaaccccatgtctactaaaaatacaaaacttagctgggtgtggtggcgggtgcccgtaatcccagctacttgggaggctgaggcaggagaatcacttgaatctggaaggtggaggttgcagtgagccaagattgtgccactccactccagcctgggtgacagagcaaggctccatctcaaaaaaaacaaaaaaaattcttcttatggttctgttctttaaaaaggtttctttctatggttctatttttatggtttatctttacttacaatttattgttcttgattcttttttttttaacttaaaaatgatgactgacacttcctaatttatgattaagaacttcccttcacaacacccccgcctccatttccgctgctaacccctcatatgagtgtgttcagatgagatcttgttcctggtctggcttaactgtgatacgaattattcaggccatggagctttttctagaattgtcactgggcttcaagacttccaccaaagtcaaaatcagtcggcgatggactacctcaaacagcttgaattgaattaaaatgaaccatagcactagaaaggcatgtaatttgatctgaaatattgcgcaggaacaatatcaagtctcaggcaagacaggcaattagcaactttgtgataataaagaatttgaaatagctcttgagttcataactcgttgcctgcctgtgtgttttggttgggggattcaaaatgtatatgttactattttacctgtgacattacaataagcatctgatggatttacactagtaacattgatcttttcccattttactcccttttactgattataaatgttataaacattaaaaactggaaaatacattaaattgtaatgaaggaaaaaaaatggtcgatcttcactcctcctgctcaaagatgagcttcacattttagtgtctctggctgttaagtcctatttatgtgtagatacatacactccgtataaatttttatcgtatttaaaatacttaaactagttttgtgttttgctttttcaggtaataagagcatttttctttattttcctcatttttttcttcacatcaaagagcatacagaatataagagcatttttctatgtcattaaatattctttgcaaatataattgaatggttgcataatgttccatcctgtttatatgtaaacattcctatgttataagacattttgttgccatctatataatgccataatggactctttgagtataaatcttttttacacatgtctaaatattctcttaagacagattctcaccagcagagcaacatttttaagacttgggatacttactgctaaattacttttcagacaagttgggcaaatttgcacttttgccagcgtgtggctaggaggttgtcatacctccacgctcactacaatcttcctattttcacaaatgagtcaatgaacgggctggatttgttgtaactgtctctcaagtgatgctttctattggattcccacaatatgactactgctaacttttaaggactaagttaccattttaaatggaaagatttcatcttgaatgtgaagctggatatctataaataaaaaattgcagttggttatttggtgtttctcgtattgctagtataagttccttaaatattatatagatattatttttatgatttagcatttatcccatgataaaactggaatcatgtatgcctcatacggattgactgtgtccccacccacatctcaccttgaattgtaataatccccatgtgtcaagggtggggccaggtggagataattgaatcacgggggcggtttcccccatactgttctcctggtaatgaataaatctcatgagatccgctggttttataaatgggagttcccctgtgcaagctctcttgcctgctgccatgtaagtcatggctttgttcctcatttgccgtccgccatgattgagagtcctccccagccatatggaattgtgagtccattaaacccctttcctttataaattacccagtctcagttatatctttattagcagcctgagaacagactaatacagtccttctcccccaccatgttttggggtttatctgaggataataattcctaataaatactttacttctttggcatttggacctctggacagctttttgaaatttgaacagttttctattatgttgtgccatctggaatttatacaaataaaatacactgtgcttcaggtttagtttgtagaagtgagaattttatgtatgtagcttctattctcttcatttctaagaagtcaacatttaaaccagacttcatgttgtctggacataaaagataaagtatttgtagagtaatttaatcgagtaggtcttagggcatagctctccatattacatacccaatttccttgcaaacttcaaccaaaaaaaaaaaaaggaaaaaactttattggaattttagagttagagcacattgtactttattcactttggaataaaccgtttggctctttcattctttaattaaggtataaactagttgtgatactttccttctctttattcggctcaaatgagtctcactgatgcaaaataaacactagatactatgtaactattgggaataaaggaggccttctgcccaccccacctctaacctgacgaagcccctgatgaagtcaaaggaagataaatccacgcagtgctggaatatactgtggaacctcatgatatattcattatgagtcctcctctccagcacaccccagttagtaagttccttagataaaccaaatctatgcacaaatgaactcactattaaaaattagttctcctagcgcttgaacccgggaggcggaggttgcagtgagccgaaatcgcaccactgcactccagcctgggtgatagagtgagactccatccgaaaaaaaaaaaaaaaaaaaaaaaaaaaacagttagttctcctgtaagcattcctgtgtccttaatatcactttctgttcctgccttgcatctccgcatctttttcttcgtctctggccgaatgctgtaaacgctcataaatatcaagtaataagatgcaaagagattgcaaactaaaactgaaaaccttaaagatgcagtttgtcatgaagctgctgaaagagatattggagaaatgccaaaatacctccaaagccaaagtctggctgtgtgactgtggagcatttaaaagcttctcatgacttagtttcctcacttgaaaactggaataatatctgcctgattaaccacatgaaatttgaaataaaaagcaagtaaaatgatacctaaaagcactacttaaataataaagtacctggccgggcaccgtggctcaggcctgtaatcccagcactttgggaggcctaggtgggcagatcacgaggtcaggagttcgagaccagcctggccaacacagtgaaacgtcatctctactaaaaatacaaaaaattagccagttgtggtggcatgtgcctgtaatcccagctacttgagaggctgaggcaggaaagttgtttgaacctgggagttagacccttaacagcccaagaggagaaattggtaggaatggtatcaagacaagtgcttcagaatagaagttgcataacaaccagttaatagaggaccttggttaaaaaagaaaatgatagtcttcaaaaatatttttgcaaaacttttttcatcactggggtacaaaagtcaagaaaagaatgtcatctcacataattttgtcagaaaaatgatcttccctccccaccaaatctaacactcaaataattctttgttctaaccattagggcatatttataatgatgacttattttgattttttttagtgtaaaatcttaagccctttaaaaatgacatattattcggcgttagtctctatattttgaatacctactgctgtgtaacaaaccacctacccatttggggtgctctaacagaataacatagcctgggtggcttaccaaaaaaaaagaaatttggtcaggcttcgtgggtgacaactgtaatcccagcagtttgagaggccgaggcaggtggatcatgaggtcaggagttcgagaccagcctggccagcatggtgaaactccgtctccgctaaaaatacaaaaaattagctgggcatggtggcgtgcacctgtaatcccagctactcaggaggctgaggcaggagaatcgcttgaacccaggaagcagaggttgcagtgagccgagatcgcaccactgcactccagcctgggtgacaaagtgagactccatctcaaaaaacaaaacaaaacaaatttatttctcatcattctgaaggctgagaagtctaagattgaagccctggcagatttggtgtctgggagggcctatgtcctggtttgcagatggtcatcttgctgtgtgttcacatggtggaaggaaggaggaagctctttggggtcttttttataaagggactaattccatttatgaagcctttaccttcatcagttgatcacctctcaaaggccccacctgctaatactgttactggggattaggatttcaacataggaattttggagggacacacacatttatagcaccatccctaagccagaggttacaaacaaccaccattttattgtccctcatcattctgtgggttggtcagattctgccagttgcatttagctgggcctgacatcatttgggatcttggctggactagaatgtccagggtaactcacttatctgctaccttcacagggacggcctcaaggctgaaatgactgggggccctgggatggctggagactctctttctctccatattgtctcagggcctcttctccatgtaggaaggtagccagattcttacattgcaactcggggttttgcaaggcacaaaagcagaagctgcttccaatgatatgggtcccaaactggctttgcatcactttattcacattctgttggttaaagtgattcaccgaccagctctggtacagggtagaagggggctacacaaggatttgagtattggaatgcactgaaggtcatcatggagactaacccactgtaggaagcacattcatcgaaaacgtcatttccagtactgcttatccatggataatgaggacctcctgtagctgtagtcactttggtgcatcgtttccaaaaacctaatgagttgtgatgtcaattgcagctgtcaatctacttttaatcacaggcctcaaatgaagaaattcatttagaggataagcaaattacagcttcagttttgttcataaacttaagccccttattgctaatttttttgaaagaacaagtttatgctgatttgtccaaggatactcagcaaatatttggaaaatagttcaaagtttaatgtataatcataatcctattgcttcttggccttttggcaaagatcaagtgtagtgtctgttcttatcagtttaataatcataatcctgaacatttatatattattattattattttgagatggagcctcgctctgttgcccaggctggagtgcaatggtacggccttggctcactacaacctctgcctcccgggttcaaacgattctcctgcctcagcctcctgactagctgggactacagacgcgtgccaccacacctggctaatttttgtatttttagtagacagggtttcactgtgatggccaggctggtctcgaactcctgacctcgtgatctgcccacctcggcctcccaaagtgctgggattacaggcctgagccaccatgcccgacctcatactttcttatttaagtggtgcttttaggtatcgttttacttgctttttatttcaaatcttatgtggttaatcaggcagatattccagttttcaagtgaggaaactaagtcatgagaagcttttaaatgctccacagtcacacagccagaaaacactggagccaagactccaagttttgggttcttcttttttatttttttaagacagggttttactttgttggccaggttggagtgcagtggtgtgatcaaggctcactgcagcctcagcctcaacctcgcaggttcaagtgatcctcccacctcagcctccagagtagcttggaccacaggagtgccccaccatgcccagctaatttttgtagagacaaggtgttgctatgtttcccaggctggtctcaaacttctagactcaagcaattgtcccacctcagcctctcaaagtcctggaattacaggcttgagctgctgtgcctggcattggggttttattcaaaccacccctccatcctagaattcttttttttttttttttttttttgagacagggtctcactctgtcacccagattggagtgtagtggtgtgatttgggctcactgcagcctctggcttccaggctcaagcaatactcccacctcagcctctcaagtagctgggactataggcacacatcaccatgcctggctaatttttgtgtttttagtagagatgggctggccatattgcacaggctggtatcaaacccttgagctcaagcagtctgcctgccttggcctcccagagtgctgggattacaggcatgtgccaccatgctgggcctagagttttcttttaaactttgaaggatgtgaactggaaattcattctgtctttcgatagatagatagatagatagatagatagatagatagatagatggatgtctgtctgtctgcacatgcatgtaaaatacacattttattttattttttttttagagatggggtttcaccatgttggccaggctagtattgaactcctgacctcaaatgattcacccacctcggccttccaaagtgctgggactacaggcgtgagctactgtgcccagcctaaaatatacatttaaaaatccattgtgcaagtatagctttcattgtttgttagtgatctataggtggtcagtaatatccatttcaagctaaaggaatcactgatgcatggatgccatctggaagttatctggtcaaccccttcatttcacagatgggaaaaacaggtgtggagtggttaaccaagttgcccaaacccacacagctatttagtgaagagccatggattcttacctctgaacccatcattttaccaactagaccacaccacctcaagaatagccttccagatgaaactatgagaggaatatagatattttacatgtttaaaacatttgtctgtagtttgccaggacttaaaagtaatacaaattttaagtgctttactgatcaaatacagctaaagaccagttgtgcagctggctcaaagtatcactgtttctgggaggcaacctatgactagggtttcatgggacagaaaatcccctgtagaaaaagcagaggacagacttcaacgtggagagttcttcatgaagaaaagcaggtgataaccattgtattcaaataacttggtgtatgtttcactctcaggaatatatgttgctagtaaaatcaagaattttacatcaaacattctcaaggcattgagtgtggaaccttctgagaatgaaaagggcagagatgagatctcgtttttcaaattaagtaaaatttaaaggtcagttattccgacagtgtcttgacaataatattgcacttgtcccaactctaggatgttactatagtgagtaatgttgcacttcgatctgggttgaaatactgttttcttcctccctctcccttttcctccctcgtttccgttttttttttttttggagttggagtgttgctcttgttgcccaggctggagtgcaatggcacgattttggctcactgcaacctccgcctcccgggttcaagcgattatcctgcctcaggcttctgagtagctggtattacaggtgcctgccaccacagctgactaatttttgtatttttagtggagacggggttttactatgttggccaggctagtctcgaacacctgacctcaggtgatttgcctgcctcagcctcccaaagtgctgggattacaggcttgagccaccgtgcccagccccatttaaaaaaaaaaaaaatgttttcagttggccactaaacagagaaatttgggaagccactggtaccagttacaagtttgtagaccacagtctacacaaaggccatctgctcaaccctggtgacttgaggttgactggcccaagttaaactgaagagttaatgaagccacaagccgattttttttattcaaggagtctgatgtgttttctgggttttcaaatggcttcaatggatttacttaccagtttaagatgaacacctcacatcaaggaatgcaggatggcaaaagcctgagctgacccagaggaggagacctttcccaggctgacctgtctgcaaaggccttttcccagcactgtcacttcctgggttcgtcactgccatagtcctcgtaattgtttagaatttgcacatttcctcaggttttcttcttacattcttagtcaatttgaaaaaaaaaaaggaaagcttgggaatgaaacccaacattttcctccaacgacaagctgctcatttgtgtctctgagcagttttgctttatttatgtcacagtttaaagaacttgctgggtcccattattgctctgtatccttaagtggtgggatttctttcttttcattcaggcatggttactgattcttttgacagtgtttaatattaaaagttataaatgcacatgcagtagggccattacaccataaatagctgagagagtagaagcatgatgactgtgtccaaggagggactcctggtgtcaccgttggtcagtgtccaggcccaggctgcttcaaagaagatatattgcaggtctgaacctgtatgcacaatggaagtattcaaacaagctttaaaaaaaaaaaggatgcatttaaaaaatatttttgtgacaaatcaaatgtcagtgttaagtgcagtgtttctagagtgcagccgcgctctgtgatgtaacacttcaaaaaatagaagtgctgatctatttgggccagacagcacttttttcttagaagtccatttatttggaggatacttttatagtaccagcaagtccagttagaaagttccatctgctctgcctcttactgcttctggtttcttgccatctacactggtgtcatctcagacaagacactacctgattttttctggataatagcgacatcctatggggctccctgcaggtacaacgggccccctcccttcatccattcgtacacggctgccaggctcttcacttcatattgtctgcaaaaaaccctgagatgccttcccgtttttttgtcagttagggtttcttcagagccaccaaactattaggttggtgcaaaaataattctggtttttaccatcacttcattttactcatagtattaggtcggctctggccgaatgctgtaaacgctcataaatattaagtaataagaggcaaagagattgcaaactaaaactgaaagcgttaaaaatggcagttgtcatgaagctgctgaaataaatattggagaaatgccaaaatacctcaaagaccaagtttgggtgggtgagtgaggagcataagaaagctccgatgacttagtggcgcaagttgaaaactggaatgagagtggccggttaaccggcgtgaaagtagagggagcaggctggtgaaggtgtaccggaaacccgagcaagagtatggagggtcgctggcggggctcgctggagaaggtggggtatcaggaatttggggggcgatacgggaggatcgcgcgcgacgtgaattgactactctgtttcgcgacatttgttgtccacttattcacgacttatctattttcatataactcagtgtgtattcttcactgaagcttattannnnnnnnnnnnnnnnnnnncctaatactatgagtaaaatgaaacaagggatgtatgataagaattagacctttcatggttgggggaggagttgggaaagtcaactgaaaactgatccaccaaaactcagttttgtaatttgactatagcattttttttttttttgagatagagtctcgctctgttgtccaggctagagtgcagtggcgcaatcttgactcactgcaccctccacctcccaggttcaagcaattctcctgcctcagcctcccgagtagcctcccgagtgatgacagacatgtgccaccaggcccagctaatttttgtattttttatagagacagggtttcatcatgctggccaggctggtctcgaactcctggccttaagtgatctgcctgcctcaacctcccaaagtgttgggattacaggtgtgagccactgtgcctgacctaatttgaccattgcatttaaaattgttagacgagtaccttcaaccaggtcaagggctgggtataacagagtccggggtgggagaagagcctatgtttatgaaataaggacagtgtatttcagttaagagaagctctcctcattcacaggtaaaatagagtcctggaaagtcctaccctctgcaattcaaaatgccactgaaaaatatattcaatctacatagacggaatcatcttaagtataatggccagggtgaaatagctgtgaggaactctcagtgaaactaaactaaaattgcccccaaactaccgtcctgcacaccaaatcttcaacaattaggtgaattgtctaagtattttgtagaagttgatttatgcatatggttttagaatacacatattttaaacatgcgtattttaaataagacaaatcctatttatcgtttctggctttcagctgtgctggaggactgtcctctgattctcttctcttatcccttttattttttgtctttaaaccctctgtgctttttcagttctagatgcatcagaattagaaatgttgttccccttggctaggctgtaatagtaattgcagtctatcctcagtcctcagattgttcaaatttcacatttgaagtgcaacagaacttttgacccatgtgtttgtagctctggctacccactttctcactagcttctgtgccggtgtatgtgagtgatgcttaagcctctcaggcatactctggaaaatgccagaagcctgctttgtttgttggtaaccagtcctgtttgcaccattgggtatagctgctctcatcgttccttaccttcttccttgttctgtgaactctcttctctatgggggaaggccatgaataacctcttgcctgtatgttgagaagagagcaacctccaagctgaatgcagagggaaaagggctccctccctgcacaggaagcgtgtattctagatacacactccaccccactcaaagacattccagcttagagcaatgttggctacagtttgttctttaatcgtttcttatcctttgagtggaggttacattgtgtgtgatcataggaagtgccagccagttctgcctgagagcattagaggaatctcccagaagggatgacatttcttaagtgatttttttttcagaaagactcacagcttgtgagcttgaaacgtaccaacattgctctttcaaatatgcatcaattgaatatgcagtttggtacttttctagcaaaagtggtagcattttatcaatttagctcagtttctgcccctctgtgactctctggaacacgtctgtaagatggtcagccagaaggaaagaaacggcaaattaacccatatggaagcttgcatctattattaatggtactgtgatttcatcaacggaaggcatgaactacacactccttgctctcagtagcaaggaataagacactgaacagtaaattcctatccatcatcattggaaaatattgccctgtatagtgcctggcagctgtgtggtgattctctgaagagacactgcctgcttttctcttagccaccatttgaattgcctagctgatagaagtttggcttccagaaaggcactatcaaacaaaatcaatggccatgttagccacaagtcctaagttctgtccaaaagtctaaatccatcatttatgccttataagccaatatatcgcaaacacctgagttccagataattgcagtggcttgctataaattggcctacaattctgtcaccctctgacctctgatgttgttttcaccttgtcttacgtgtgtactatacccttcacaaattttcccctttgttcccccaaatcatctcccctctcatcagccactttctctgaaaagaaataatctaggatatacgtgaatagttcctagaattcgcaaaacaaagctactatttgttgaatatggtctgcgtgccaaatgcatctacaggtatttttacctgtggtatctaatttatttttacgacagtctatgaaatgtgcttcgttattttaatttacagatgacaaaaatggaagtcaaagaaggctttcaagggatatgggggaaatgatgacttcagaacactatttgaaggaacagtttgagagcttggaaacacgtgatgctccttttcttcagttcccagagtctgggactcgagtcctgattttgctcttggccatgcaggagtttgtcctcactattttcagtagctcttgttcctttataaacccttcatttaggaaatgtacttaaaatttttttttttgagacataatctcgctctgtttcccaggctggagtgcagtggcgcgatctcggctcactgcaacctccgcctcctgggttcaagcaattcttctgcctcagcctcccaagtagctaggattacaggcacgctccaccacacttggcaaatttttgtatttttagtagagacgggttttcaccatgttggccaggctggtctcaaactcctggccttatgtgatcttcccacctcagcctcccaaaagtgctgggattataggcatgagccactgcacctggccatttaatttttaatttaaacaaattttttaaaaggaaatgtacttttaaaggaaagtactggaattggagttcttggtatcactgatagacattggtgaacacttaatttgtgctacaaatgaaagcaaatcgaggatagagagggctttgctctttttagagatagccgatttcagtttcaataaatcacaatcgctttcattatggctaagaatctttgcttttcagtatttttgaagtgtgtttctgtgtgccctagacaatcaagcattcaacctgaagaggttcgtttcttgttgttatttcattattcaaccgagtgtgctcctcagttgttttggggaggggcatattctatgaagtcgtgtgagtcagagatcttgtcttttgtttctttatggctctaatttctgacacatcatggaccttcaacagaaatttgtttgcttgggtagtggaggaacagtagaaagatcagttgtggccacgagtgatggttcacacctgtaatccaggcactttgggaggccgaggcaggcagatcacctgaggtcaggagttcaagaccagcctggccaacatagggaaaccccatctcctaaaaatgcaaaaattagccaggcttggtgacacatgcgtgtagtcccagctactcaggaggctggggcaggaaaatcccttgaacccaggaggcggaggcggaagttgcagtgagctgagatcgtaccactgcactctaacctgggcaacagagcaagactctccctcaaaaagaaaaaaaaggaggaaagatcagttgcttcaggatatttaatttagctaaaaagtgacaaatgaaacagtactgatacatggttagtttggatgtaagttattgattctgaatacttttttttaattacaattactgttgatttatccaagaatgcatagctatgattaagagatacaattaagttaaagaaaagtgaactgaatatcaaagaatatttccagtagataaggttaggactaactcaggcagaggactcccagtagaaggggtgggaggcaattaacaccacgcacgtcacttagatctgcagtggggatagattctgaagtcggcaggattgtgagatcgtatctctagttttattgatttgccttcttacatgggtatatgttcacagcctcccaccccttacggacaagagtttatgtgtgtgttaaatattctgattgtagttgtttgtttgtttgtttgtttttagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcaggtaaaaagcctaagttctttgacagtatttgttcataaattcagaacagccagaaccttggaaatgccctgggttcagaggtagctgggcatgctacggaaatttgctagctagcaaagacatctgccagttggggccccagttagtaacactgtatttcataaagaaagtgccaattttgcaagcaagccttgtggtaaagaaaaaagaaaataataataataagtgtcaaggaaagagatcttagtgcactggtcattgcaaaatccaacgtgataatagttagatttgtgtgtatcgtatctgtcctcagtattggcaccacagtctatttgtaaacctcacttttccatcttaagttatgctacctcgattttttttcaccctggattttataataaccagcaatgaagattcactgtagggtgaaacttggcagtcaaagacttggcacatttgtgaatatgtttcagtttcctttcacaaaacaggagaggtggaagaaaattcattcccctgtgttttgtcataatatggtcttaagaatgggcagaaggaagtaaattgtttagggacaaaaagaataaggtgcaaaaccttttttgcacgtgtatgtgttctctttctaaacacacatgtatctatttatacatgtttacacatatatgtatatattcgtatgtatcttccattgcctgcatgacaggcatagggtgtcagctcattctttgcaaaagatcacttactctctggagtattttgtatttcaaaattttttctgcattattttccaaccaggactttatttttttaatgtatttttgttgtttaaagactatgctgatgatgaggattatatattcttccaaccactcttagtggtaactatacatatgaacccaaaagtctaatagtagtatagtgtgctgtgaattttctatgctgtctatgataaaagactggaataaataggagagaattaaagcatttcttgatgccttgtgcggtgatgcaagcgtgtagtcctagctacatgggagcctgaaatgggaggttcacttgatctcaggagttccaagtccagcctgagtaacatggtgagacctctgcttctttaaaaaaaacaaagaagaaagaaaaagaatgacttgatacacgggacatagattcaattcattggcggtctttctatattctagatgctgctccccaggttaagttacagatttttttttgcttcatcctgaatgtactctcattaagtcactttgtccccctccagcttcctaaagctataaatttcttgttaaataatcatggtatgatattatcgaatcttggatttagtgcaacttgttgatttttgatttggccagcaaaatgcctttttccttggccaatattaattgataaatactgaatacatttttaaaagaatgaatgacaaaataaataaattcattcacatactgtggtggatctattttgataaatttcacaacctataaaatatattccttctcactcttccttagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggtaagtaggctgtcttacaaatggatgcaaactgccatataattaatgcatgatcaaattaagaatctacagtaatcagtcaatgcaatactaatcacgcagagaaaaccactaactatatggaaggtagtatttataaagtttcacaactgacatgaataaaagtcaatgctgccatttttgtgtccctcctctgtgtcagatagtgtcctaggtatttcacataagatatttcgcataagtcatttcctttaatttactcaatcctttataactcataacaggtgtcactgtctacttcatttctttgtctcatgggatgctatcaaagtagctgccaattccacttgctcaatgtttaccagtagttggagtaataaagttatcacacatataaagggagggaatgtcaatggtttcacccagagaagaaaaccgcaaatataaatgttcacatttgtgtcacttgtggtttgaatcatctgaattttggaaaatgcaattataaaaaataatagtaataagtatagcatgtgttgggtagtatcatgcattagtttcctattgctactgtaacaagttatcacaaactgggtgcccctaaacaacagaaatttagtctctcaaagttctggaggccagaagtctgaaatgaaactttgtcagggccccgcttcctccaaaggctgcagggagaatctttccttgcttcttccatagcctcagatccagctgttccatggtttgtggctgcataactacagtttttgcctctgtcttcgcatagccttttcctcactgtctatgtcttctcctctgtttgttacaaccacagttgccattggatttatggcccgtccagataatccagaataatctcatctcagatcatttacttaattatatctgcagaccttttccccaaataatgtcactttcagaggttccaagagttagaatatggacctatcttgttggggttcaccatttaatccctacatattattttagatgcataggggacagtaaaatgaatgactaaatgaagaaatgccagctgctgttaattttatgaacaagtctaactgttgctaaggctactcattagccttcagttgaatttattatagaattaatacagcaccagtgagactaataatatattatagttacttctatcttgcctattggagtaaagccatattaacatattgataaatcctgattatcagaccagacagattgctatttcataaactaacagtcctgcaaaatgtattgataaaatgcctctccttatgaggctgcagtgaaccatgaccactacactccagcctaggcaacagagcaagaccctgtctcaagaaaaaaaaaattcttttacttaataaaaaatactgtgaaatcatgtgcaggaaatataaacaagttgtagttatagcagaacagagaagtcagtattaatggggaaactgaggcataataggataaaggtaattctcctggcaaccaggttggtatcaagatccatacttggctatcttgaggaatcttctggttgcactgataaagtagaggcatgcttctatatactggtcacagagacaatgcatcagactgtgaaaactagactctttggacccagtgagaactttgaattctaactctcattggtgtaacatcttggacagcttaatttgaatttaaaacaatgtattttataatgttgccttgtatgatatgggatatatgtagcacatttactgagtaaggatgatactttttaaacattgtgaagtacctcataccttcaaaaatgtattacactaatacttttaaattttataaaatgttttagattcttaaaagcgttgcattctgcagttattatacagtgtaattgttctatatgtctattagaacataatcatttatcatgttcaagtattctgcatttctactaatttaaatatatatatatatatggagagagagagagagagagagagagtctgtctctctgttgcccaggctggagtgcagtggcatgattttggctcactgcagcctcaccctcccaagttcaagtgatcctccaacctcagcctcccaagaagctgggactacaggcatgtgcctccacacctggctaatttttatattttttgtagagataggttcttgccctgttgccgaggctggtctcaaactcctgagctcaagcaagtcactcgtcttggcctctcaaagttctgggactataggcatatgccattgtacctggtcataaatttcttttaattgcgtgcttggcattccttgggattcctgaatgtaaggatgtacctttcattgtttctgaaaagcctcagccattatctctttaaatactgtttcactcacatgttatttatcatctgtatcacaaactccaatttgatatatgtagggctttcttacctatactctgtatttcttaacacctctttcatatttccatccacgtgcatcactgagctataatttcttcagtttgatcttcctatttactacttctctttccaacggaatcaatctgtcacttagccaatatatttggtttataatgttgagaactacatggtttttctgttacctattaagttctagttggttacttttcaaatctgcttggttaattttgatcatttatgttcctttcaacatggtttcgattcaacctttaaaaaaatattaaacatacaatgtataacttgtaattgataaatctaacttctactgcctttgttttactctgatatagtttactagttcttctggctgtcattgataggaggttatttccttatgttttagagtacaattttttgttgtaacatcagacatcttggaaattattatgagtattaggttggtttcctcttacccctggtttttttttttggttatttattttttatttctggtaggcagttgtggcactacttacgtgggacactttatactaaattttttaattgtggtaaaatgtgcataacataaaatttatcatcttttaaacattttgaaatgtacagttcagtaatgttgagtgtattcactccccatggcctgtgacaaacgccattctactttctgtctctatgaatttgactactctaggtacctcatgtagatggaatcacataaagctttttgtgactgtttaaactaaattttagacttgagagacttagacccacacaggtgctatgagttctgacccctcagcttagcaagtgcaggaatggggctatggattctcaagggagactttttctcaacttaccttcctttcactagaagacaagactgagaaagatacatacagataccccttgacttaagatgggttatgttccaataaacccattgtaagtcaaaaatattgtaagctgaaagtgcatttaatatacctaacccactgaacactacagcttaacgtagtctaccttaaacatgctcagaacccttacattagcctatacttccgcagaatcatctatcacaaagcctattttataataaggtgttgaacagctcatataatgtattgaatactgtaccgaaagtggaaaacggaatgtttctcttggtacttgaagtacggtttctagtgaatgtgtattgcattcacgccattgtaaagtccaaaaagcattaaggtgaactagccagggaccatctgtaatctccaaaaactgtatatggggcaagtttttacctacttcatcctcaagggtgttgccttccatataaagggagtagccctttatatgtctccagtctgatctcctactcagttcaagcccaagctctgtcttacttggttcattaataccttttaggcaaatgctagctctaggtctcaacttattcctcattttctcagctctcttgttgtctctgtcccgcgagcaagtaagtgttactttcccaccagctaaaccaagcatttcaaaatagggtgttttttttctctctcttcaatataatgtagtattttacatgcattctgctggaaaggttttctgtgaacatctagtctgccatactgcttgaaactggctcaagatgattcgtaaagaagaagctttctatctccatctatttacagttagacatgtatgtaagttagaaaattatgcttggcacaaatagaaaacaagctttcactggaaaatgtgaaataaacccttacttctaccacagtagtatttccctgctcataaaatcaaacaatatataaattgcaaatgttttctttattgcctagtgatatacatatatgtatacactacacctatatatacacatatgtatatatttatgtatatacacacacatatgtattttttttctgttaaacaataaagatacattaccagatttccatttggctgcagtttcaatatatctctctagaatgggtcagaacagaatggaaaggttgacctgacatcagacaaactcagaacattctagaaaattctgagaccatcgctagagcagccatccattctgtacctatctgatggattattcacggttccagtgcatgaaaaagacatacatgaaagtatgagcatttcagaagggaggcagctagggaacatggctttagaaaaagcagtgcattcggaaaaacataccgaataaagtaacagaaaaaaataatcagggaggcagatgcaggcattgttagctctttgaagtggctgttcacagcaagacagtggccatgctgaagtttgactgggtcagcctctcacagactctctgaggtctgcagggctgtgcatacgatctgagccgtactgaaaggccaaggacttcagctttctgtaacggggacaaatcacaaagggcatgtatttcatgcaacgaaatgcacagaagcctcacgaaacagacctgcatccccaaaacaaggcctccaaaaaataaaaaccaagacaaaatggcaaatcatttcatttcccccatcatgccttttcagacattaaaaaccaaaaaaaaagatctgaggctaccttgtgattggaagataatcaggccgtcgctgtgcttcatagccccctccagaatgctgggactctccaatgggactgaccctcagtcttacctacccatgatcagtttatttttcccctttaaagtagtatttccatcatttcagtatacaaaaataaaatattacagtgtgcccccaatcacattgaagcaggtaaatatttttgaagatatacaatcttcattaggattcatgcatttgtatgggtgcacacacacacacacatacactcattgtgacaacaacaacaacaaattgctacatggctatccaaaaggggcatttgggaccctgagagggaagagttaatgaatggccatcaccttaggagacctcttaactacattgttgtcatgtgaccgttggtgacctgcttaaggtcatttactaggagataacagcttgacaagataaatctgcttctgtgtctaggccgtcccctaaccatctgctccctttaagaaacatgggcctgttggttgctgtgaatttaaccctagggaacattgcagggggctgcccttgatagttacagccacccaaagtcaacatttattggaaaagagcacctggcacttaagtgttcctgtttggtcttaatctatgaaggctttctgcctttcaatcacttactataattttactacctgttaaaactctacccacgtgtccaggtgacgtgtaatgatagcactgccttggcctccggtctaatacaggctagatgcgattaaaaaaaacaacaccccacatatatcctttttgccattcatcttcaaggagattttatccttaatggactattagagtagctgtaggtatttttatgacgacaaaattctttaccaatgaaagctgagtaaaacagcatggctggcaggtatttgggtagcaactatttactgattaatttttgagccccctggaggggaaacagacaggtgctgtgtgcctgaatcttttttctacttggttatctattcaacaagccaaagggctttgatagaaatccagggcctagagtttgattaagggcacaatgataattaagtgaaggaaaatagcgcatcactgtctttgaaaattcctagctgaggaaggtagaggaattgacctaagggtttctgaaagacaacaagagggaaacatttagggaactggccgacagcacattttattccctttgcctctgatcattcgtgccaaattggccaaactcttggaaagctataattttgatatgtttttcatgctcttaattagatgaaataagagagtgggatatcacatcattcattcattccacaaatacttgcatgtctaattaccatataccagacgttgggctgtagcctgaagaacaacccactctctgccttcaaagtcattatttaattataattatggtgatttttaaccttaaggttttctgtgaaaaaccacaaaaaataattatttggtttccttggaacttacacacatttaatccctctgaatattcgtgaattaacgggaagtcattcaaaaacaattccaagcaaatgtttgacaaactgaaactgagcaaaacatcgtgatatcgttaagtagtacaggggtgtttgagaataattggaatgctatgtgcatgtatttgtttgtaacatctagaatcctatgaatatgacactgagtttcttttattcttaaaaacaattttttttttaaatttttaagagtaaaagagacagggacttgctatgtttcccaagttaattttgaactccttcctcaagtgatcctcctgccttggcctcccaaaatgctggggttaccggcttgagccactgagccggccagaaaaattatttttaaccctaaagtgttatgcaaaatttccccacccctgccctagttattgtttactgtgtattttctctcaacatgcagaacgtatggaaggaagaaagggaaagggagagggagggaggcagaaaggatggaaggaaggggagggagggagaagagaaagaaagaaggaaaaaaggaaacagaaagaaatccaggcaaatatctgacaaagtaaaatgcaccaaaattctgtatattcataaatagtgccaaataaaatgcaataaagttatggtgataattaataattaattgtggagtattccagattatactattttgggcagacctgccttcctggtgaaagggaaacgctggccatgtgctctatccagtacattctacccaccaaagccttccacgagtaattttttttctaaagcaatttttcataactctgacaccattcccatgaaatgtgacattttaacaaataggattgccaggtctgtgagatttatcttcactctcctcaataccgtcattccctgaaccgtgtatcgccttacatgaaaaacgcaacctcttttgtgctatgtggtagctgaagagttcgtatggtaaaaagctcttcctgggatgtataaactgtgaaatgcattctaaaataaagttttaattacactttgtaattcggagccaacttctgggtttagtctaatttaaacaagggtttttctctcttgcagccatctgttccttttgcttaagcctacacttaagtcataatattgaaagggtgacgtcactccttccttatgatgtcattaaacatttctttagcgacccaagcagtcagagaactgaataagtgatggggggagatgcttgttaaaatatggataatagcatactgaattattttatttttcattcccagttattctccaatatcaaaaatattgttcaatgaaagtcatgcctccgtgcaaaaagaatcccataaaaaataaatctttgaaatacctacgtatttggtcataaactagtacattaatgcaaacgtaccactctcatttttggcttgggtctggatcaaactaaaattcttggcaaattattagtggaagtagcaaattacatatttttaatcataggcaatatttagaccacacattaaaaacttacatcatctctatttactttctatttttgacatttaaatttatttttaattaattgagatcagttaaatttcttcaattaagaatttctcagctctcatagttgcagtggagctgtcattagcagtgtaagaatatacatgaataatgttttaaaattatgttaatatcaaattagagtatagtaaattaggttacaatcactcaattatagtaatttgctttttttaaatattgcattataaacattttaaaattaattttaggttattaagtctataattctagctgagtttagtaattattttaagtagttgttgaaaaactttaaaaaaataagaattccacatagctgtacaaatattcattggttctaaattgataaactcaagggggaggagtacaaagattttttggaattacttttttttttttttttttttgagacagtgtcttgctctcttacccaggctggagtgcagtggcaccatctcagctcactgcaacctccacctcccaggttcaagcgattcttgtgcctcagcctcctaagtagctgagattacaagcgtgcactaccacgctcagccaattttgtatttttagtagagacgaggttttgccatgttggccaggctggtctcaaactatcgacctcaagtgatccacccacctcagcctcccaaagtgctgggagtataggcgtgagccaccatgcccaaccttcaattacttttttggtaaacaatttttaatgatcagtcactgaaattcaacaattttttcaataaatcagttgtatatataagcattctgttgttattttatttgtatgccaatttttaaaacatacttgatcaagtctgtaagttttatcagggaatgcaatttatgatgcataaattcagatgtcagggcctgagctagttccatgagccacatagagctgccctcacaggcccaccacttgcccaaggaattcacagagtcaaatggctgaggagttacaattaaatcaaagctcagcacaatggaaagggcactagattaggagttggaatacctgcattgtgggtcactttaaagaacacccatgctttcctttctttatttgtgcagtgacattaatacgtgacataattatttcaccagtctattgtgagtttcacagcctgctccttgttcttgttatttaatggtgccaacatctaatcagttgcccaagcaagacaggcttgtgattctcctcctgcgtggctgtccctgtggtgccaatgcctcatccttcactcttgctgctgtgctccgtaatctggctaataacagcgctatttacccagctgttagcctaaagacctccagatacaagctctcctgtccactcctctggtgttctctgaattcagcccctcatttatcatttgaattattataagtctccaaacacaaatccctcccttagttttggtcccagatctagcctccacaatccaccagatctttccaaaggcaaatctaattatatccctgatcctgacttaaaagcctccaatgggtcacctttgcctcaggcacaaaatccgaaggtcttggtcttctggttccctcgcctccctccaccttatctctcgttattcccagtatgcacacagtctctgagccaaagccacactgaccatgtctttgagtgccctgtattggttgtccttatatgcatctcacacatgctattctctctgctaggaatgttctatttccccttatctatttagcagaatctttcttcagaatgcaattcaccaggggttttctcctctatgaagcttttccagaaacagccaaccactgtttgatatctccttctctttgccaacctagttcctagcagcactcttaccatgacacttggtaaattctgtatagcaagtatttgtttccgtgtctcttttccacagtagatactgaaattcttccaagatgggactggtgttatttgtgtttgctttcccagctcatggctgattgcaagtaggtgatcaacaatttcttgttaaatggaatgatggatagatggatggatagatggatggatgattcccctctcttctccccttcctctgataaactacacccttatattcaggaacagcaagctccctttttgcctctcagcaggtggttctctggatttttttttttttttttttgagatgaaatctcacactgtcacccaggctggaatgcagttgcgcgatctcggctcactgcagcctttgcctcctgggttccagcagttctcctacctcagcctcccaagtagctaggattacaggtgcctgccaccatgcctggctaatttttgtatttttagtagagacgaggtctcaccatgttggccaggctggtctcaaactcctaacctcaggtaatccactcgacttggcctcccaaagtgctgggattacaggcatgagccatatgcccagcctctctggatcattcatcttgatccctaccaacatttgtctaaatggtgtcctttaagactcaactcaaatgaatcaaagtgaatcaagtgaaaaaaattaagtgcttcattcttcgttcgcaatactgtgtatttatttgtacttcaatgttttttagcacatttaactataattattagcttaaacatcttccttctgcagactttaatttccttgagacagcatcttaaatttcttattcgtgtctatattcctaacacagagaatagcacaagatagctgatagtagatgttcactgaattaatttatgaaggtgtgtttcaatgtgtgaaatgaaataatatacctgagagttatttgaaactgtaaagcccaagacaaatggtaggtgcttttgttatcttgatcctacccacggatcaaattctttcctctgctccttagttctttctagctagggagcccacagacccttgtctaaattatcacttcatgcagacttcctttctcccacacagagtgcattttgacattaaactaaacccctcagcatatggataagatctagaatataaaagggggttgaaaatagaatcacctgtcttgcattatagtaccagccttaagaaactgggtatatgataactgtattctgacaataaagagccgaatcactttggacaccatttttttttttagctgatgacaatttattttccctaaatttatgcctgtttcttatatacagaaaagttacttactagttgagcaaaagtataaaatatgcagcagaggaaatgatatcatatgaatgacatgaacaagtacttgataccaaaatctggtcttccttctgggaaatcccaggatgttttgtaaatgacattgcaatcatttcatccaccttgaagatgggacttttcttcagtgtgaaatgcggtagctcttctgtgcgtcacaatcacttcactgacttttcaggggaagaagtgaaaaataccgaccttaaaagctgggaaagattggagtaagaaagaatagaattattcatggatggccaggcgcagtgtctcacactgtaatcccagcactttgggaggccaaggcaggcagatcagctggcgcatcagctgaggtcaggagtttgagaccagcctggccaacatggcgaaaccctatctctactaaaaatacaaaattagctgggtgtggtggtgggcacttgtaatcccagctactcgggaggctgaggcaggagaatcgcttgaacccaggagatgaaagctgcagtgagccaagatcgcgccactgcactccagcctgtgtgacggagcgagactgtctcaaaaaactaaaataaaaaacaactctcaagaagtattcatggatatagaatgcagaatgaggaaaactggctgaggttagcacctccactcttctaagatgtgctatgagatcattggtgactgggagggacaggacctctgtttaatcctcatctgctggatggcacacagagttcattttcccatggtaatatactgacattaggggtcaaccctctccaagtgaaaaagaaagtcacttgcataaatgcaacttcagtagcgctttggcagtccctggaagccatccagctgaatgtcaatttcacatgggtaagtcaccttgttagacgttcacggcgcaaggtgcttgttcctagatgtcactacgatggtgagtgtgtctccgtagtgtgagtgccttggaggaggaacggagttgccctggtgcctgggtgttcttacccctggaggggcagcctggtttaagaacacggcctcaacacaaaagcagtttgggtttgtttgaagctcttcaggttgagacctgagtttatcttttctgagacttaaagtcctcatctgtaagatggggacagtcacaccttcctgatagagcttctgtaaggattaaatgagctggggctgtattaaatacctgatgactatcaggtgttgattttcttgtttcccgtcccaccccttattaatatctcataccacatactacttattttcaggactttcctttgaaaacctgtgtgatcactcacactattttcttcccctgaattttgcactcagtttgctttgtcaataagaagaatttaaaggaattcattcccttttttatttttaatttaattattttatttatttatttatttatattttggagacagggtctcgcttgctctgtcacctaggctggagtgcagtggcttgatcgtgactcactgcagcctcaacttcccgggctccaacaatcctcccacctcagtctcccgagtagctgggaccccgggtgtgcaccaccctcacctggctgattttttgtatttttgttagaaatggggttttgccatgttgcccaagctggtctggaattcatgagctcaagtgacccttccacctcagcctcgcaaagtgctgggattacaagcatgagccactgtctgcagctgaattcatttcttaattgccttcacgttaatgtttagttaccccaaggaggtcatatcaataaatgtcagttaaaaaatcagaaaaaaaactgcatatatatgtatgtatgtcttggttttttttatgacagcaaatttctcttcccctctttttctttctatttgtttgtttatgttatagaggcagggtctctctgtgtttcgtctcaaactcctgggctcaagcaaccctcccagaggcttggcctcccaaagtgctgggattacaggcatgagccactcactgcatctggccttgcccctttttttttaactgcattttcctaatgtctaaaatatcagcctaattgcttcccttctgaagcaatctcccctcacgtgtgatcatgaaatttttaagagcattttaacagaggaaccagcttccccaaagtcactccgctttatataagtttttgagcggataagaattcatagggattacttttttttttttttgagacaaggtctcactctgtcacccaggctggagtgcagcagtgcgacccaggctggagtgcagcagtgcgaccatagctcgctgcagcctcaaactcttgggctcaaatgatcttcccacctcagcctcctgagcaactgggaccacaggcacacaccaccacaccctgctaatttttaaagtttcattgtagacacagggtcttgctttgtttccaaggctagtctcaaactcctgagctcaagggatccttccaccttggcttcccaaagtgctgggattacaggagtgagccaatgtgcccggccaggggttacttttgaaacttacatgtgtggatgaatcttatgggacagtgttagtcttcctctagaaagacatctctgcttattgtgagattcttcagtgaacgtttataacgtaggtaacatttatatttcattgcatctggagaattgggtccctacagtccctattcatcttttattttttatttgtttatatttctttttttagagtcaggggctcactctgtcacccaagctggagtctagtggtgtgaccataggtcactgcagccttgaactcttgggctcaagcaatcctcctcactcagcctttcaagtagctgggaccacaggcgtgagccaccatgcctgccatctccccattcctcttttattttatttttttatttttgttttttgagacacagtctcactctgtcacccaagctggagtacagtggcacgatctcggctcactgcaacctctgccttccagggtcaagcgattcttctgcctcatcctcctgagtagctgggactgcagcacgtgccaccacacccagttaatttttgtatttttagtaaagccagggtttcaccatgttggccaggctggtcttgaactcctgacctcaaatgatccacctgcctcagcctcccaaagtgctgggattacaggtgtgagcccccatgctcagccaatatttgtaatattcatttcttagttgacttcacactagtgtttagttatccagagggggtcatatcactatatgtcagttaaaaaaatgaataactacacacacacacacacacacacacacacacacacacacacatgcacacacacacacacacaccccatagtaagaaagtaagcagttgtcatgattaccatagttcctttctctttgatcatgtcattcaaattgtctaaaataactgtaaagatttaatcctgcttactatatatagttaccctctgacttagcagttaaaaatctccacaagtgaatcctttcttacctttctgggattttcactttcttccccccatactaccctttgatggtaaattctccatttttcaagtgcagtgtgagggtaccacggggaggaaatttcaaattaaaaattaaagcacactctgtgcacattcagtcattgtaattctggaaaatgtcctttgagtaaaaaacaatatttagcaataggagaagccatacagtatggtggtttacagcgtaagttctaactttgagatgaatttaaattctagcacatcaccttgagtgactatctaatcaagtcccagtttctcagtcttcagaattgagagctgctgggatcatggagggtattaaatgagataatacatataatgcactttgcacaatgtcagacacatagtaagttctcataattgtcagcatgatgataatgatgctaagtgactttactttttattttcaattggagctaaggctaaagagttttctaaggctttacatttaccacggacttttcactaagtatatgcctcgatatagcactgaaaatttaggaaagttattctcaaggcattgggccaaaggacagaaaaagacattaggagcagaaataagagtatgatccaacctgtaactggtgactccatttccgtgctgactcctgccctcccccagtaccctgcccatattggataattaacacactgaatttactcaaaaggaaaaatactaaacttacctcttcccgcttacattactttaattgtgtatattttgtttttttcaagtatggttctttggggaaaacagaatatgttttctatagaaaaacacatattctttcagcctagtaattttggaagcaaaagatggtctccatggtaagaagatggaaaatgagtagtattaatagaagatagcacagaactaatgtacattttatagtagaaaggaaagattttttagcctccctgcctaaaacaacatcgtgaactctaagttatgctaatttggtgaataaatgaaaaggagccagccagggtatgatagctcagaatgaaagtcagtagtcaactcccaggaatctcacaggaaaggagaaacttcccgcacccgtggcacagggaggcttaattggttctcctgtggtttataagaaaagctttgatcaggtgcggtggctcacacctgtaatcccaggactttgggaggctgaaacaggtggatcacctgaggtcaggagttcaagaccagcctggccaacatggcaaaaccccgtctttactaaaaatacaacaattagccgggagcagtggcacacacctgtagtcccagctactcgggaggctgaagcaagagaatcacttgaacccgagaggtggaggttgcattgagccgagatcacgccactgcactccagcctgggcgacagagggagactctgtctcaaaaaaaaaaaaaaaaaaaaaatctctgaaaatacttctgacctcttagaagtagattcatggacacatgatagtgctttttttttttttttttttttttttttgtatttttagtagagatgggttttcaccatgttggccaggctggtctcaaactcctagcctcaaatgatccacccaccttgtcctctcaaagtgctaggattacagacgtgagccaccacacccagccacatattagtgctttttgttttttgagatggagtcttgctctgtcacccaggctggaatgcaatggcacgatctcagctcactgcaacctccacttcctggtttcaagtgattctcatgcctcagcctcccgagtagctgggattacaggtgcctgccaccacccccagctaatttttgttttgtttttgtttttgtcttttgagacagagtctcactctgttgcccaggctggagtgcaatagtgtgatctcagctcactgcaacctccgtctcccaggttcaagcaattctcttgcctcagcctcccaagtagctgggattacaggcacccaccactatgcccagctaatttttcgtatttttagtagagatggggtttcgccatgttggccaagctggtcttgaactcctgacctcaggtgatccacccacctcagcctcccaaagtgctgggattacaggtgtgagccaccacacccagccatttttgtatttttagtagagacgtggtttcactatgttggctagactggtctggaacacctgacctcaagtgattcacccacctcggcctcacaaactgctgggattgagccaccgcaccctgccacaaagtagtgctttaatcctcacatcgtggagttgccaaagtaatagaaatatcagcatggataaaaagccaataagacaatgactgtctaatgttcccaactcatctccacgccaatttccgatccgaaacgatcccttacatttctctaggtccttcattcctttcatgcaatgtctaatggggtatatttttccttcattcccttcatgcaatgtcttccttcccttcatgaaatgtctaatggggtatatttttccttcactttttttttcccatattgttttctgctaggatgtttttattccttcttagctctctgtgtgattggatctctacagtggtattttggggttaccttagtgcatctctttttacttgttataatgcaaatttcttgatataatctactcttgctctgtactctacgcttgtctgtagcctgtacttgtcttacatttctctcctttccctttcatttacataatcttacatcctaaaatagttacattctttatatgacatctattgaaatgagaagatatccataaaatttatcataaaataataaattttatttaaaaaataagcactccagagcataaatatctgtatgagtattgtgccttcaagaaaatgtgggaatgatattctttaaaggctttagaattaattttagaaccactttacaatcttcacaagaaaatcaccctgctaccacaaggcaaagcctcatgtgttacccagattagcattactcacctaattcaccagacctgaggccagatttcctttaatagttttcacagttcatagcagtctttagaggatgaaaatttaccccattaaggattctcaaaatagtgtgggggcatcttctgaacacagttctgagggagaattccaaacttgctctggaataatggaagcatcattaaactaagtctgtagtacccaagtactttagaggggaaaactcctttttagatgagtaagttctgttatttctagtaacaaattgaacttactgttttatactcacatcattaagagccatttcagaagtgtctgttactcgacttcaactatgttcttgttcttgtacattgtgtgcttaaaacttctagtatgtacatgtggaaaatgggctcttcataataacagttcatctgtcgcattgtttctaggactattcttgataagaaagagctcttggagtttgctcaacttggctgctacttggaatatgatctctttggtactgaactacttcattaccaactcggcccagatattgacatgcctgatgataacaaaagaattagaaggtaaatatggtaaagcctctcatagcattccctttccctagccctttttgattgtcatatctagggaagtattagcaaagattcagaaaacagtaagcaggccgaaccacagacttgcagagaaaaatatatctatgctgtttcagggagaaaaatctctctatattattttaaggagaaaatgagtcatcctaagtaggctaaagcttagcagagccttagaagttcagtgcagatgggcagctgacaggaaacacagataatacccaacccctgccatgaaaatcagagaacaaaagacattttcctctatttacccctaatgaaataagctgttcctctctcaggttgaccacactaaagccataacttcctacaagtaatatttgaaatgctttatcaaaagttttcattaaaaaggtgatttcaagttaaatgctaaaagtataaggtctaaagactaaatattatgtaaaatgaatgcaaccttccaaaactgtataatgtgtgatgctggcagataattgtaggagtcattctttgtaatcaagtagaaaattttaggcgtcaatgatagctacctagtttggtcttggtcacatggtgataagaagattgaatgaaccaagttagaatacctaggaggagaaataaattggagattgacaaggaagactttcgtttgggaatatctaagtgttgctacccagtgaagccctaagatatggtttgtatgtgatagttgaaccgtgggaatgaatgacatcactcagagaagaagatgaggacagagacctggggacagagacatttaaggaatggagtaggaaccgttgctcaaggaaaggtcgaggagaagttttcaaagtgataacatgagagatatatattcttatggaagtcagtagagaggaagtctcagggcagaagggcttgaatgccggtaataagtgacaaatatcaagggaaataaagactgaaaagcatccattggatttcacaattaggaggctcacattttataaacagagtgcaatctcagtggaaaaggcttgagaaatgggtgggccgtgaggaagaggagagaggatgttgaggtgactctttcaagaagcgtggcagtggagggaagcaaggagatgggtctggagttacaagtcaataaaggatcaagggaagcttctagtaagagttgagcaatgtttatgtgacttaagagcaaaagcagagacagagccagagagaatgagtccagggaagtggtgcccattccacagggttactatagaattgacatgaaataatgttttccaagtttttgtctgagtgtctggtgcagaatatggaagtgttcaatagatgttgactttaaaaactctggatagataagaaatatagagcaaggttcctaaggcaacaaatagatggaatctggggaacaaatagaaagtcggttgaaaggatgctttctccatggaaatgagagggcatgacacagcgatggggtgaatgcaaacagaagtcttagtgagggaaacaggagactgaggacacatggccacatgtcctctagtgtctctgtgaggtggacatggttatctcctgagaaaaaaagagtggatttagggcagcactgtgtagagcaggagaaaggctaggaatggctgtcaggtcaatgagagagatcttgacatggatgtgttatgtgcgagacctagttgagtctagaaatcatgattgcatgcctgtgtattggcaccaatgcacacgatttggtgattattttccaaagcaaaactgttttgcgttttggtagtggaaccagagaagttgtgtgcgtacaagcagaaaatgggaacagttcaagagattgagggttgggattctatctgaaagagatggataacaatggaggagttgagatgagggtcatgggatccaagttggagggaagaaagcatagagaggaatggtcagatagacaggaaaagcatagcagggcaaataagtggactgcaggctttaatgaagtgggtggagcatatatatatatatatatatgttcaaatatatatactgtatgtgtatgtgtatatatatatgtgtgtgtgtatatatatacacagtagaagaagtgagtggaaaaagtagaaaaatgtaacatgatcggagtgggaaactgaagatggagatttcagagggggagcagtagttccctatgataacaagaactagaatataattatgagaacagaaaagtggttgccgtggaagtagcaaagctggaattgagaagtgatgtccaggaaccatgagattcaagtattgctagttgaataaggcacactgggttgaggggaagatcttgagccagtggtcatagttgggacatcctgaggatctttccctgggaagtcacatttacgtctgtatgccttctgctgtctccaagtactggcattctgccttgatcacctcattaatagtactatgcttcaagtttagtatcattagggaaagctagttaatcagtgttgcattagttaagtaagatggcaactctcaactctacatgagcaaatgacttcacctgtcttgaccaatgaagttctgtcttttaatactcagatcagttatttgacaagtagatgtattgtttctttgtttatttttgttttattattttaatttacttgcccaggaacccgattcaatacaggtgaacctgttcccctaaagccctagtagttagtttatactcagaggagactattccttgcctaagggcatctggaatttaaaatagtgcagtgcattcagtcattctcatctttcacaatctcaaaaacatgatttcctgatcaatgccctcaacatatgttttatttcttttttctttttttctttttcttttttttttttttttgagatggagacttgctctgtcgcccaggcaggagcgcagtggcgcaatctcacctcactgcaagctctgcctcccaggttcacgccattctcctacctcagcctcccgagtagctgggactacaggcacccgccaccacgcccggctaattttttgtatttttagtagagacggggtttcaccgtgttagccaggatggtcttgatctcctgacctcgtgatccgcccgcctcggcctcctaaagtgctgggattacatgtgtgagccaccgcgcccggcctcaacacatgttttctaaatcatcttggaaatgggaactttgcactctggatcggcttccttttccgaagcccctttgtggtagtgaggtgcatcttttgcacacctgtgtctcgcatgaggctcccagaccttctagaacaagagaaagaagatccgtaaaggggcatctgtgaaggagatagaagggtcagatgaccgatggctcccccagcattccttcttagctccttttagccatttgtttaccctttactgtgctaaatatagctattctggatgtatggaaataataaaaattattataatataaatctgtgtatatatatataaaatacctgtgtgctattccatacgtacgtgtatgtgtgtgtgcttaatcttccttaaattaaaccatgcattctcgcttgacccaaggacagcccatgttaagcactgaatgcccttttgggttgcgtgtgctccagtacccactgtcttgcacacttgattttcatcatgcatgaaaggaccacagggtccttttctgagccatcgtagtcttaaaccttgaagtgcatgaacacagaagcacgcttctgcctacctctggtgttcagcaccagaaattctgtgtctaacacctgttttcaatcttctgctccatttctcaaatcttattatatctctgccttttcacactttgtagtctctctctaatatttgtttgcaaacactaactcatttgtatttctataattaccgtgattttttgtcttctcgtctgtagtggctcccccttttctggcagcatctctgtaactcctgttcttccatataatggcacaacaggagagatgatcttttagtgtaagcaggacggggcaggttttcttcatagtcaggatatgattgtgtgtccagagccataacgttatctttctcataagtagtctccagattcttgacttaatgggttctaaggattcccggttttaagtatgagtatcttgtcctctatactctttcattctacttcatgatttgataacattgtgtttcaaggtctgacaaaggacatcttaaaggaatttgtttatccacatgatctgcctttatagtgtgagaaattatatttatcagataagaaacataggcaaaaattttggaaaatgcccagaaaatatcagggagaaagtgtttcctaaaacctcctataccgtgatacttctttgcagttgtggatcaaggtttgtcaccctaagcttcagtattgtgtgtgcattctgtcaaatctttgtctttttatgtgataatataacttatcttagataattcccctaaactgagtgtgttccaaaagtaactgcagatcagaacttcaggatagtatacaaatttcaatgaggcaaaaaatcatagtggcacaaaagtcattacatgcacttataggacaggcatggttcttctctgctagtgcttgcattcctttgacctgcagatacaaagtctattcttccattataatttattttaaaatatgtgttctcagagggcagggctttgtgcttgagttttttttgtgtgtgtagtaccccacgttttgctcactgtagtagttattaaatatgactcatgtactaggacaccaagaaatgcttttgaaacaaaaaagatacctttcaaataatcagcctctggaggaaggcactgtccgtccgtctagatccactttagaatctagacgccaaaaaaactattcagagaatcccatagaagagccattgtctgtgagtggcatcttctaccatcaaagacccatggaagtcacgacagacactgcccagagtccagacacgtacagatggtggctgtcaggaggtgactcacactacagattccagcatttaacaaagcaaagaggatttcatttttagagaatagtcaggaagctgttctttagtccactgactataaatttaaaggaacagcttattattttagcaatcttgctgacatggaaagaagacagaatatatttgtattggtcagtttaatccaatgctcagaggctacaactaaatcaaaattgccatagacttcaaaggggcaaatggttaaaatgctgaccaaccttttttcagtggctttgtagcttatcaaatgcccctcacttgcagaccaactgattttgctctcagaatattttacttgtagtgagattccttttgtttccctattttaatcgcaaacagtccttgatattttttggccagataaaaggagagagcaagaatgagatctgaaaaatgggcccacagggagaggcatttgagagaggattgctgaatacaaatccagaacaaagttatttagtgaaatgccaaaatggtcattcatccaaactggcacatcctattagaagctatctttaatgcggtattgccaggcatggtcataaatgtcacaggttagaaatttctgtatgcatggaataaggatatgttcctgctaggatgcagcaatatttttatcgtcaccacacaatatttattaaaggtctctcagtacacacgccacagtagaagtcagtatctttacgacaagcacaataggttaatgagtaaaaagttgaaagcatcctgaaaagcgaaaatgaaagacaaatgacatctaatgagttaacatttttcacagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcccagtgaatctaaatgtattcagttgacaaaatggacacataagggctttttctaaataccgtacataattacacattttcacacttagagggtaatcctatgatacactgtcaatctctatttttaaagactatcaccagaaaagagagaaaagaaaattcatataagaaaaagaaaatgtgaaaaagatcataggcttgggaattccctcaaatccagaaaattccaggttaaggcttgaagttgaatcattcccaggtctagctctaaggttaacaagagtacaaggcaaacaatttctttggggacaagcagcattatttcaattagaccttctcct

SEQ ID NO: 13781 - DNA, 228851 bp, Human
  misc_feature (1)...(228851): n = A,T,C or G
gaaacaaatgcagggtgttattataggccggcagtccaataggactggtgtccttagaagaagagacaccaagggtgtgactgcatagagaaaatgccctggagggacaccaagagaagacagtcgtccacgaggcaggggagaggccacaggataaatcaaatctgctggcaccttgatctagaacttccaggattgtgagaaatttctgttgtttaagccatccaggctgtggtatattgttacgacagccctagccgactaacacaggtactgtatgtcttcagcctacctaggcaagattcactattagaaattgatagaataagaaaaattctgattgcttcaaaacaggacttttgctttaaaagagttaatgattcaagaaataaatgtattaggagattacctactaatacgtattgatgaaattatgaagttagaaaatcatcagtggatgctaaaacttgtgggtaaaaattagatgaggaatggggtgtaatcaagtagcacctccccccagcattatttttaatcataaagaaaaaaatagtaactttatggtgaagaaacctggcagacactaccttatttaagtgaacatcacctatactgggagaaaccgatgccatctgtaccttgatatcatgcactggaaaagacacatcgctttagtggtgtttctccaaaaattcataacctgaaagggaacatcaaacttactttgaaggatattccacacaatacctggtctgtattcttaaataatgtctagttcaataaacataaaagccaaggacggttccagatcaaagaagactaatggaggaataactctttcatctggaatgttttttaagcaagaaatacctgctttcgaatttaagagtgcagatcctttttttatccaattggttcggagatataattacattattttaccacatctccttaaggctttgatccctgctacaatctacaatatataaatgcatatgtgtggcatccgtcttatcatcaatttaggtgaccagtagaagaaaagtgcctggtgccaatttttattccatagtataaaatagtctctcaggacagggtttttggtgagagaagcacaggatgttgctgggtgactgagaccgggtcaggaaatagggaggcagagggcaacagtttctctagaatttaaaatttggttgcttttggaagagaaagcaagagattcctggaagccagaacgtcatgtttcacaaatgtaaaagtcctagttgggaaagacacatcgctttagtggtgttttcaaatgacttttaaaatagtagggttttacttgtaggttctagctacaagtaaaaaggctaaaagccagccttagaaacctgtcaaaaaagatttccagcagggcgctggggaaacgcagaccgcgccggaatccccgcctggagaagctcttaatagggcgggaaactgcgtgccccacaaggtccctcagaggcacattgtggagacgggctcagggtagcaacttctggcgagtggagcggctattacacaagcgaaacattcggaagcaatttacttccagctttcgcaacacccaccctgagccaccaccctcccttacacagtcacgccacaaacttccccacttccgcccacagccctctgggcttcgacccatcaactgagcttgcgccaagtctactgcgcacgcgccaacttcggcccaatcagcgtcccaaaccgtggggtggacgccaccgggataaactatcctcagcgtggggcggggtctcgaagccgaataacgaacgtgattagccagcctcttccacagacttttaagggcggagcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtggtgagtgtgtgcggtgttgcacttggggttgcttctcgctgcgtggccgcagcggggctgaacccttcccactccatcccctccccgcacccggaccagcccctgggacgccctcggacgcccacccgctccaaccctggggaagcctcagagtggcagcgaaggcctcttgcctttccgcctctgcgcttgctgtcatcgcccacgtgctttgttgttgttcggtgcagaccatgtccaagtctctgaagaagttggtggaggagagccgggagaagaaccagcccgaggtggacatgagtgaccggggcatctccaacatgctggatgtcaacggcctctgtgagttctcgggcaggactctcccgtggatgagctggaaggctttctaagtttgccaattcactgctggtcctgctgtgagcgattgtactggtttagaccccagcccctgcttgtaaacctcacttgtcaggggcttcgcgcagagggtttgcagtaggatttgttctgttccacctggaaaacgatcctgagagtccacgatgagaatcacacagacagctgtgcctcatcggttgtctctgctgtatggcattgaggtggattttccacagtttgcttaatagtcactttaattataaattgaaaattaattttgagtccttcttcctgtctcctaatacagtctttgtccatgaacaaatgacacagaaaagttccatggttaataagcattcttgtgcctggagcgttttaagcatttcttgaatctttacattcttctgagtatttattctccgaacttggttcaggcttttgtcacctcctcatgctgtggtgaaatcctcctaacttgccctcttgccttcagtttcactgcccagtttaatcactgggtcactttcagtgtcattttcctgtaacccctgtctatggtgttaccctctcccttaaaaccagggattgcagattcacatgcctccaagtgagggcggtcaggggcggttatgaactaggtgataggtgtcccacttgaaggggccagctgctgcacctgctactcagacacatgtcaccataggaatgttggcccaatgtgccagattattttcttaaaggaaccaagattctatatttttatgtgaaatttgctaatttttagatgttggctactaattctaatatttgaaaaacctgtgataagtgagctaaagcagttcttcaggctgacgtggctttggtttaaaccctctccgcacttctccaggttgtccattatcgacggtaatgctccaggtttcttggcgtgatgtacaaggcctttctgaatctgaacacaaccttacccttccatgcagctggcattccagccattctgaacctgttgcccttcctggaccagagcctactcgttcagatcttggtgcctttacaaattctgttttccctctttctcagtcgtttgcacctgaaatccttttacttctaagagtcagcttagacatcaccacctgtgtaaaaccttatccgtctgcaccaggctaacatatcccttccctcctctgtgaaggtggtcgtgtgtattgctttgtgactcctctcacataggattgtactgatttttttcttttttaatctagaagtctctcttctctgctgggacattgggaagacaaaagctgtgcaatattcatgcttgcatttttttaataatagtgcctggagcacagtagatgctcaaaaatagttgaggaatgaagaaaatgaaagaatgatggattaggcctgtgagtttgggatatcaactccaggatgtgacaagagagaagaagggagatgttcaggagaccctgaaaggcgatggatagccatttaggcatggagagaactgcagagtcaggtttactgtgaattcacggttttcacggttcgaaaacctgcctgggacagaggttggagttgatgctattgatatgtcttggcagaaggaaaagggaggaaacgtagatttgcgtttcgtaggctttatgaaaatacgtgccattaaacttaggttgtgtactagttagcctctcaggcttggtgtgtgttggtctcttgcattccgtaagggtccttgctgtcagcaactgagcagatgcctctggaattggatatctgagtttgccccttgctgcgcctgcccggctctgccatgaccatggtcattattgggggcactgttgatacagaggagaaagagaaggggatagggaagatgatgcatagcgggaaccttggccccatggccttcctccctacagcactcattctcaccaggtagaagagaggctgctttcagcagaggagctttgtacccttcggcttttgaagaggagactttatgtaatatttataaatggggagaatggcttagctatttcggttcagctccgttatctctttgaagccttggcttttattaaggaagaaaagatagccacttgcttcctgaaatatatttccggtataacattgggtggtgaaaagcgagatcattcttaaattttcctaaagaagtagctaacaacggataatagtactttttgggaagttgggtggaagtgaatttggagatttgcagattccacctcctctggcttctgtagcattgagccaaggctgctctctgcaaactccctgacctcaggacttctcggagcctagggggttccaggatgctcttcgaagcctccaccagggctcacttctcagcagtgcacacacactgacacagtgcttaatatatacaagtattaaaatacttcacatggctacattaattataagtgtaagaatttttttttcttttttttttttttttttcctgaaaacagggtctcgctctgtcacccaggctggaatgcagtggtgcagtcacagctccctggggcctcaccctcccaggctcaagcaatcctcccacctcagcctcccgagtagctgggactataggtacacgccaccacgcctggctaatggttttattttttatttctttgtagagatggggtcttgctatgctgcccaggctggcctcaaactcctgggctcaaggagtgcccccatcttggcctcctaaagtgctggcattacacatgtgagctaccacacccaacctccatgtttctttactgataaacttttagctgtaaccaggaagttttatatactagtatccagcttaaacacagcttaaacttgtatgtacagagaatagctgtttcttgcatctcaagttttccctttattattcttactttgtttaatttctcaagaggttagaattaagctttgaagataaaagtaaggttttgtactactaagcatatgagatgcccgtctttcttcctgggagagttgtatcttctaacgcagcccttccttagagacagcaaattacctttaaaagatgttttgaggagtttaggtaccaagaactttctgatggggaaaacttcttaggctggagacaggtatcagacaggttctacagttttctagtagtccagccagattctagaaatgctcacttcctaccatgagaggcagaggagtacagcacataggaggggaacctggatttggatagacgtggattcaaattctgctagttagtactgtgtaaccttagagaagctacttaacctctctgatcctcaagttacttaataattggtagcctaagaaaccacttcataagactggtttaatggtttgcgttaaatgcaataatgcacattaaatgttagttattaactagtgttagatccaataatgtacattaaatgttaactattaatatgaatatccagctatagacccatatgtctcagacatacccagttccaacatagtcagtagcctgaaccaagaactttactttgttaactcgactgggtaaggcatttgtatcaggtgttggaattttttgtgtggcttattagaacctgtagtgtttggtacttttgcctaaggttctaattgatttagatagctatttatttaaaatttgtcctaatttatttattttccatcattttgttttaacatggcatgtaatttgcacacacattctcgttaaagcttccaagaacaccagtgtgggcaatagagtgagaccccatctctacaaaaaattaaaaaatgagctgagggtgatgtgcaagtcccagctttcagggaggctgcggtgggaggattgctggaacccaggagtttgagtttgtagtgagctatgatcgtgttactaggtgacagaacaagaccttgtctcttaaaaaaaaaaaaaagcttcccagcataatcgtaatgctgctgattttattctttttattaaagagatttcactgcagaaactctttcccaagcagcagctgtcttcatctggttgataaagttgattttgaagggccctgtaatcagcttccatttccatagagacagaatcccagctgtagccggaggaactttctttcatttctcttatttaagtgtttcctgattttttaatctcttcaagtgtattgccctctctgggtggtcaagcctttatcattttttttccaagttagactaaaatatttttcagataaatctcgaaaacaacctgctttcaagggagtggtctttctaaaggaccaggcaaaataataaacaaatatgatcatgggttatctggaagagctatctcaaaagtcttgttaaacctggaacacatgctatccatgtcgaccttctttgggggatagattaaagagctggggaggacctgtaattttagatataatctattaaaatcatttttttgttttttaatttttgttttttgtttttgagatggagtcttgctctgttgcccaggctggagtgcagtggcgtgatctctgctcactgcagcctccacctcttgggttcaagcgattctcctgcctcagcctccccagtaactggggttacaggcgtgcgccaccacacctggctaatttttatatttttagtagagacggggtttcaccatattggccaggctggtcttgaactcgtgacctcaagtgatccacccgccttggcctcccaaagttctgggattacaggcgtgagccactgtgcccggccttaaaattatttatgttttcactcctctaggttgtgtgtatgtgcccacctttctgtttttaaacacgccgcttcttggcctggggagcccttttcgtttttctcgctccagctagcccttgcccccttgtcagttagtgcttgttgaaagaaggaaggacttaactattcacatgactccatttcctgtgacctcctcaaggaggcccctcgagaatactcagttctgacccaccatcccatccagcctagctgaagtgtctctctacttggcatagtacttgggaaaaatttattgaagaaggaatgttactgcttttagttaagagattcaggttggctaagggagaaagcatagctctggagaaggagcatgtactctgtctccttcctgcaggcttctccgcagtttccagagggaagcagtttccagctatcaggaacaagatggaactgacaacttctatttttgattgtatgatagggttaaaactggaaatgcttcattgaaacaaagaagaggtgtagcccctttggcatgactgaatcggtaatggcatttgactttttgtcagtcctctgacattctggctctagtggccctggtggcttttttgtaagcatcttttttgtttgctactagctgtgtatccttgggcaagttgcttgacctctctgtgcctcaggtgcctcatctataaaatgggaataataagagcacctcatagggtcattgtgaattaatatctataagggcctagtgtaccacccggtacctgatggtcttaatacttgctattattagaacactcatgcattacttaatggtggggatacgttatgagaaatgcataataagattttgtcattgtgtggtcattcccagaatgtccctacacacacccagatggtgtagcctactacacacctgggctagatggtgtgcttgtgactcaggcttttgctcttaggctacaaaactgtacagcatgtgattgtatggaatcccatagggaattgtaacatgatggtgagtgtgtgtgtctttatacaaaaacatacagtaaaaatatagtacattattgttatctcgtgggaccgctgtcatatttgtggtccattgtttgtttgtgtttttgagacaaggtctcactcttgttgcccaggctggactacagtggcatgatcttgcctcactgtagcctcggcttcctgggctcaagtgatcctcccacctcagcctcccaagtagcgtagattacaggcacatgccaccactgccggcaaatttttgtaatttttatagagatggggtttcgccatttctcccaggctggtgttgaactcctggactcaagcgatctgcctgccccagcctcccgggtggttcattgttgagtgaaacattattaagcggtgcatgactattgtaaaaaccattttatctgtgatggtgtaacaagtgcaaaacaatatctttatttcttggaaacgttggtgatggtacttctcagtggtctttgcccacctgtcccatggtcttgtcaaaccagcacacccactgccttattcctcacctgagtcagaattcccaggagaagttgggcggctgggcccagtgtgctagggtcaagaggaacagccgttgccacacactggcgagttcagagctgtgcatagcccggggggcggctgctgggggaacagcagcaggattttcgttgggatgtgcttgtggccaagtttctgttgagaatggcagacatgctttgaaaactggtaatttttccactaataattaaaatactctgtgtcctgcagtaactatttattgaatgtatttttttatgataggcattatgtaaccagagttcgtttgggagtttacattgaattttttaatttctatttttttatttttttattttttgagacacagtctcactctgttgcccaggctggagtgcagtggcgccatcttggctcactgcaacctccgcctcccaggttgaagcaattctcctgccttggcctctggagtagttgggattacaggtgccagctaccatgctccgctaatttttgtatttttggtagagatggggttttgccatgttggccaggctggtcttgaactcctgacctcaggtgattcacctcccccccccacccccggcctcccaaattgctgggattacaggtgtgagccaatgtgcctggtcttatattgaattttaaaattatctactgagaaattattgtttgttatgttaagatgactataaggtgtctattacatgtgaagtagttatattttcaccataagaactataacactcactgctttgccattataaccaatgctacaattggtatggataataattgaaaaccataccctgtattatttattcataaattcacatgaacctagttgaaagaaaacacaatctagatacaggagatccattgttagagaaaagactagagatgactttttttttaattcagcgtaaagacctcttctttggatagcaagtttgtgcaggtgggttaatttttttattttttaaaccaaaggatgatgtaaaaatgtggccaaggagcatttggtctagatcaagtgtgtgagcagcaggggtcagtgttgagcctctgtgttttgctcctgggctccctgggaggctggacacagctcgtctcatctccacacagagctttgctgcctctacagttcttccaccttcattcgccaggttctgtctttgggtagagagatggagtcttaatggcattttatctgtgtagctcacagtgaaagaaatctcacgtatgttacagtcaaccagagcatctttgaggttggcatgtttcacagctgccttgcatgtggcctctgaatagagaagtgctgatcagagcatgtttccaatcaaaggaaatggaatttgcagtgtccccattgagcagattccatcagcgtgtgatgcttaatgctgtaaaacagtatttcaggtttgaggtgctagcaaagcccaaaaggccaataataggattaatagtacctactttgttaatgtcctacggctgcaaaacaaaacaccgcaggctgggtgattttgacaacagaaatttatttcccacggtcctggaggctggaagttcaagatcatagtgtcagcagggctggctgctcctgaggcctctctcctgggcttgcaggtggccgtcttcttgctgtgctcacatgatcttccctctgcatccctgctgtccctcagtctgttcagtttcctcttctcatgaggacaatagtcagattgggatagggtccaccttaaggacctcattttaacctgatcgcctctttaaaggccccatctccaaatatagtcacatgttgaggtatttgggattggggcttcagcatattagttttgggaagacatagttcattccataacatctagattagaggttctcaaatgatacagacctgagtgcctactctgtggtaagtgcttctcacactcataacatccctctttggttcacctaccgtcagcattttatagatgagaaagtagagagctatggaggttctataaagtccccagtgtcactcaggcagtggtggaaacggagttcactttgttttttttttttttttttttcttaaatggagtttcactcttgttgcccaggctagagtgcagtggcatgatcacggtcactgcagcctccgcctcccaggttccagcgattctcctgccttaggcttccaagtagctgggattacaggcacctgccacaacgcctggcgaatttttttaattttagtagagatggggatggggttttgccatgttgaccaggctggtcttgaaatcctggcctcaggtgatccacctgccttcgccactcaaagtgttgggattacaggtgtgagccactgcgcccggttggagttcactcttgagtgtgtctgaaaggtttgctgtgtgatactgtgctgtgttgtatcctagccccgaagggctcaccagggccaggcttggatgccaaggagaggtgactcctagggcctgccttaccgtaaggcattcattttcagaattctttttttttttttttttgagacagagtcttgctgtgtcacccaggctggagtgcagtggcgtgatctcggctcgctgcaagctctgcctcccaggttcacgccattctcctgcctcagcctccccagtggctgggactacaggcacccgccaccaagcccggctaattttttgtatttttcgtagagacgggatttcaccgtgttagccaggatggtctcagtctcctgacatcatgatccgcctgcctcagcctcccaaagtgctaggattacaggtgtgagccaccgtacctcgtctcagaattctttaaaacactgtgttaagcaaataaaatagtgttattgggctagccctgccagcttggaaacttgggtttacaggatggttgcagagctttaactgttgaagaaaacataagaagcaacttaatctccatcaatattagcagaaccctccccactttctttatggtttcctgaaaaactattaatctcaatagaatggaatgatcagatgtgagatctttgtataccgtatgttaattcattttcttttgtcttcaaacttagaacattagcttaaaacactacaaagtatggggctggaaaagattgtgttggggaaatattggttcatgtatcaaatagaataaacctgaagtacattaaatggtagttttagttatagtatccatacctcataaagatccttcttatttcatccgtttctttgcatatccattaattattcctttggactctgtgtaacttataattttaagggtgaggccaaatgaaaggcacacatcagaacaagcaattacttgcaaggaggtttcgcctcttagtttttcaggacacagtgcagaccggagaacggtaatgtggtttgcaatctcagtgtttgaatggtggtctatgtaacttggtgttcttaacagctgtaagtgaggctgggcgcagtggctcatgcctgctgtaatcccagcctgactcatgcctgctgtaatcccagcgcttccggaggccaacgtgggtgggtcacctgagtgaggtcaggagtttgagaccaccctggccaacatggtgaaaccccctctctactaacaatacaagaattagctgggtgtggtggtacatgcctgtaatcccagctacttgggaggctgaggcaggagaatcacttgaacctgggaggtagaggctccagtgggctaagatcacgccattgtactccagcctgggcgacaagagtgagactctttcaaaataaataaataatgaaacagctgtaaatgcttaagtctttagggcgtgtcaaagatgcctatgtaatttattatatgtttgtattctacaacgttgtgcactctttgttaggaggatgaaaataatagataatatgattgaaataccatgccatctatgcatggagtgtattaatataatacacgcacacatttaccacataccaggcattgtgctaagccctctgtatggattaatctttcaaacctcacaatgtattgtcattatatagttaataggtaaggaaacagatttaaggagcatcattaacttgctcaaagtcacccaggcaataagtggtagagcccagatttgaagccacacctgcagacgtcggaagcagtgttctcagcttctcctgttttgccttactggtttctgacagtcatatgcacataccctgtggaggagatgaagataacggctaattcagcgagcatgctgagtgcctgtggccacccggtcatgttctagaagccatggtagctgtcctgtctgggctaatgattctgtaacaatttaggaatgcattcagggacactacctatgtttatcccatttgaaccagggaaacaggaaccttcatcttcccaaaatacttacacatagttttaaaaaaatctattccaaaaaaccttattgaagtattcgtatcgataagtgcataatgacagtacaagttgacagattttcaaagcaagaaacattatcagtaggttgggagctggtgctcctcctagtcactctccctttaagtcctgagactgccagcctcctgagcttatactggtagttccaatggaaatacataacagaatgcaaggcttttacttaactcctccttctagtcctcatcttgacctcccttccactcggaagcgtgcctcttacagatatgggtgatgatagaattggaatatctcacagtctcagatttggtacctgacacgcaattaacaatactaatattactaatgccagtattgctaaaaacagttgtcttatgcatatgctatcttcattctccctctttaaaaaaaaaaaagctttttttttttttttttgagacggagtctcgctctgtcggagtgcagtggcgtgatctccgctcactgcaagctccgcctcccgggttcacgccattctcctgcctcagcctcccgagtaactgggattacaggcgcccgccacaacgcctggctaacttttttttttgtatttttagtagagacagggtttcaccgtgttagccaggatggtctcgatctcctcacgtcgtgatccaccctcctcggcctcccaaaatgttcggattacaggcgtgagccaccgctcccggccaaaaaaaggctattttttgaagagcagttttcgattcacagagagctggagcaggaagtacagatccacgtctctcctccatcccccgttcctagtttcccatattaacatcttgcattggtgtgttacgtttgctatgattgctggaccaatattgatgcgttattattattattattatttgagatggagtctcactctgtcacccaggctggattgcaatggtgtgatctgggctcactgcagcctctgcctcccaggttcaagggatgctcctgcctcagcctcagcctcccgagtagctgggattacaggcaggcgccatcacacccggcaaatttttttttaatttttagtagagatgggttttcaccaagttagccaggctgttgatgcattattattaactaaagcttatagctaacatcagggttcactgtatatagtatagttttatgggttttggcaaattaatgtaatgtattcaccgttacagtatcacatggaacagttacactgctctaaaaatcctctctgctttacctcttcatcccctctccctcattatctacctccaaaacctcagacaaccactgaaatgttacagtttgtctctataattttaccctttccagaatgtcatatagctggaatcgtagggtatatagcctctacagattggctacttttgcttagcaacatgcatttaagattccgccatgtctttttgtggttcgatagctcatttctttttagcagtgaataatactccattgtctggatgtaccacagtttggttatccattcacctattggatgatattttggcagcttccaactttggacaattatgaataaagctggtgtaaacattgttgtgcagatttttgtatagacagaagatttcagcacatctgggcgaatacctaggaatgtgattactggatcatgtgataagattatgtttagctttataagagactattaagctgtcttctcgagtggctgtaccattttgttttctaccaataaagaatgaggtttcctgttgctccacatcctcaccagcatttggtgttgttggtgttttggattttagccattttagtgggtatgcagtggtatctcattgtttccatttgcaattccttaatgacatatgatgccgagcatcttttcatatgcttatttgccatatgtttatcttctttggtgagatgtccattcagatttttcacgtactttttaattgggttggtgttcctgagttttaagtcttttttttatattttggatactagttctttatcagatatgtgtgttaacaaatactttctccttgttggcgctggtctttcattcccttaatgatatttttcacacagcagaaatttttaattataatgaagtcttatcaagtttttccttcgtaagttgtgcctttggtattgtatctaagaagtcattgccaaatctcaggtcaactagatttttctcctttgttatatctagaaatttttatagctttgtgtttttcattaggtctgtgattcatttggagttcatttttgtgaacgatgttaggtctttgtctagattgatttttgtgtgtgtgttgatgtccatctgtttcagcaccgtttgttgaaaagactccttttctcactgaattgcctttgcacttttgccaaagattagctgattatatttgtgtgggtctatttctgggctttctattttattccagtgacctacttgtctattgtttcaccaactccacactgtcttgttactataactgacattaagttttgaagttggtcagtgtcagtgctccaactgtattttcttcaatattgcattggctgttctgcctttccatgtaaattttaggatcagtttgttgatatccataaacttgctggtattttgactggaattgatatgtagatcaacttgggaagaactgacatcataacagtgttgagtcttcctgttcatgaacctgaagtatctcattgtttatttaggtctttgatttcttccatactagctttgaagcttttctcatatagagcttgtacatattttgttagctatatatctaaatatttcatttgtttggtgttaatgtaaatggtgtgtttttaatgtaaaattctatttttttatatagaaaagcaattgcctttgtatattaccttgtatcctgcaaacttgctgtagttattagtttcagttcttctttgttgattctttgggattttctacgtacacatcatattatctgtggagaaagacagttttaattcatcctttccaatctgcatacattttgctgctttttcttaccttactgcgttaacaaggacgtccaatctgattttggctagaagtggtgagaggggacatccttgccttgttcccaactgtagtaggaaagcaactagttccttaacattaagtatcttgttaattgcaggttttttgtagatattttttattaagttgagaaagttcttcctctattcctagtttgctaagagtttttatgggtgttgaatttttccagtgctttttctgcctctatgcatataatcgtatggatttccttctttcacctgtttgaagtgatggattgcttttgtttttgaatttgaaccacctttgcatacctggagtaagttccacttggtcattgtgtgtactcttagtacatttttgaatttatttgctaacgctttgtagaggatttttgtatctatgtccatgagagagattggtctgtagtttctcctttttgtaatgtctttggcttaatgagttagaaattgttctctttgcttctattttgtgaaaggtattgtagagaattggtataatttcttccttaaacgtttggtagaattcatgagtaaacctatctgggcatagtgctttctcttttagaaggttattaatttatgattcaatttctttaatagacgtaggcccactcaaatgatctgtttcttcctgtgtgaattttggtagattatgtctttccagcagttggtccattttatctaagttataacatttttggacattgagttgtttataatgttactttattatccctttaacatccatgaaatcagtagtaatggcccttctttcatttctgtttgtaatttgttcgttctttttttttttttggttagcctccctacaggattaccagttttattgatcttttccaaaaaccagcttttgtactcagagattttctctattatttccccttttaagtatcactgatttctgccctaatttttattaatatttttctgtttacttgtagttcaattcattctcatttttcttgttttctagggtagaagtttagattattgattttattaggttggtgcagaggtaattgccgttttgccattacttttgcaccaacctaatagaactgtcttgttttgtaatacatgcatttaatgctataaatttcctttagcattgattttgctgcagttcacaaattctgataagtagtattttcgttttcatttaattaaaatatttttaaaaattttttgacatttctttgacatgttatttagaaatatgttgttaatgtccagatgttttgggatttttcagctatctttcgtttgatttctagtttaattccaatgtggactgagagcatatattgtataatttctattttcttaagtttaaggggtgttttatggcccagaatgtggtctatgtctatgaatgttctgtgcaagcttcagaagaatgtgcatttttctgttagatggagtagtctatagatgtcaattatatccagctgatagatggtggtgttgtgtttttaactctgtccttactgattttctgcctgctggatctgtcaattactgatagagtggagtcttgacgtctccaagtataatagcggatttgtttctttctctttgcatttctataagtttttgtctaacatattttgacgctgttgttagatacattcacattaaggattgctgtgtctttcttggaaagtttaccatttaatcgtcatgtaatacccttttttatttctgataatcttccttgctttgaagtcagctttgtctgaaattaacatgactactgcagctttttttgtttagcgtttagcgtcatatctctttctccatcccgttacttttaatttagttgtatctatattttatatttaaagtggatttctcatagataacatatagttagatcctgtttttttttttaaaaaaaagatccacactgatagtcttataattgatatgtttggttattaacatctaatgtgataattgatattacttagattaatacctacaaaataagtgttttctattcttgcccttgttctttttttttttgtcttctgctctttttctgctttccgtggctttaattgagcatttaatatgatttcattttctcttctcacaacatattccgttttctcttttctcagcaaatgtacatttaaaaatttattttttagaaggaggataaagcaaggaataaaaacttcttaatgatagccctagagtttgcaatatacatttacaattaatcttaactcacttttaaataacactgtgccacttcagagccagtgcaggtaacttaaaatcagacatttccagttccttcttgttgttctttatagaatcggtatcattcatttcagttatctgtaaactataatcaaccaacatgcctgttacgccttttgtaattatcccattgttcttagatattttgtcttacttttctcctactcttctttctctttgcttttcagtttaggaagtttctgttgacatgtcttcaagatcactgattctttccttgactgtatccattctactaatgagccagtcagaggcgctctttatttttgttacagtgtttgtgaactctagcatttcctttcaattctctcagggattttgtctctgctgacattacccatcttttcttgcatgttgtctactttttccattagagctcttagcatatcaatcatattaattttaaagtcgcagtcagataactgtaaaatatctgccatatccgagtgtgcttcttttgcttgatttctctcctcagcctttcttctttttagagtaccttgtaattttgttgtaagccagacatgatgcattgggtaaaaggaactgaggtaaataggcttttagtgcgagttctcacatttttgtagctttgggtgtcagagggtaaaattttctcttgtgtcttccttgtgttttcctccccttttctcttagattttccctgttgaatccttaaatactgtgtgagccttgaacttctgccgtaattccgtattattttataggaccccttctgatgagaaggcatcgggaaaagggaaacgttctgtaatcctgtgcttagatctctctagtgagcctgtgccacttggctgtgaccttcacagctgtttctcaacttccccgcatcccctccccgcccccggctaccaaattgagacaggaaggtgtgagcgggctggagttgggtatttccatcagttcctgttggtcaggctctggtaaatcccaggtagcctaggctctgctaaatcatttctctgtttgttaaggagagcagaatgctttgggcttctttcacagtggttgctcttctccccttccatgaagcacagagggatttttttttctaattttttcacccttagaacctggtagggctcttagaggtaaaactcagcaaagtacaggagaccccttaagaccgggcccccaggaacttgttgttgtttttgttgttgttgttgttgtttttaatctctcaaattagtttaccactcagtctctggcaattcggcagttacccttgaggcattcctaccggttgctggctccagcaggtatttctgctcctactatgctgtgattctctgtgtttgcctgtctctagatttcggtatggtggtttgccctgtgacctgagttttctaatgaatctatggaagagttgtttgttttctgtttgctcagctttcttcttactgtgagtatggtagtgacaacgtccagaatctctatttgctaaccagaaacccgatacatctctaatctggtattaattttggaaatacggctccctgctttttagaatttgaactgtatctagattttcagcacatatagccatttcctatgatacagtctctcctttagccctcacgtagtcttagttctacaggcacccctatcttttatgcgcattaggagtccttaggacaatgtatctctagttattttgattgtctgaagcttatactctggaatattcctcagaaaggcatcaagagaataatcccagagttttttctgtggatagtacataaaaatttgtgttctttttacatgaaagtcaattttacaggtatagagactcgacagtttcttttctggagtgttgtcgatgtgttactctatttcttctggcataaagcattgtttgaaagtctggtgatacaattttatttcctgtaattttactggagtatgacttggtgtagggcgtaggtcattctggtctgattatttcccaggtatgtagtatgctctttaaagtttgaaaattgtattagtctgttttcatactgctacaaagaacggctcaagatgggtaatttatgaaggaaagaggtttaattgactcaccattcagcatagttggggagacctcaggaaacttacaatcatggcggaagggaaagcaaggtgcctttttcacaaggcagtaggatggagaagtgctgagcgaagggggaagagccccttataaaaccatcagatctcatgagaactcactatcgggggaacagtatgggggaaaccacccccatgattcagttatctccacccggtctctcccttgacatacgaagattatgaggattacagttcaagatgagatttgggtgggaacacagcctaaccatatcagaacttttaaataccttttatttcaagaaagtatttttattgtgatttttagtctatgagctctttccttatgttctttatggttttctggggtctgtatgttgatttttttgcccatctttaatatttgtcacttttgcccagatccctgttcttgcttcatttctttgttttaaaagaaatccctcatgcctataatcccagcactttgggaggccgaggcaggcatatcaggtgaggtcaggagttcgagaccagcctggccaacatggtaaaaccccgtcgctactaaaaatacaagaattagccgggcgtggtggtgggcacctataatcccagctactctggaggctgaggcaggagaatcccttgaacccgagaggcggaggttacagtgagccgagattgccccgctccactccagtctgggcaacagagagagattccatctcaaaaaaaaaaaaaaaaaaaaaaagaagaaatccccactttaacttctgtttcttgtaaagtattacgtattgtgtttatttgctcttatatgtctttgaatttagctttcatttctgaaataattttttttgtttctaatttttttcttaagttttgtccctttattgctgaatttttggaaatcagatttatgtttctgttttgtgtcatgtatcattgttgtaatggctttttaccttgttttgaaatagtcaattatagttttgccctgtgttctgggcatctttttggttagtgagttttcatggtcaatgatgttcttctacactttctttttccttttattccataataacgttatgggatttgctcccaatattttttatgttgctcatttttaaatgaaattaattttcctaaactttcagaggaaggcttagttctagatagcttttctaactttacagagctctgtcctctggttgattttatgtagttttcagaaatacagtggcttgctttcagatgacttggttcagtccttctgcccacttttatctggatcttctctatccttggtctctttttctctctctttttaaaagcgttttatttttacttactgctccttgtggagtagggctaccctataggcagtgtgcctctatcattggtctctattatttctgtcttatccagctttgattctaggccctgtcctgcaagggagccctaggtggtcagtttccaggtcacagggcctagacttgtcctaatccatcagaccctactgcaggccctgctgttggaatgggcaaacccttcctaatttcagctgctattctcacagaggtcttctgggctttctggtgaatttgtttagctattcgggggttctcagttgtcaagtttgttagttgccccttgggttctctctgctttcgtcacatgcatgctgatatcatgccaatctttgggttactggtagcttgtcctcatctacttgtattttggagttttttgtggggacactttataacctagttttgttgtaaattgtgtccttgaattttttcttgctgcctagtttctctattttgatgtagggtttcaggattcctaaaatctgccatgctgcctccacgtttcctgcacctacactttttcctccttggtacagtgggaaaaataagcttctcctcaaatgaaggataatgtgtatgtagtatctgatgcagaccaggtactcaaaaaatgatcattgtgatgaacagtttgacaatttcatacttgttgagcagtggcatagtctgttttgaagctgccattgtgggagctctgataagagggggatttaggggtgaagagtctaatgggcctttggggtgaggaaagaacaagagggtgagggtttgtgggtgtcattgatggcagatttgtttgcagtgttgagagaaaggtggagggaatggactggagcaggactgggagaagagacatcacacacagtgaagacgtagcgaggccctggagcagatcagaagaaacacacctaagtttgacttaggggctgattgatgatcaatgtcaatctaggtgactggttataggattggagaaggcaacacttggaggccaggataagggatgacatgtggggagagaatcaaaatccaaggttaaaaataatggttgagctgcctacgagaccaaatcatgttttgccttcgggtaagagcaggtggcacaccatggtcttctaatatttagtgactgttgagggacttagaactcttagagctccaagagtcatgtggcttttgtacagacagcaggtttaggattccagctcctcctgcttgaaaagaaggtttacttttcccagggaaatgtggggccaggttcaggtgagaagtatgggggaaggttgaggcggacgcagagagctgctgctcaagcggagaatggagagtgatagagaaacgtctgacatcagcccctgggaagagggtgccggtgcctcacctgggcggcttgtttaggggtccggggggttgaagatacacccaattttctgaaatgcaaagtgtgcacagttaatactgctcatgtcttaactttggcaaaaaaacaacctgtgtacttaaactccttgtcttttgaacatcataaaatgccatgcagttggcaaattgtggatgcaaccggtggcatatttgtttagccagtaagacagtatcagaattaatcagcttcttgtttggaaacagcttttagggggttctctctgcttactagttctgaaatcacagacaagttacataacctcttgtgtctcatttttctcatctaaaattgagagggaagaagagactactattgccttgtagggttatcgtgagaaataggtgaattgataaagttcttagaactgtgccagtcatgttttaagcatttggtaagcattagctattgttgtttgttattaccttatttttttttaatttttttttttttttttttttgagatggagtctcactctgtcgcccaggcttgggtgcagtggcgcgatctcggctcactgcaaccactgcttcctgggttcaagcaattctcctgcctcagcctccccagtagctgggattacaggcacccaccatcacacttggctaatttttgtatttttagtagagatggggcttcaccatgttggccaggctggtctcgaactcctgacctcaggtgatctgcctgccccggcctcccgaagtgctggaaatacaggcatgagccaccacgccgggactgttctaacatttttgattctagtgaacacatatgtaaagtgctcagcacaacacagtgatgtagtggtcattacataaataatcttttttctctcttttatttgtttcattttaaagatgaggaatttgtgctccagaacaatccagtgatttttctcaggatctcatgggatgacagggcaggtctcacctgctaggaactgtgcgttctttgctttgcttttgtgtcttattttattctagataggaaggaattttccattcaggtttatattatttttattatggttggaattgctgtcataaaggacattccatccaggtgtcaataataattttccagtttgcaaagaagaagctcaagatttagaatctggaaaccttgattgtactctgttctgattctgctggcccgtggaatcttagaatacctttacttctctggcccactgttttcttatctgtaaattgaggagcttaagttgtttgatttctagagttcctttggctccaacattctataaccatgatttctaaaactgcataagttttgtgttacacaaataaaatagtttatgctagaaaaattagtcaatacaaacaagctaaaaagaaaaaagaagagacagaggaggaaggtagttagaaataaaacaaaatggactctggtccttgaaggttttattaaccctaaaaaaattttcaggcacttcccttttaatgggagtttcaaagcaccttagtacttttatggtacaagtctgcctgtcagagttctccagagaaacagaatccataggcaatatatatatggagatttattatggaaattggcccaggtgattatggaggctaagaagtcacatgatgtgctgtctgcaagctggagaacctggacagttggtaatgtaatttagtgcaaggccaaaggctggagagtcataggaggggtgcgtgtcagtgatgcaagtcccagaatctgaaggcccaggaaccaggaactctgatgtctgagggcaggagaagatggatcttcatgaattctcccttcctctgccttcttattctattgaggcgctcaatgaattggttattgctcacctgcattggcaagggtaggtcttctttactcagtcccctgattcaaatgctaatctcttctggaaacaccctcacagaccctggaaaagaacattttaccagctatctgggtatctcgtagcccagtcaagttgacaaataacattcaccatcactttctgtattgtatcctagtgttttatttcatctccttattgcagaggaagctcattgagggcagcagctgcatctcactcatattctatccctgtcccaccaaagaagtacagtggcttgcagagtagctgtagctcaccaagttttgttaataccatccagtgactgcatatcttaggtggcttactatatttttctctttaattctctcaggcatcttcagaaatagtttttctgtgtattttttcctggagcaaaaactgtgtgtttggacaagaatgatgtgggctccataatttaaataccagtgtcttgggtctgtctgtcttctttctccttaatgtcctgatggactcatagactccaattagtgaccagctcatggggggttctcaagataggtgaatttgctgctattatgtgtagaaacaggggccatctttttttttcagttgtcatttatgttcaattgttttgtcattgattgagagaggacttaattgtgattgatagaccctttatctataaatagtagaattcagtcaagtattcaaaatttcaagtgttttgaaaacttactactgaagagtttcagtaaccctgcacactaattagttgtgaaataaggaaaagctttcatcccaccgtgatattttaaaagttttaccttatgaacaaaattcagaagaaagctttttatgattctggtgtgttggtgaatatgatatttttattatttattgatatcaaatattttattgtctgtcttcattttaatacattgtcagaacctgcatacgtaagtagatcagaatctgtgtcctactaccaagggtgaaataacttcagccatgcgacatgggcaggcgttttaagcagcatcacggagatgcagagctcaagttggtcagcattgctgcccggtgctgacatctggccagcttccacattcctgtggagcctctgatgagggttatttaaagctgtggctgtttctagtccaccagggaaccaaaatggaaaagccatttacaccgtgctgtatgttaagatccagttaattctttgtggtctagaactctgggatgatttgcattaacgtggctgtctctgtgcacaactgccgagggttctgtctacagtgcaacttgtagaatcttgcagaattggaatagtgcagcctgcagtgctaaaacaaggcagactcctttgaatattctagaaggtatggtggttcttccagcatgttacatttgaaaccacaagaggtgtgaaaaagccctggccgggcgcagtggctcatacctgtaatcccagcgctttgggaggctgaggcgggtggatcacgaggtcgggagttcgagaccagcttggccgacgtaatgaaaccccgtctctattaaaaatacaaaaattagccagttgtggtggtgcgtgcctgtagtctcagctactcgggaggccgaggcaggagaatcatttgaactcgggaggtggaggttgtagtgagccgagactgtgccactgcactccagcctgcgacagtgagactctgtttcaaaacaaacaaaaaagtgatgaatcctttgcagatagcaaaggcctttttagtggctttcattcggaatgcacagtctgtgagctgaactggtgattgcagtctagtttttatgaccaacgttacagaacctttcatttagagtccaagatggccaatgctcacccatgagaagatcttagaaacttccaagttccatatcattttgtgtgttttcaggcctcatttcccgtgtctcatcctggctttgttcgccctcatctgtctggatgtaagtgccattctgtgacactagaactttttcccatctctgaagtgctactaaaggaatcatttgcttcctaatttgccagattgaaaactatggagacaagttccagagttccacatctttgtgataagttgggccaccttgggaacgagtctgtaatgtcatcttacagggctgtggattttatcctgcttattttgccttccttatattgtctactttatcctgaagaagaggaaaaagcgggacctatttcaaatactgatacctgcttccatgagttatctagacataatgattctttctctaggagttttagtttttcgatttttcttttttttttttttttgtttttttgagacggagtctcgctctgtcgcccaggctggagtgcagtggtgtgatgtcggtcactgcaacctccgcctcctggtttcaagcaattcttctgcctcagcctcccaagtagctgggactacaggtatgcaccaccatgcccgactaattttttgtacttcggtagagatgggatttcactatgtcctgaaatcctgaactcctgagctcaggcagtctgcccacctcggcctccgaaagtgctgggattacaggcatgagccaccacacctgcccagtttttttattttttatttttattttttttgacaggtggctcacgcctgtaatcacagcactttgggaggccaagtcaggtgaatcacctgaggtcaggagttcgagaccagcctggccaacatggtgaaaccctgtctctactaaacatagaaaaattagctgggtatggtggtgcatgcttgtaaccccagctactcaggaggctgtggcacgagaattgcttgaaactgggaggtggaggttacagtgagccaagatcatgccactgcactccagctagttctttgatttttctgaatttactccattaaaatactgaccactccttccatgttatatcctgtattagtatgttctcacactgctataaagaactacttgaggctgggtagtttctgaagaaaagaggtttaattggctcacagttccacaggctgtacctggaagcatggctgggaggcttcagaaaacttataatcatggtggaaggcgaaggggaagaaatcacgtcttcgtgatgggagcaggagaaagagagaacaaatagggaggtgctaacacactttcaaacaaccagatctggtgagaactcactcaccatcatgagaaaagcaagggggaatccacccccatgatccagtcacttcccaccaggtccctccctcaacacaaacgattacaattcaacatgaaatttaggaggggacacagagccagaccctatcatatgccttccctgtttttcatctctgtgctcagataagcctgggattgactccatcacccgtgagttgtgtaggtcccctgggtgcatggtgtactctctaccctaaagcatttctcagtttgtcatcctacgataagtaacatctctttctgaactgccattgtctttctaaatccacctctcagtgtccatgattcttatacctagcgtgttaggtggttggtccatattctctgttccgtaagttgtgtggtcgtgtagcttatcctccaaaccaggacattttttagagggacagctggtataatccaagaccattccaggctaatcaggatgtgtggtcgatgctgcctctaagagaatctccaaggtagagacggccggcgctctgagtgtgatcagtaaatatccagtcaataagtgcctgcgtgagtccttgattgtctttcttttgaaattattgaaccaactagttccttttgagcattttcctgctgattcccttcctggctcaagaataaaaaaatcataaatcacagggacagtgccagcaacctcaccctgcccccacaccccacaaatgcttccctcccattgattttgcttccctctgttcattttggccagatccaacgttcacctaaataacattcctaaagaggctagagtagaatgataaccaaggcactgtagtatttaactgtgcacgtcaacacgttttcttagttactgagttgaattttgaaatgtattctactctgaaaatgcccgggcaaagcatagttgaatattgctttaggaattttaataacagtttgttctcactgctttgggggagctcattctgaatggtgtctggttagcaggagcattagaagatgttatcaacacagcagaaaatctaccaggtgtgattacggtcagcaaggcaccagtagcgggtcagtggtacagcctgctcccattttcccgacacgttcaacgggggcagcttttgtacttttaaataacccattctatttcggtagaccttttctcccttcttttctaacagctcagtttccatacaagactcacagtgaactcaccattcccgagtggaaaggagtgactggttgtataaatatgtctgtctccacttggtctttgcctgaccgggctttgtgggggtctgttgattctttcagcttcactgccttccctgcagacccgacctggagtcctttgttgccctaaatatttttctcaaagatcttttattaactttttcttttctgctcttgtttttcttcctcttacctactttaccatgtggtcctgtggcaagagtgagaaagaaaaatacattctagtggtgtgatcggctgaagcaacgactgaatttctcttctccattaaagaaaaagaaaagaaaacacaacttttaaacttttttagtttctctcctgctaagtgtttgttgaaaggacacaatgaaatgactgaaaagaaccagttttccctcattaaatctgtcctcgtgaacctgagcttgtgaactttgcacttttttgagaagagcaacatttttttttccttgctaattagttgcttgtgctattttcggagaaattaagggaagatgggagtaccttcagttttcttttgacttcagtgactctcagatggatggtctgcaggtgtgagacactgctaattgtctgccagttgcagctcacccatctttcttggtaataaaacccctaatttttagctggcacgtggtcacccagaagccagccttgtagctaggcatcactgtgttactgaattttgattaattgcttgtaagtggaaataccttgtacaacttcttggaagtgtcctgaaggaggaagccttctttatcctttcctttttcctgagaggaatgtagatgtgatggctgagctcaggctgtcgtcttggatcttgaggtgtgttttagtcagctctggccgttataacaaaaatactatagactgggttacttaaacaacagaagttttttattcgtggttttgaagcctggaaaatgcaagatcaaggtactgacggatgcattgtgtccggtgagggctgtcttactgatttgtggaaggccaccttcttgtatcctcacccagtggagaaagagatcgtgtctcacatgtctcctcttatgaaggcacttaacctcattcatgagggctccaccctcatgacctaatcacctcccaaaggccccgcctcccaataccatacactggggattcgggcttccgtatatgaattttttggggaaaacgttcaaatgtgtagtccctagcaaggtgggagccatgcataggggatggcttggtaacgggaaaccaggggcctctggactgcctatgagagaaactcctgttttgtgtaactcctgttgagtgtggtttgctcttacatgaagctgagcatagtcttaactgatacatctatgaatctatttaataatcttgtttgttatcagggatttctggggagatttttttcatgtcagactatacatctcagggatagagcaatgctttgtctggtggacagaaaaatctgaactcaaagaaataaaaatgtgtgagatttctgcagcgtataaaatcttaaccatgatgtgggaaaccactatcaggattctgtttaaaagccacaaaaatgcttttcttcttccccttagcctctttctgtgccattctgtaacaattcagtcctaaagccattaactgggtgtattagtttgttttcacactgctaataaagacataccaagactgtgtaatttataaagagagaggtttaatggactcacatttccacatggctggagaggcctcacagtgatggcaggagatgaaggaagagcaaagggacatcttacatgggggcaggtaagagagcgtgtgcaggggaactcccatttatataaccatcacatcctgtgagacttatttactgtcacacgaacagtatggggaaaccactccccatgattcagttatctccatctggccccgcccttgacatgtggggattattaaaattcaaggtgagatttgggcgaggacgcagcctaaccatatcagtgggacaggaaaacagaggcgttcaggggtggcctgcgggggagcattggcgccttggtgaagggagcagccgtgcgggttgggcaagtcggggcccaggcagagtgaggagggcgtcctggtggaggtggcctggcatggagtttagtatcagggcagagtgaggaggaaggggtgatggggagattggttgctctacatagtggaacacgtgttggataattgaaagggctcgcaagattccacagcacctgctcacgtgaagacttaataaaagcacaggaggtggttcagctgtaggaagaaagcacaagccagcatcagtgacccaagagactcactgttgtggctccaaagggcacattttgtctccagattatgaaccatcaacacgtgtccaaggaatcttggtgtcaggagagcctgggcagaaacatcaagcactgtcttctgtgcttggccagtcaccaagccaacccaggccctgtgtccaggtgtaaggcatcgatccgatccgcacctccctgaatgttcaagcaagctggctctggggaccaccaggggcgtttttaactttaagctggcccactcctccttatcttgattaagaatcagtaccaaacttccaggtgtccttgcagatgagcacagagctgtcccggtttcactgtaagataaccattttatgtagctctatataggggcatttattaaataagtaaacggtttaaaggccaacgaagcggagttctcgtcgttagaggagagaattacaaatacgggaagggagaaaactagaatgagccctgagatgtattggaattgggtagattggggtgaacgtagggtgtttaaaaatagaagtagacagtgaaatcagtacaggtgttaggagtgtgttattccctagctctgaccactgagaggggccgagggtacctgactcccccccaccccaaagtaatgagcacatctagtgcctgaattttggcttataaatattatttcccacaaaaaggaaccagagatcatgggataaatggctgattccaggactgtggcagaaaaaatacaagatgaacctgaatatcttgtgtcagaaggcaagaaagtgctgcaagaatgagggcgtgtgtcgaaaggactaataagccagcttggatggactcatactggccaaatcaggggcaatttaaccatcactgtaaataataatgatagattataacccgtcagctaaaatagcaagctgcaaagccatgcaagtataactaaataaaccatgatctcccagcaccaatgctcttgaccttttggagtggacgattctttgtcatgggttcggctgccttgcgtgatgtaggatgtgtgtcagcatccctggcttccacccactacaccagtgctttacactagtgccatccagcagacagagaatgccagtcaccaacgaaattttagattttctagtggccacagttgttacaatccaaaatgtctccagacattgtcagatatcccaattgtggggggtggggaagttgccttgatcggggaccaaaagacacaataagtttagagtttggtgaggaacaggatattgacattgtgtcaaagtacccgtcctccttttcccaaatttactaattacaagaggggaaaacaagacattgacaatggagaggccaggcagacttacgcgatcaaagtgaagatccttatcaatgggataaatggaagtcgtgtgtcctaggtagggtgccatgacaagagcacagtgtttctgcgatatccctgccaaagatgctgatatggtttggatccgtgtccccaccaaacgtcatgtggaattgtaatccccagtgttggaggtggggcctggtgggaggtgactggatcacgggggcaaagttctcataaatgggttagcaccatccctcctgtattagggttctctagagggaaagaactaatattatatatatatatatgtatatatgtgtatatatatatgtatatatgtatatatgtgtatatatatatgtatatatgtatatatgtgtatatatatatatgtatatatgtatatatatatagaaagatagagagagagtgaatgagtttattaagtagtattaactcacactaccacaaggtcctgcaataggccatctgcaagctgaggagcaatgaaagccagtccaagttccaaaggtgaagaacttggagtccaacattcgagggcagcgagcatccagcacaggagaaagatgtaggctgggagactaagccagtttagcctttttctacctgctttatatcctggccatgctggcagctgattagatggtgcccacccaaaattaagggtgggtctgcctttcccagcccactgactcaaatgttaatctcctttggcaacaccctcacaggaacacctaggatcaatacttagcatctttcaatccaatcaagttgacactcagtattaaccatcacaccacctttgtactgtatagtgatagagttctcatgagatctagttgtttaagagtgtgtggtacctcctcccaaagccccacttcctcctgccctggccatgtgatatggtttggctgtgtccccatccaaatctcatcttgaattatagctcccataattcctacatgtcgtgggacggacctggtaggtaactgtatcatgggggtggggctttcccatgctgttcttgttatagtgaataagtctcacgagatcgaatggttttatgaaggggagttcccctgcatacgctctcttacttgctgccatgtaagatgtgcctttgcttcctctttgccttctgccatgattgtgaggcttcccagccatatggaactgtgagtccattaaacctctttcctttataaattatgcagtctcagtttcgggtatgtctttactagcagcgtgagaacaggctaataccccatgtgaagatgcctgctccagctttgccttccaccataagttccctgaggtctccccagaatcagatgcttctgtgcttcctgtacagcctgcagaaccataagccatataaacttcttttcttataaattactcagtctcaggtgtttctttatagcaatgccagaatggactaataccgatgaatgaatcaagaatcaacaaatgacaaatctccagcctgggcaacagaatgagaacccatttctaaaaacaaaacaaaataaaacaaaaaaacatttaaatcaagcaagaatggtgctgtgagcctgtggtctcagttgcttgggagtctgaggtggggggattgcttgagcctgggatgctgaggctgcaatgagctgtaattgcactactgcaccccagcctgggcaacagagcaaggtcatgttaaaaaaaaaaaaaattgtacatagagggacataatacaaaacaattgcccctgcaatcttcacaattgccaaggtcacgaaagtcaaggaaagagaaattctcagcttagaggagacgacaaagacctgacagctacctgcagcgtgaattctcaaccagatcctatttcttccctaaaataaatgattgggacatttggagaaacttgaatgggggctaggattagatggtcctcatgtactgggttaactgttttaatggttgtattgtggttatgtccatttttgcttgtaggagatataccatagactttatggggcatcaggccagcagcttaatctcagtggttcaagctgggaaaacaggtttttgtattgcattttgaacttctctataagtttgcaatggtttgaaaaaacaaaaaacaaaacaaaaaaaaaaacatgcggccggactcggtggcccacgcctgtaatcctagcactttgggaggccaaggtgggaggatcatgaagtcaagagatggataccatcctggctaacatggtgaaaccccatctgtactaaaaatacacaaattagctgggcgtggtggcacgcacctgtagtcctagctactgtggaggctgaggcaggagaatcgcttgaacttgggaggcggaaattgcagtgagctgagattgcgtggctgtattccaaactggtgacagagtgagactcagtctcaaaaaaaaaagcaaaagttgtggtcagtagaagtgatgcatattttcttcaaagcgtgctgagccccaacatcgagacccttcctgagaaaaatttttatcttatccgtttaaggaaaaacctctactgcattaacagaatgttcttaaagaaataatattggaggctggacacagtggctgatgcctgtaatcccagcactttgggaggctaaggtgggagaattacttgagcccaggagtttgagaccaccctgggcaaaataacgagaaccacatctctacaaaaaatacaaaattagccgggcatggtggcatgcacctgtgatctcagctacacgggaggctgaggcaggagaatcatttgaacctgggaggcggaggttacagtgagctgacattgtgccactgtactccaacctgggcaacagattgagaccctgtctcaaaaaaaaaaaaaaataggaaaaatttacacatacacacacacacgtgtatatgcatatgtgtgtaaatgctgacacatacagtaaagttttagaccccagagtagaggggagatcatttctctcttttacttttgtggctctgtatatattttctttatttatagttagaaaaaccattctttaagcaaacctaatcttactgagcagattaaaccaccatgataatgtttgaagccagagagcaatctgcatttcaaatcagtgctttgaaatgtcaaccaaaatatgtttagaagaaattgtgaagggtttcaactctgatcatctgataccatggaggagaatttctggatgggcacggaacatagctgaagcaataacactggcggccttctgctagataaagtttctgtttggatgaagtggcttcaaaaataataataattaaaattttttagcacaaggtaaggcccctgtgcacctctgcccccttggctggtctttctgactggcacagataattgaaatggatcactaatggctgggcaagcaggtcggggcgccacgcagagctaactggccctcgtcatgttggattctgtgacattaatctgattagctctaacttgctgagctaattgcaccgttagttgcatgccttttcttcctttggtttaacattgaatagatcgtgttacatgaatcctagcttctattttggtgagcgatagtgcttcaacctgtgaaaataactttgccgtttgctttgtaggagtacaggtagaatccggatacagtgatacatttactgactgacctttttttttttcttttctttttagttaccttatcccatatcacacaactggtcctcagccataacaagctaacaagtaagtgatgtttctcatttgttacagtttctgacatttaggtaatcctatggcactgctgagtctgttactgtttccttgggagaaactaatgaagaatgattatttgcagaaaccttagtttactttggtgacactaagatgagaatattgtcatcctgtattttgtccttttgtagttagctctactttgaagattcttttcttttttttgagacaaggtcttgccgtgttacccaggttggtcttgaactcctgggctcaagcgatcgtcctgccttggcctcccaaagggctgggattacaggcatgaaccgtggcgcctggcctgaagattctttcttatcatgtttataaaccaaagagaaaaaaaatgacattgttgctctggaagtggttccattcagagatagtaaatgctatgctgacctgaattgccagaccattggtgagcatttcatgagcaaaacttacttgaaagcattgaaaacttgaaattgttagaacaagttctttgttttcatttatatttcctcctcgaaagggaaagttttaactgtttaatacactttctgtccctgcttgatggaggaaaagatgcaaaattgtatacatgatatacctttacatctgcatttttcaaatttttgagtctggcttccccaaaagaaaaattctgctgggtatccatagagccccacagtagacgtatctgcttagcatagatgaatgcctatttttatatgactatcttgtgtgcatgatgggccgttttcttcgtagagctgtggctttaaagattttaatgacagggacccacgctcctttcccattcctaatgactcagttctttttgcttgccatttttcttgcagacttgaatgattttctaatcatgtggcaagaatttgtgaaggagctttccgagtccagtgaaattgagcagaatgtcatgttgagggatttgtgtcatgaatttatgtgtgtatgtgcattatatacagcttgaagcgatgtcacagagctgttgattattgagaattaagagtggcagcagggtcccctcatgtgcaagaaacaagtggattagtcgttgttagccaaagcgtatatttgtaaggcaaaggcagagtgacggcacagttgtcacacttaagtagtggtggccacagaagccaaaagtgagacctacaagtcatgtgtggtcattgttgtaacaggtaatttattgccggttccattgtttttctgggaaatggtcccgtggtccacagagaccagattctcagttcagaagggattcatggtctgttttgaagcgtggaccacgtgattcctaaatcccccaagatttgtgagcagtaataactgacatgttctgttgtgtagtttagtaaagtatttcttaattgctaagcttaccattgttacaacaatgataccttgttttgcttatcttgtgcaaaccagtttacacaagaaagcaaaactggccaggatcagtgaccgatgcctgtaatcccagcacttaggaaggctgaggtaggaggattgcttgagcctaggagtttgagaccagccaaggcagcatactgaggcccccatctctaccaaaaatcaaaaaattaaccggacatagtgggtccagcacctgtggtcccagctactgaagaggctgagcccagtaggtcgaggttgcagtgagccatgatgacgaccctgctctgcagcctggacgacagaggtagaccctgtctccaacaggaagaaagcaaaacctttatttctattatatcattcattgatctcttctttaaaaacatctttcagatcactgtagtttatttctttttacatcttcacaaagatagaaatctcaggagtcaatggatcagtttcttcctccaggcattataatattaggttaatttagaggagcatatttatatgtggagttacattgtgttggccattcaggagactgactgtgaaagaatccaaactttatatttctgccttgccagtttttttttccttttcttcactccatttgagacactcttgacctaatccagtaaactctaattaatagtcttggtaaattctgtttcaagccatcctgagtagcgtcactgacacccgatctgtttcagtaaggtcaaattagcatcctttactatttttctggcatttaaatgaatgactttgctatggtttttcaagtgtttatagtaaatatgtccatttgatggaaatataaatatgcattaagtgtaagtggctaggcacaccctgctgtcactttttatggtaatcagtgtctttcactttctgttgtttttaatagggaccagctgacaacgccacattaaaaccacagggactcaaaagataactcccccaccccctcacccggcactgcttttatcttgcaaaagtattcatgtttttctcttagtatgccaattacaccgttctctgacatttccacttatgtactcatggaaggaatgaatggtttactcaaactgggacattgatttggggacactgttgactccactgacttaagatctacagggttattgaaacagtgtggcacgtggttgacttgccttttcttgccagtggttttggccttgacatgtctacccagggcagtaaaagtgaggcgacaaggaagctgaaagtgggatctgtgattctgaaattcctcaagaatctgggagcagaaattcctgaacttttaaatactgcagttcataaaaatattaatgtattgtcaagctaattgctgttaatgctccaagactattatggtgcccctatttgaatttaaacctgggagcttggggcagcgttgatgggtttttgaagtcagcgggggacttaatctgtctgtagcaactttcctagatatgtatatatgcatgatgtgtttaaggagacgggaagaatagttgcaagtgaatttttttcttctgcctttttgctatgaatgggcaggtactaactttgaatgcaacaaagtcattggcaaagtcagaatgcaaagccatcctggcccaatgggaagagtttcagattgaagatcctttcggaaataatgctttctttgagcacctgcctgtgatgcagtacgcacctggcagaaggctggcttactctcatgcactcactgcccctctctgcctttcagaaactgccctaatctgccccacatcccatgccagcctctcctctccatttgctgctctaggaagatggatcatcttctgtccccccgtagccctgcctctgggcccaggatctactcttgcctgcctctcctcctccctcctcctctctaccagcctctccccatcctcccctgggggccccctggctggtctggcccatctgaagcctttcctccccaaactctcttgcatgtagactctttaactctagcatggcattccctgtccttctcttcctttgtgttttttttctctctccaaatagatggtcagcttttgtggaagcatggatcatttcatattcttcctgaatgcctgtgactgggcccttagtggcttcgcagtaattacctgtataaaccgagtgttcattgctcccaggaggtatgtgaatgacagggaagggcagagaggaaactgctggctggagagaaagtggggaacattgggatcagatggtttctttgggattaactggtatagggacttgagtagatgtggctgccacagacttctgtttcttactcgttgtgtgctcatttcaaacatggtagagcgtgatgctctaaagatacatgaccttcagcctgggcaacatagcaagaccccatctcttaaaaaaaacatgagccaggcatctcagctactgtggaggctgtagtgtgaggatcacttcaacccaggagtttgaggctgcagtgagctgtgattgtactactgcactccagcctgggtgacagggcaagaccctatctcaaaaaaaaaaaaaaaaaaaaggtatatgaccttatgtccaataaatgatggccatctcatctttacaatcatagagccaaggaatgatgggctgtgatgtgttactcaggcacacaaaggactcgcagccagggaaactgttttcatgaccgctcagatgcgtgggaaggcagcaataatgccgaaggtcatcttcctgtgtttctttgcttttccttcctgcccctggcctctgtggttaccctccctttcaagccactgtcagctgagtcttttttagtctgctccttaatccaatccctaggttttatggtgttttggaagtgtgagctttgtaaatgctttcctacttgttttttgtttttaaaaaggagtttcttttggggacaaccattttaagacttgtccactagaggtcactgttgagacacatatgtctcctccaggttttgtacctaaagattagaaaccacctttgttgtgagaataaattttgtgcaggctctccggccctgcaccacagggcatgttgctattgctgcttacacagtgcagtttttaccacatttaaggtaaatccttatagaaggaggtatgctgtgttttttgttctcctaccatgaaaatattcagtttcacgtatcattttttagtgtttattatggctactttctcaaattagaaacatttctcttcctccaatatccttacgttgaaagaattatactgctttccatagtattttgtattgggcatatttgagtttttttttttaatctgtggaagaaagtttgaagtatttatgtaaccagattttaattcaaaaataactgtaaaaatcaggaaaatgtgtattttgtgcatatttatgctgattcgtatactgctcaattccattgtgttggggagaatatgaaatgaatgtacaacaggaaatgaattgcattctgtagcagtgataaaacaagctctgggcattacgtttttaagtgaagttttccttaagttttaaaaaaattttattccaacagcaaaacccacacgtaaacattgcaagctactactgcactccagcctgggtgacagggcaagaccctatctcaaaaaaaaaattaaaaaaaaataaaaatatgaccttatgtccagtaaatgatggccatctcatctttacaatcatagagccaaggaatgatgggcttaaatacggcagtagtttttttttttttttttaaattttgtgacccatgtgtgttgaggattagacattcgtcattttgtgcaagaaataaccaaggatatctttttgctctgtgcaaacattgaggagccgacatttatgtaaaacttttcaaaagtgtgggtctctgaatgtaattgtttagttttatacttttaactgccatgtaaaaccttttcctgaggtattggcagttttgcctacaatttcaggtcttcactgtgaccatatctcatcatttaatgcatcggaaatggccaggcaggtagtaaacctaagttttatggcaaaatgtgggttttttttttttaatatacactatttcctattagttacagcttatgtatgaatttagaattataacaaacaagaaatactaagataccttctttggtggtttcaataatttatttatcaaagataatattctaagtacatagaatttaatacttttaaattttatgcagatgtatacattgattatctaccataagtcatattataaacaaattaagcagcatatttcacatgaaaatactgcattcttaaaatttgtagatccaattataatgaagaaaatttagcagtttttaaaaagcataatacattgaaacctttttatgcagacataatagattgctgggatgattgagaagaattaactgtctgaattcctgaggacgaccttcaccactcttctcagaccttgctgttcttaagtctgtagttattccctccttcatagattatttgtcatgctttatgcaaaagttcttgtgcatggcttgtatgaaattaaaccatgaggggggaatatgtaaaataaatggtctctgtgtcatgaatttatcttgtgacaatatcaaaacaacttgctgttcgcattttaacagagtgtaaatgtgtttataatacagaggctttgatcaataacttatttttttaaattactgcacatttatcagtttgcttctctgccatcattaaaagatgagagttaaaaaaatatgcatagtatctttgagtctaacagctattaattaaacaatatctatctgatggtaccggtagtcaggttaccataaaaaagcactggcagttgggcatgtgttgcgattttttggctgtagtgagtgagcacctgagatcatgctatgggagggtctgttgacccaggaacccagaaccagtgcagccaaggccagcgaatgaagtcgaagacgtgtcctgccggtggcatctaatctgtcctcagcttgtagactgtggccaccccccacccccattccttttgttgtcagccccaccaaccaaaatgtacctgttctagaatcctttttctagaggtcctgttttgtgctaagcggaagccagctaacgtgctaattcctccacaatatatttttaaatggaaccaccccaatcgtgagaacttcagaacggtggcaggctgtggagaaaataagacgggggagtgtaagcctgtcactttccaactcataattagcccatgtgcggggctgatcctgaaaaaggtttctattgctattgatgatagaatgtctatcaaacagaattgatttaatagcaaaatattatacgtacattttcagttgatgccctctctcctatatcacttgatgtgtgtgtacatgtgagtatgtgtgcagaatgatagaggagatacactaagaggtgcaatacttaggtacatacattcttgtagagcatctcttctctttttttatgtttttattttttagagatagtgtttttatcacccaggttggagtacagtggcacaatcctagctcactgtaacctgaaactcctgggctcaagcaagcctcctagatagatgtgcaccaccacgcctggctaatttgcccaggctggactcaaactcctgggctcaagtggtcctcctgccttggcctccaaaagtaccagaaatacaggccactgtgagcccctgtgcccagccttcttaacttttcttaagtcactgatctttttaaataatagagtgaaaactacaaccctgatctgtagagaagtgcacgtgatggttgtaattccagcagaggcttgtggatcccattgtgttcatccatgaattctttagaggtccatgcagctcagatttagaaactccagaatcggatgaagataacactagtatgtttgcatgcagtgtggacatagggatgctatttttttgtttgtttgtttgagacaggatctcactctgtcacccaggttggaatgcggtggcgtgatttcggctcactgcaacctccatctcccgagttcaagcgattcttctgcctcagcctccctagtagctgggactacaggtgtgcactgccatgcccagctagtttttgtttttagtagagacgggtttcaccatgttggccaggctggtcttgaactcctggcctcaagcaatctgcttgcctcggcctagtgatgctatttcttaaaggagatgctccttggagatttgtataaaactttagatgatttttaatgcatcacagaactcattcttgatgactttttaaaaaatattgataagtgccatcttattaatctgcttaaatttacattttgttaaataagaatttgcaatcctgtagctcccagggttgaacagaacgtgtgtgggcatatgggcatatgcagttttttttttttttaacggaatacctttcccatttccatttttctttctgttcatcagtcagcctcatagaccaaaaccactcagatacaattgataaccagtaacaaactcattgaccttgcgttttgctgttttcagtctgaaccctcttttgtctaattttttgctggttctttagcttttttcccctgcctatctattctttgttctagtcacctgatttttttaaaaaaactgatgttcctacccctttctctgaatttggcttatccttcagaaagttgagatgaatgctcatctttctctgtgaagccctccttttcatccaactgaaccagcactgtgtggaaagaaatacaaggcaccccacagcctgtgggaccatcaagaacaacacctatataataacttcagcaggaagtgaaagagaaaagagtgaatttgttgaacccccactctgtattacgtggaggaggcaggtgtaaagtgattaagtgaccagaatgaggaggcgacagagctttctgtacagcttccaagtggctgctccgccgtgtcccctgctgcctctgcaagtgatctgtgtgtgcacttgacgtcccgttaggtcagtgtaggagctccatggacgaagcgttcctgtggctctggatccttactccttccagtcgaagaacgggagaattcctaaggttaaaagccatagttgggttatttcgaagggaatgatcaaagctcccatgtggatttggtggattttcctagccctgggcctcttccttttcctccccttcctgccctcctcatgcagtgaccctaaacataaggtctggtaggaagagaagcagtccacttgtggcctcttgatggatttgatggattaattccttttctttttttttttctttttttttgagacagggtctcaagttgttgcccaggttggagtgcagtgatgcaatctcagctcactgcagccttaacctccaggctcaagtgatcttcccacctcagcctccggagtagctaggactgcaggcatgcaccaccatgcaaagctaatttttttgtagaggtggggtttcgccctgttgcccaggctggtctgaaactcctgggctccagcaatccacccacctcggcctctcaaagtgctgggattacaggtgtgagccactgctcccagcctagattaattcttaattgtgaaagaagacagaaactaatgacaaaacgtgctttttctgtgtgcatgtaaaagagtgcaagatagaatgtgacttgctgactatctaccttgtaatgttaataatcgaggcttatgtgtagatatacatccatatatattatacatagtaaaggcatgtactcatataaaagagcctagatcagtccttttataacactgagactgcttttttccattgatggattgaagtttttttttcttgttttttttttttttttttttcatattctactcctctctctttccagtgttttggaattttctaggcatttttcctacccttccttttcttacccttcgctggatgtcacttcctccccaggccactgaatgccatttcctttcctctcagtgctgcctctccctcccagctccccaattaaagctctttattgatgtatggctttgctggaggggtcgcacatcagaattgtagtgcaatttagaagtggtgttcctgcaagatttcagagttcatacgtcctcctgaagatgctttgggagttaacacaagattcaggcattaactaatttttatatcctcagaggagaagaaatccatacttgtcagctttttaggaaatttgtttggttatgcatacatactttttatagctcaggaacatacatttttgcatgtttggctttatcctctaaaatcgaccttatcacttgcttatgccttttttcctctaattttcacgtaattgatttttcacattgctggtgaaagagtagggccattgttttgcggtgagttaagccaggggatatttttgtttactaaaatgacttaggctatagaatcctgaggcagctcatgatagcatagagtgagcgtgtgcttttggggcacaggtccccagtaatacttgttgtttattaaccaaaagtacattaccattgttatttataaagctaataattggaggatgttggcctttcttggcgtagatgcttagatactttgctattttatgtttaccttgaggaacatgtagaaccttttaaatgagaatttgctttactgtttcataaactttatgtttttaaataacctggaactaccgtaattcactgctttaatagctgctttggggtaaatcccataaaatctgtgaagacagttatcattagtatacttttgaacatcagagtcttgtggtaatatgtaattagttcattattgtccaccttgtgtttttggccagaaaacaaaggtaattaatcactataactacaaatgacctttttttttggcatataaagtgctgaagaatgtaattattcctacgcgagagtgagaagattcttctttatgtataatcattaaaatgacattgagaactatgatttgctgaaagaatcggcatgtatgtaattagtctagacaccacctctgtgctatgaatggactcatgttctccagttattacagctagagattaaaaaggctgtgcttttactttgaccatggatgccccatgtcatatttcatctagtttctgctaatttgattttttcctcccttacttcattcaggccaaagggggacacttgtttttcactatcatattcatcaaatgctggggcaaggaaatgtttgctttcaccattttctcataaatggtccatccctcccctcccgtatatataatgaagagcctcactcattttcacctattctcatgtttttagtaatttttctagtgacttggttgtagtaatgtaacatactaagttatctaaataacaagctaattttaatatcctctgccatcctctgtccttctatgctttataaaaaaagctgcagaaatatatgacattgtgaacatctgcccaggcattttcatttgttatgacaacagacaaaaacttcctttttttttttttttttttttttaaatagcaatatgtcaggtttttagaagcaatactactcagtttcattttgctgtgactcattctatgtagtttctttggggactctttggcccaaggattggtggcacttttgcttcctggaaatgggcacgagacagtagcgttgcctccattgcagcacaagggcggacatgccgcgatgccacctgctgtcctggccctggctgtgagcagttgcctcccacgaagtacctgccttaagtcctcctcttcatccccttgctgtaattcacaatccatcactggaggcagaggttgagctatcagttcacttgtttcaaagaggctgggtcccctggctttcatgccctgggccagccctagctcaggaatcaccagctctgaaaacatcctttggtgcttctgcaaaaacagttgggtgtagtgcagcccccaactccccagaagtttggtggagatggtgggtggaggtcacctccagatttcatgcctgtgctgcggagggaaagcgccatgtgtttggagcagcttctggcttcctggcagccgtgggtgtgtgttagcatggtgcagggtctagtgctgcccttctggagctgaagaggacctggctgtcggtggtaaccatatggctctaaagaccaaagtgtgaccccctgaccctcccgtgggctgcacccaggcagagctcctgtccttatgttttttgcgtggtgcctgctgctcccagagtctgtcgctccttacggctttgatttttttttgcctcaagggccccaagatgcttttgctcaaaaagcccccaaatcagctgcacccaagccgatctgtctgtaccgtcactaccacccagcatcctgccattagggttcagtgttttgaagccaagcagtagagcaggtgacatctctttgtatgactacccttggtcatgatgaatttgccactgagtgacttaattcagtgtgctagggaattcaaggcttttctcctctggaaagttgtccgtcttaagcaacagtgatcttaccataaaatgctgtatggggaagcagaagttgactagaaagggtttgattgtagcatccacgttgaacgtgttaagctacctagagtatcatttgtttcacgtgtcatcagttccccaggctcaagaggcatctttatttggatcagattgattattatactcatcgcattatcgcatggggtaagggacatatgtgttggattgataatcgtgatgctgccaatgaattaaaagttttctgagccaaaagagggttcccagaccagcaacatcggcatcccctgggaagttgttggaaattcagagtctcaggctttaccctaaacctgctaaatcagaaactccgggatacccctccatctgtgttttagcaagccatctggtgattctgacgtctctgtggtttgagacccactgccatcgggtagggctgtgtaataaaacattttgcggtgatggaaacggtcagtatccctgccatgcagtagtggagccactggtcaccacatgtggctgtcaagctcttgaaatggggctgctgtgaccaacaatagcattcatcattttatttaattttgattaatctagatttaaattcaaacagctgcatataactagtggctgtccaacagaaagcccagcccagaacataccctgctaattattattgtataaactcctaaaatgctttgagttgttggttgtggaattattaattttagatcatagaacagaatcttccttactctattcaacagaattgaaactgcgattgttacaacaggtgattttgattcttcctatggaggggagacagtttgtgggctgctgaccagttgggggaagcctattcttgagctgattgattgttgattttgtgaatgtgcatcagtggtgcagtaccggctggcacatgcctgttgcaggtattaccgatggccgtagatacatgtccttttaggagtaaagctgttgctcaggaaggggctgtgtcagtatttcacgcagatggactttggtttctccagcctgtccagcaaagtggaggtgcttctggccaaagagaagttaatgaacccttcaggcactttgggctgcttgtggaaccttccagaaactgctgggggagatgggagtgctgaattgccaagtctgggctggcacgtcagatggacaaaactcttgaatcacattcagttcttcagtttaggaggacctgaaggaaagaaggtcatgccgggtgtgttaggcggaactgctgctgcaaagtccagaagaaactttgagatttgtctctggggtgatgtgaccacatccttgtcacctttccaaaacagcagaggctctgggatgagagcgtccccagcagtcctgtgatcctgtggctagagcgaaatgggacattgaggagccaggggatatctgagtcctctgggactgttcccgcaaacctagcaactgaagtctcaaaattaaagcagccatctttggctaggcagaaaatgatactcaattctctgtcagaagcgaagttctacatgactaagcttcctaattgagagccccatttgttgaattatttaaagccatatcattgattttcataatccatctccttttagaatcctagaatgttaaaatgaggtggaagagaccttggaaatggtcataatccagccttcttattttacagaggcccagagaggttatgagttgagtgagggcacacacagcactgtagggtcagggaccacgttgctctttagttcctttggtgtcataggtcagctggggtcatagatcagaagctggacagattgatgaaaaaggatcgtttcaaagatgtaagaaatatactgatgtgcactgttagcttttaaaatgcttcttgctcatgcatcctgtagatatctagaaaattccagtagaatattttgactggtaaaatattgcagtggcctttttggaatacctaaaattgttcccgccacgtatgtataggatttagtcatagcacaattcatattgctaactggttatttttttcagagagtttggttgggagtagtttattttccaagcactaggcctgtttcagttgattgactttgataccctgtcttttgtaacttactttctttaaataacatgcctctcctattttatctcccaggtattgagatgctgtgtgtgcaaagtatggcactgtgcacctaatcagcattctctaaatattggttcaaagagtgaataccatcccatccagaagggtctgcatgttaatttctttagattttcactatggctgggggttaaaaaaaaattccgtatattgagggagactattagctgtgtattatttttttttcctcgtctagcttgaatggagtcttaaacgaaaaattcacatgctcaccaaaaggctgggagaggttttgtaaattgaatatggggttattgtttgcgttcacaaaacaaagccctaaatcacatttagcataatttgtggttttaaattggactgatttagcaaggagagtgaaataatctctcatcctgtcaaaaaggcgatacctttagaccagcatttaattgcactggcagagtaacttcgggaagacggcagtaattctggctgcattattcttggtttgtggctaaattgagatcatcattttctcctggtttcactaactttccttattgctcttcaaactaatcagatgaatgtgctcttcaaactaatcagatgaaggcttagtggtagctggagggtggacaggggagggatgaggtctgtgggcagctgtaatgtatatactttatgatctggggggagaagatgacatccagtgacccagaaggcacagcctggtgattttcttttctttttttttttttttggacatagagtttcactcttgtcacccgggctggagtgtaatggcttgatctcggctcactgcaacctctgcttcccagaagcgattctcctgcctcagcttcccgagtagctggaactacaggcatgcgccaccatgcccagctaattatttatttatttatttattttttgtagagatggggtttcaccacgtcggccaggctggtctcaaactcctgacctcaggtgattcacctgcctcagcctcccaaagtgctgggatcacaggagtgagctaccacaccaggccaatcttttctcttctcgagatagagttgtactcttgtcacctaggctggagtgtaatggcatgatcttggcttactgcaacctctgcctcccaggttcaagcgattctcctgcctcagcttcccgagtagctgggattacaggcgtctgccaccatgcccagctaatttttgtatttttagtagagtcagagttgcaccgtgttggtcaggctagtcttgaactcctgacctcagatagtccacccacctcggcctcctaaagtgctgggttacaggtgtgagccaccgctcccggccctggtgattttcttggtaatcccttacacacagtgaataccattcatttacacagaagtgttccatggactgtgcacctaagaaagaatgtacatttgcagccacactgtacaggtagggttcatttgcattcctgcaggtatcccagagggagggttctggaggaactttgagctgtctagattacccgatgaaaacttgttcttttatcaacggccacttccggagctcgcgcaggggccgctcactagaccactgctccctgcccgtgtgccccagttcagagtaatctgtattcttcacagtcccttcttccagtgaaagcatctcttttacctttcaccaagccttacctctaaaaggccagtgataccttagacatttcagaaagctcaaaatgatgactcaaaactataataagcaacgtgcctgtccctttacttttgttcccctgggagttatcaattggtcgtcttgaaatggctagctgcttaaatattttagatgtatgtttggcattttacacacacctttgtggtggttctaatcacaggtgctcccgggtctgagtttaggtctgactgcaggaagcaggttggtctcccagcctcctggggcacccctggaggaagcagatgggatgggaagtaaacctgactgataagagacatcacactttctcaggctgagttccacgcccctgttcatgttcttagttatctggatagtcttggtatcagagtttacgtgaaccatggccaagcttatcacccacagaaatgtttgtagaaagactgaatagcaagtgggatagatgaattacagtctatggaaactcctgctgctgccaatttacagtttgtgcttttaagataaagatgcctttggcttttacatttgtattttcaaatgtatatattctagggaaggaggaacctttcaggtccccagtggctgattttcacctttgatctgaatactagtattcatagcatgctactgagttgactttttgtatttctatataataacagtgtatcgatctcttgctaatctgatgtaacctttgtgtgtgtatatgtatgtatgtgtgtgtgtgttactgatcaagttaaattactccagaggccaaaatcagaaactagggagggtgaatatttcatcatttaaaattgagcttatattgttattaatgcaatgttaagaggacagcttttcagatactgggttatttaagcagcttcaatgtacatcatcccggaagggatttggagatctccatctttcttctggtggcaatgcaagaaaaccaaaagaaaaaaaaaattgcacctataagatcatatatgacaaccataagtatatatgcttcataatactcatttttatagactgtttgtggtacagaaattctcttttgtgcatttttgctctgtttctccccccccattagccatctgaaacaaactgtgccaagcacttagctaatcatatacgaagaagcatttcttcttctgacggcaatgcaagaaaaccaaaaggaaaaaaaaagttgcacttagaagatcgtatatgacaaccataagtatatatgcttcttaatattcatttttataggctgtttatggtacagaaattctctgttgtgcatttttgctctgtttcccccctcattgtccatctgaaacaaactatgccaagcacttagctaaccatatatgaagaagcatttaagcagccactcagaagtgagtgactgcttatgaaaaacctgtaaaaaataaataagaccggtaggtgaattcgatggcccttttgaagttatgtctttctttgctttgaaagaaaaacaaaatgtgccgctgccatcccttgctaggagttccattcccagattcacactcagcatttttgtttccatagtggtgccaccgaacatcgcagaactgaagaatttggaggtgctcaacttttttaataaccaaatcgaggagctgcccacacagatcagtagccttcagaaactcaaacacctgaaccttgggtgagtatcagtggagcggaaaggatggagaggaagagagtggaaggggcatgccgggtaaggccaggggagggattccttttatattattgcacagaaatggatttctaatttctttttatgttttgggtcttaaaaaaattttattgttttaatatattctttcagtggcctacattagtgcatatttgagagctaattgagaggctaattgttggcgcaataaggaagttaaatttttattgtattttctgtccagtaaaattttatctcagttctgctgaccgagaagggacttatttgcatagcatgaactggcggacaagtggtaatatggctgatttctttttcctctctgtgttaaattggaatagtttacaaagcaccttcgtgccgtggagggaagaatattttccctaatgatgcttcattcatttatgcaattcttctctttagctgagaggtgacagtcctgtctttctttatgcaaaggtgaagagaggagttttgattcagctgaggttgcagaaccagggagcagtaaataataataatgataatctatttttgtgtattgctttgcagcacttgaccctctcaacatttgtgaggtacggagggcaggttttagtgctttcattgtatacagaggaagccaagccttttcaaaggggctaagggcctggctcctggtcacccctgaggttagcggccaagctgggaagatggttctgggtctgaaggctccttcagaccccattgttatggtctgggtctgtgtccccagcaaatctcatgtggaattgtaatccccagtgttggaggtggggcctggtgggaggtgattggatcctgggggcggagctctcctgaatggtttagcactatcccctcttggtactgtccttgtgatagcgagtgagttactgtgagacctggttgtttaaaagtgcgtagcacctccccccttgtgctgtcttgctcctgccatgtaataagcatactcctgcattgccttccaccatgagtaaaagctccctgagacttccccacaagcagctgctgccacgcttcctatacagccggtagaaccacgagtcggttaaacctcttttcttgtaagttacccagcctcaggcattcctttatagcaatgggagaacagacaaatagatccatagaccccaaccggaactgcggcatcagaatttcatcttcattggcgcagctatcagatgaaactgcccactcatgctgcagtctctgtgcaaagtcatatgttcattaaatttgtagccactaaatgctctagttaagttagtgattgacgtggagtggcaatagatgctggccaggtatttcccaggtttttttgtttttgttttttttttttgagacagagtcttgctttgtcaccaggcgatctgggctagctgcagcctccgcctcctgggttcaagcgattctcctccctcagcgtcccgagtagctgggactacaggcgtgcgccaccatgcccagctaatatttgtatttttagtagagatggggtttcaccatgttggccaggatggtctcaatctcttgacctcatgtccgtctgcctccgcctcccaaagtgctgggattactgcgtctggccgtatttgccaatataatagggagcagtcatgaaaaaaaatctcattcatggagtgatttttagtttattgctcccacaaggaatttggtcagacacattattttgaagttcacttgggcttagggaccaactttatgagatccatgggcagcctttattcttatgtctgagggaaagtgaagttaaaaggagggaggaacatcgcttgagatgagatggtttttttttttttctccctacaaatttggagcctgtatacccatctggcaaagcagaaatgaaaagatgctccatttatatcttggttttacaggctattctatcctgatctttaatttgtatgtgagaaagaagctaaaactacatatagatgtatattcttactgttaatttgttcatttattaaatgaaatatatgtacacattatatctattttatatatatatatataaaatctcaatcactaggaacagtgcttggcacatactgagcagtacctagtattagttagctattgttatcatcataattgtcttatttacgttttcattgattccatgactatgtaagtgactattctatgtcaggaatcttcctagtaccggggagccaaggtgaaggttatggtccctgaccttacctattggggcaaggctggttataaacaggaacagaccaatgaggtcacagatatgctggcggttgtggaccaacagggggaacagcaagaccggggagcactttagtccacagatgagatcttcaggagcacaaacacagcagggagcacaggagccgagacttgatgcgtgagaatttctcagacttacaagttgaaggaaggcatctcagatggagtgaatggcactcttttgttttgttttgtttttgagacagagtctcactctgtcgtcgaggctggagtatggtggcacaatcttggctcactgcaagctccacctcctgagttcaggagattctcctgcctcagcctcccaagtagctgggactacaggcgcctgccaccacgcccagctaattttttacatttttagtagagatgggattttgcggtgttagccaggatggtctttatctcctgacctcatgatccacccgcctcggcctcccaaagtgctggcattacaggtgtgagccaccgtgcccggctgagaatggcatatttaaacgctcacagcactgcctgcctggggcctgggaattgtcagttttttggcactgttgagtataaagtgtgaggcgggcggctgtcaggtcagaggtcaggctagacagggaatcctggatgtctgttgttcagtgaatgaggatttaccaagttccttaccatgtaccaggcattgttctagctgctggccatccagccctgatggagcttccattacagttggagaaaccaactataaacaaataaatgtttataataatgacaggaagtaaaaagtgctaagaaaagcactctgtgctaaataaagcagctcctctcgggcgtggtggctcatagctatagttccagaagtttgagaggctgaggctggcaggtcatctgaggccaggagttcgagaacagcctggtcaacgtggcgaaaccttgtctctactaaatatacaaaaattaagtgtggtggcacgtgcctgtgatcgcagctactctacctgggaggctgaggcaggagaatcgtttgaacccaggaggcagaggtttcagtgaactgagatcgcaccactgcactccagcctaggtgacagagtgagactccatctcaaaaatacatacaaaaataaataaacgagctccaattttatactgacccttgagaaatttgcatagcagagtagcagataggagatatggtcatatttccgtatgaaagagtatggagaagagggtggagggaggtaaactagaggttaggagaccaataagaagacgagcttcatgtcccaggtgaactaggacagtgacagtggaggtgggggggattttatatgaaaaatatacaggcggtaacgttgacagacagtaactgatgggatggaatgataccttcatttctgtgttgggcagctgaaaaatacaacagatggagacaggtttgggaagaagataataagctcaaattttgttcttttttgactttcctaataacattttggtttgaggcagcagaggacagagtcgtacacttttctttttttttttttttctttttttgagatggagtttctttcttgttgcccaggctccagtgcaatggcatgatctcggctcactgcaacctccacctcctgggttcaaacgattctcctgcctcagcctcccgagtagttgggattacaagtgcacacacccacacccagctacttttgtatttttagtagagatggcgtttcaccatgttggtcaggctggtctggaactcctgacctcaggtgatccacctgcctcggcctcccaaaatgctgggattacaggcatgagccactgcgcccggccctaaacttttccttttcaatgaatgcatgttagttgccttcttgttctctttggagttgtttgcatttttggctgtcggtgctgtactgattgtgtaaagctttttgtatttaattacatagctacatagacggagttgtcaaagtttgaacaaaactcccagttctttgagaaaggagctaagatgggtttcactaaaggatactctgtcctcaaatggcataaagaattgtactcacacagtgaggcaagttatagggaggactccttattctaaggagccagggtgaaaagcatacacacaggagatcacaaagtggagatgggaagccacttgtatgtgtgatccatcagaatttgctttcaaagtttttatagtatttacagtttattctgatgattgtaagacatgagagaattttaggccacctgaataagtaaaagaaagtttagttctgttctcaattccttaaatgcggtttatttcatagagttattttccaaaaagtgtgaagccacataggttgatgtggcttcaacaattatccatgttgatgattatttctagggtaacttcactgcaggaccaccgtgcccaactgttcgggaataacgtttgacctcgtttgttgctagagcttgtctcataaacacatagaagtttttattaagtcccttgttggatatttgtggatttggattatttatttatatattttttgagacaagatctcactctgtcacccaggctggagtgcagtggcatgctctccgctcactgcaacctatgcctcctgggctcaaatgatcctcccacatcagcctcctgagtagctgggaccacaggtacgcaccaccacgccatgctgatttttgtaggttttttttttggtatagacgggtttttgccatgttgctcaggctggtctcgagctcctgagcttaagcaatctgcctgtgctggccttccaaagtgctgggattacagacgtgagctactgggctcggcctggatttttttaaatttttatttttgataagtgtgagtaggtcactgtggaggtgagaaaaattagtgcctttagacaagaaggtttctttgaagctggaggtgctcaggacaacctgcggagaagaaactgctctgaaaaggaggcattagtacagacctttctggggctttagaagacaaggaaaaaagatgctgaaatagcctgaaaccccctggttttatcaacttctccatcatatgcaggcatttgcccacttccaacacgcatttgaaaaatcttcccatgcaaacaaaagaattgataccacttggcatagctgagccctgcgaagctttatgtttcaacacctgaggtcacctgagattaaccaagtgtggcacaaatagaaaaccacacttgatagttgagactatccagagtggcttgtcatgaggtgagcttgctcgcttagggctaaatcaaaattttctctcaaatcttttgaaaaataattctagcaacagctctcattccctgagaagccacgtgtgagccatggattgggtgttgggtgcttcggatattttctctcttatcctctcagtgatcctgccctgaaggtgttgtcagcctcattttatagttgaggaaactgggtctcagagaagctgagtaacttggtgaaggtcacgcagctagcaagtgctggagccggtctcctcacctagctgtctcctaccttaaagctccatacttttcctaccgccactgtagcctctcatggaaaccttgattgctagcagtgtcagagcggggccctgagcatggaattcctatgtgtcaaaatgtggatggatggagatggatgttagcacctgctggagggaggggggacagccagcatgttccatccttcattctgcagagagagaacccaccatgtcaccatccacctggactggtgtccggagaggtggccagaagtctctgcagttccttggccgctttgtagctggggctgttgctagcaattcttctgaagttttagcatttgtttaaggacttctttctgcccgccagggtggtgtgcctaccactgttacttactgctgtcagcggcacatgggactctgctgtgttccttaaatgttgtgggtattggtttgtcactcaaaggaaaaaggaatctgcaattaagtagattcttgccaccaggaggtggaggggctccaggcttgctctgggctgaagattgagtgggagctctctctcaggtgagatgcctcttccctctaagcctgtctaaccgtggatttcctctacctaatattgcaaaagtgtatttatttgcagagaaaaatgttaaggaatcagcagttttcaaaaagagataaccgaaagcagcgtttaaagacagaagcacctagtgtggtcttctctgctgtccttcctttgacttgcaattcttctcagaatccttgtatcagagcccaagggtccggagcagctttggcctccgtgcggtatggggtgtttccagacacatgtcgccttcatcagtcacttctgaagtcttggctcctcaccctctcttaggctgttttttcatctcaacatagcattaatgacaagctccatcttacctgtattgcaaggtagttttagtgaacaagcgaagtccttgccataatgtgcttcacaaattgtgacttcatggagaatgtttgttcttgctgtcgtggcagtagatagtcgtggaggtagttttgctgggtgtagtctgtctgggaagttttctgcctgacagggggaacccgcgtttcccttttggttgccccctctgctgtcagctgtttctggtgaggccctcttggtagggctggatggagctgaatgtgttaggagaaggatcgatggctagaatgatttttattgtcacagtcccttccacctttcagtatctgtcaacttttattaaattttttttttaaaaattggcttttaagtatgctcaaagggaactgcgttaagaaaaataaggggcttgaagaaaggataaaagatagtgtagaaaaaaattcccttagacttcactggagacacgcccacacacacacacgcacacccacacatacccacacgcaccacacccacagcacacacacataccgtgtacaaacacacccacacacacaccacacacacactgcgtacacacacaccaccacacccccaaacacaccctatacacacaccacaccacactcatacctaccccacaccacacacatacccgcccccacacagccccccacgtccttcacacaccacaccccacccctcacacaccacacgaaacacccagatacacatacacataacatcacacacaataccacacacacacagcacacaccccacacacacactcacacacaattgacccttgagcaacacatgggttgcgggagcaacacaatgactcatgcagtcaaaaatccacacattacttttgactccgaaaaatcttaattcctaatagcctacagttggctggaagccttaccaaaactagaaatagttgatgaacacatattttgtatgttacatgtattctattctgcattcttacaataaagtaagctagagaaaagaaaatgttattaagaaagtcgtaaggaaaagaaagtgcatttactgtgctttaagtggaagtggatcatcttaaaggtcttcgtcctcttcatgttgagtgggctgaggaggaagcggagggttggttttgcggtctcaggggtggcagaggtagaagaaaaatatccatgtctcattggacccaggaagttcaaacccatgttgctcaagggtcaattgtatgatttaaaaattttttaggttgtgataaaatgcacacaaaatgtaccgtctttgtagtagacagttcagtggtgttaagcgtattcacattgttgttcagccaatccccagaattttctcatcttgcaaacctgaatcctacgcccattaaaccacacctctccattccccctccctccagcccctggccatcaccattctaattgaagataattttcagtgttagcagttgtagaacaaaaacatgattttccctccaaaaaaggaataaatggaatgaaatcaagcaaaagcctgaaaactacaaagcttcatgtgtatattttgagatattatcactacgttcatagggaagttgttctttacaaggaaagatattttgtaatggtttgagtttttgtgtaaagcagtgattaagtttcaccgttggaggaaaataacagctaagaaattttcaagtgtttcaagatcatgtaagctgtctgactgaaattattagcctaaataggacaacataccacaccttctcacttatatgtggaatgtaaaaaagtaaacctcatcgaaacagggaataaaatggttaccacaggctggagggagaggggaattgcagagatgttagccaaaggacatgaaattttagttaggagaaataagttcaagagatggattgtacatcatggtgactgcagttaataacaatatgtggtataattgaaaattgctaagagagtgaattttaagcagtctcaccacaaaagacaaaaaaaatgacaagcatatgaggcagcgcgtgtgttaaatagtatgatttaaaccattccatgatgtagtatacatacatcagaagtatcatgttgtacaccataagtatgtacaatctttgtcattgtaaatattaaataaatgctttttttaattaaaaaaaaaaaaggatgggcatgggggctcacgcctgtaatcccagcattctgggaggcctaggtgagaggattgcttgagcttaggagtttgagaccagcctgagcaacatggcaaaaccccatctctgcaaaaaatacaaacattagcagggcgtggtggcgtgcatctgtggtcccagttacttgggaggctgaagtggaaggatcgcttgagcctggggaggttgaggctgcagtgagctgagatcatgcctctgcactaaaacctaggcaacagagtaagaccctgtctcaaaaaaataaaaaataaaaataaagtataaagtgactctaggatcatggcactgtcttacactttcagcgtctgaaacagaggtgcccttgatagtctgtatgaatgtgtctttggtgtcatgacatagatttttgtccccctgcaacagcatgaacaggctgaacactttgccacgaggcttcggctccctgccagctcttgaggttctggacttgacgtacaacaacttgagcgaaaattctcttcctggaaacttcttctacctgagtaagaaactttcaattctataaatctcctcaaccttgtactttgcgttctgagagggaaatttatttgccaggacccaaactccaagagaaattattggacagagataattttttctttagagactccttttgaatattccttcgtagctcagcagtatgtgcatttgatagatcgttatgtgacaccattgggctgaagtggacttagtaatgtcatattaacattctgagagagattatatacctaaatgagatcaagcctcacatttagctaagagacttgactttctttttaaatagcatgccaaaaaaaaaaaaaaaagtatcttcctatgttgctattaattctttgtaggatatttgcccaggatattccaaccaattatttattaaaaatatttattaataaaccagtaacacaattttaaaattttccagccagtattcctattttgagccttttaaaaagtactcttattgacctatttatccagtacacaggcattaagaaattattggccacaggtgaacacactttattctttcatatgcaaacaaatttcttgctggagatgcttttgaaaattaaaaaatgatttcttctgggaactcatgcactattttggacaaggtttgcttcccttaaatcagtgttctatttcttcaaatagtaacttgtgtggcattcagaaaatctgaattttcagagctgatctctaaaattttattttttaccttacgtacattacctttctatgactttctcaagcacatgaaaccaactataaaatattttcttgggcagtggagcaactatttttattatgttatattaacatgcagttctcgggagtatgagctacaaagatcacttgaggctaggagttcaagaccagcctgggcaacatagagagaccctgtctctagaaataaaaatttaaaaagtagccaggcatagtagcatgagcctgtgatcttagctacttgggaggctgaggtagaaagagtgcttgaggccaggagtttgaggctgcagtgacccactgcactccagcctaggtgacagagcgagactctgtctctaaaaaataaatacgggtaaacaaaacatgtatctaattatactcagcttttttggttgaagataaacagatgctttagaattttagccttcagtaggttggaatcgtattatcattgtgtaataattatgaacaaatttctgactactgatattctccttaagttaggatttactctgttaacttcatgtcattattttagcctctttgtcttcatttacttttgtccttaaggctgtagaaacacgtagtaataattagtcagattatggaactgatgagctgtggttatagcctccatcaccagaaagccttccattaatttgtaacacagtgctatttacataggaaaaggtctattttaacagagctgtattctcttgaaagaacccttttgccctaggtatccataaaagtggcacagtagtgttctttgttttactttggatgcaaatggagaaataaatgtgaatcaaaagtaatctatgagaagtatagcaatcttttctgaaaatgtgctgaaactctgtgccccaaaatgctggcgcccacagttgttaattgcgtcattcctcttggatatagatgttttcctggacacaccagctacacaataagccagtaaatctaagtttgacctgcttgttattattgggagccctaggtatgtcaaaggcttttcaccaagccagggttattaatcaaagctgactccctcgtattgatcagacctcaaatggttgtgttccatgccaccctgtttatatattgctgtttaatttgcagccaccctgcgtgcactctatctaagtgacaacgattttgaaatcctgccgccagatattgggaagctcacaaagttgcagatagtaagtaatttatctaaattcttagaaaatcaattcactgctgcagccttgtaggggtagaatcaagtcaatttgagcaggagtaaggtttgttttgtgggaataaaccactactcctgatagtgtttcttgattatccgccggcacttgtaaatacatggaaaggattgagctttagtagaagagaggacatagaggatgagagtttctgtggagcaccttttaatgtgtaaatatgttgacaacttgttttcttctgtttagctcagccttagggataacgacctgatctcgctgcctaaggaaatcggggagcttacccagcttaaagagctccacattcaggggaaccgcctcaccgttctgcccccagaactaggtaaggttgctgatgaatgaacttagttctgggtttcatgaataacaattatcctaatgtagcaattctgaacaacctctgtcctcttcttggcaactactctccacctaggcacacgatgctgatcatttgagaaccatttgtcattgaccagagttagctgttacaggtttgaccttcccggatcctgtgttctgcagctgtagtgtcccctgtcttagaaactgctgatgaaagatgaccccgctcagctccctgcgtgatgtagtgggaaaagcatgggattagtagtaagagccttatccctggctcctcattgactagctgggtaagctttctgggtcttggttggttattaataactttaagtatcactcttactttttaaccccttaaatttttattgacctggaaaaacttttaccaaatagttaaagtagttgttatggctacttgaacatgttgatacctctgcgggtcgtgaatttgcctctctcctgatcccatctctagtaggaattgttaaatatgttcttgctgggaatggatcctactcctggccgctgaatcctaatcctgtttctctgccaggtcgttcctatttccagggtgggtttatgtcccccgccagaaataacctccaagccagtaattctgttactgcttcgttccactgcaaaaggttcacgagttcccttatcttttcttgtgcagaccctccatagcctctcatttcttcagtcctttgaaccacattgttttctcaaactgcgattatttgcttttctactccaaaataccatcatttttaagaaacacattgaggaagcagttctttaaacaagtttggcagtttgaagaggccatttgttagaaattagaatgcaatcaccaggagggcagggacatttttgtatttgttccctcgggtacagtaggtgctcagaaaacactgactgaatgaattaatgaagcaaggaccttggatgacaggacgttaggaaggttatgagcaggctcatgtggctaatggttacgcataggaagactgagacacagagcacgcctatcagcaccttgagttctgttggcagccatattagtctaaagggaaggcagtcacgtgatttcgtggaccagctgggaagtcccgcctcctctcttgccatttcccttagctctcttgctagtgttaaaaatccacctagaggattatttaatgattttttaagggctgaggagcaactcaacacttctctttactgagttgcaagtagtcacgtgttgctttgggagcagggtgacagaatcaagaaacgctttttgcaaacattttcaaggcaaaaaacttcttgttaaaggagagatctcgggccgggcacggtggctcccagttgtaatcccagcactttgggaggccgaagcaggcggatagcttgagcccaggagtctgagaccagcctgtgcaacatggtgaaaccccgtctctacaaaaagtacaaaaaattagctggacgtggtggtgcatgcctgtagtcccagctactcgggaggctgaggtgggaggatcacctgagcctgggaggtcaaagctgcagtgagcagtgatcgtgccactgcactcctggctgggtgacagaacaagaccttgttgaaaggaaaaaaaaaaaaaaaagagagatcttgtacagtggttaataaccacagatgttagcataagtaatagctggggagcttctgcagaactcaaaaacttgctccctccccaacctactaaatcagaatctccatgtgtgaggtgaattcttctataacttggtgtaaagctcacttaatgcctctgacatgtatgcttggttagtgtggttagtagaaacggaaaaataaatgtgtattttgatgtcatttgatcttatttcatttttcaagcagtgaggcaacgtaggatattaaacaattattttatcagacagtaatttgccacaaaaatgtctagttgaacctacgcatgcctatgtatatattttaaaatcttactcattttgcttatcttatttaaatactgcatgaggtcatatttgttcaacatttctgtaaggctttccattaacaaatcatgtatatttttattcaggtgtagaattgagggggaaggctttaaatgactttatttttgcgagccgtatgtagaaaagcttaatcttaacatttgcctgatagcagtttttcctgattatagacaaacagttgtaagtacgtgataaacctttagaagtcactgtcacaagcaaaactcaagatgaagacaaatggactatttatttttgaatggtgattttttttaaaaagtcaagattagtatactactaatacagtaacagctattataataataggtagtatctattaaggcctggaattgcaaggcactgtaaatgtttttcctgcaatatcacctataattatcgtaagaattataaggagactttttaaagatgaggacactgaggcatagagagagttggttgctgacaagtctgtggggacacagctagtgagtcaggtgagatttgaacctgacagtccctcctctgggtccagcttcctgatcacggtgaggtcctttttcccacccatatgctggtaagaggattcctagaaatgcagtttccaagtttgaacaaaacacaaccccagcacactctcccgaaaaggcaggcggagagatgttgctggatggtgagttggcgtgggctttgccggcatgtgagcaaggctagcataacactttgcaaaacgcagctgagatggcctctgcaagacaaattgctggccctttccaagccagttgcgttgtccccgtgtctctttcccctcagtaaacatgccccaggatgggatcgtctttggtttttttgtgtccccaacgcctgaggtgaccatctggatgctgctccgggctggctgatgggcagtgctgggcactggtgatgcatatgaagcttatgctgcaggtttgcttctgggggtgttttaaagtgtggatgatgatctctcgctgtatattttttacatatctgaatacacgagataaatgcttttgagatttctgtgaaatttcctttcataataaatccagagtttattgacttgtaaactttttggtactggtatttgagccaagcaagagaatccaggcgagttctgatttatcaggtctgagaacatacagggacacagcaaaataaagtcaggggcttggctggaggtttaatacgtgattgtgttactttaccttcactgtgtgtctttgaataagccatttaaactgttatgtctggttcttaagtagtaaagcacttgctttcatattagtctatatacctataagaaatgagatgtaagttgagtctcgtgtacccattcattcatttattcattcaggttaagttcctatttgagggcagacctttgagtccaaggaacttgccttttccggtaaagtaagagtcacttactcaacaactgtttgttgagcccctggtatttgctagggattagaacaagagacagaacacgcgtgactgatgatgttctagcgggagaagacagaagaaagagagagagaatatgaatgacagatatgtggtattaagagctctgggaaaaaaatggagcatggaagggagagcccggctggggaacgggtaatcagagaaaccctcactcatagggtggtgccctttatgcagagacttaaaggaaggagggaggtcccctgacagagagaatggtaagtgcaaaggtcctgggtgggcttgtgttgaggaagagcaaggccagtgtggctggaacagagtgagtgaaggggagagagttgtaagcaatgagcttagacaggaaatggggtctggttcacatgggaactggtaggacattgtccgaacttgggcttttactccgggtgaaatgggcactcctatagatgctcccgtcctaatcaccagaatgtgagaatttgttaccttatatagggaaagtgactttgcttatggactttgtagtcttgagatggggagattatcctggattgcccaggtgagcccggtgtaatcacaaggggcctcctaagacagaggaaggagggtcagaggtaggagtagaagacatggtgacagaagcaagaggctggagtcactcatggaaggggccacgagccgagaagtacaggcagcctccagaaactggaaaggcatgcagccggatgtcccccctgcaatcccgaagcctccagaaggaatgcagctttattggcacctcaattttagctccataaaatccagtttttggacttgtgcactctacaacagtaagagactagatttctattattttaagccactgcttgtagtcattggttagagcagcaaaaggaaactgatacaaatgggaagacattgaagggttttgaggaaaggcatagcatgatctgactttcttatttagacacagagtctcatgtgatcacccaggctggagtgcagtggtgcaatcatagctcactgcagcttctgtctcccaggctcaagccatcctcctgcctcagcctcccaagtagctgggactacaggcgtgcaccactgtgccccactggttttctcagttttttgtggagatggggtgttgctgtattgcccaggctagtctcaaactcctgtgcttgagtgatcctcctgcctcagcctcctgaagcactgggattacaggcatgagccatggtgtgtagcccctgactgtttttcagaggagttctttggctgctgtgctgaaaataggctggagggcagagggcaagggtggaagtggagagtctgagagataggagactatcattgcaatcctggtgggagtagatgctggcttcatccagatggtactggtagtggtagaagtaatggtcggatactggatctgtttccaaggcaaaactaacaggaattggtgacagtttagatgaggggtgagagagttaaggttaactgtgaggtttttggtctaagcaactggaaggctgggaaagattttaggaagagtagattaggagagggattgaggagaggaggtcatcctgacctgagcctcagatatcttaaatttgagatgccttaagggtgtctcattgagaaggcgatagggtataagaatctagagtccagaagagacgtctaggctgcatatatagtttggggcattatcagcatacatttaagagtacaaattggatgagatcccttgtgtgtgactgcagagagtgaaagattgagcctgaagcactatggttcctaaacactgaagccagaaggatcgaggatgttaatgggtcgggctgactcccaggcagacatccgtggccattcagggactgtggccacctcggttgacaccacagatggctccccattgctggagctgtgtggtgtgttttagcttcataggaaaaaggggttctcttatgagacagatgggggttgggggattattctctttttcctgacatatgcagttaactcggccaggacaggacagtggaatgcacataattgaaatatcctccggagcctgcctgaatgcagaagtctctttttgcccagtattttcagccagcatccagactcctaaaaagcagccagccgtgtggctaactgaactttcaccccttttttgttcttttatatattatttcttagaagaattaattagtagagaggataaaaatcctgcgttggtagtgaagaaaggaaactcaatgcataccctgaacaatcctcagaataggtcaacagccccaggaaaaaaaaaaaaaaaaaaaaaagtgatttgggagctggtgacgtcacctggggtttgttagcagttttctattccatttctgcattttctcacctgccgatgagaccgctgttgtgtgagctgaagatctggattctgtgttttgcataattctctttcctgagcattccatggtttctgctgcttgttctgaattggaatcgtttctggttgcttggcttctaggcagtaatgggacctcttgtcccgcatttgttacccagataattttgcctttggagaagagggaaaaaaaatcacattggtctgctcggcatgcaacaaaacaaagtgctatagacatcaaaaccttaatttgcaccaatcccagcagcctatgggacgtatgtctgcaacgctgcatacacctggggctagccagcttagtgccctgcaatatgtgcccacaatcaataacattttttactacagtaactatgagaagcatagtattttctagcatacttgtgaagagtggaaacaaatactaatccccttcagagagtaaaggatgttatgaattgagaatttcctctcaattatatactccagaataaacagaattaacaatgagtggatgtacagtcaaaaatctcttgttatatctcttaatccttttcctgtggacattaagaagctaaagaaaaataactttcttttctgaggcagggaagaagaaaatccagtatttgtttggtcaattaagtccctgattataagtgtcttgtttatcttctcttctgttactgtcattctgtcaactggttcccatttattttatccagaggtttaaaacgttttttaaatgtaaacagtagaggatagaggttaagtgctggactctccatcactaggcttgggttcaaacctcactctcccactgccttgttctgtgaccttcagatattgatatgatgtggctctgtgtcctcacccaaatctcatctggtagctcccataattcccacgcgttgtgggagggacctggtgggagatgactgaatcatgggggcgggtctttcctgtgccgttcttgtgatactgaatgggtctcacaagatctcatggttttaaaaatgggggtctcctacacaagccctctcttgtggctcctgccattcatgtaagatgtgacttgcttctccttgccttccaccatgattgtgaggcctccccagcctcgtggaactataagtccagttaaacctttcttttgtaaattgcccagtctcgggtatgtctctatgagtagcgtgaaaacggactagaacagataatgttattttacctcccttctacacctcatgtaaaatgagggtaataacagctcccacctcctggtgtctttgtgaggattaaaaggataatctgcttaaagaatttagccttgattcaggaatgagtacagctgctcagtgaatgttaggtaaatgaacacacacacgcacatacacatacgggcacagtggatatttatgctattaaactttgactgtttagagaccagctttctgaaacctgggctcttctgaaacagtctaagcagagaggtcaccccagccccacccttttgacagggaagaggcagttagttaccgagtgcctagtgagaaagaaacaacagagtagatccaaagccaaagtctcacctcacacagtgggattggtcagtgtatcctgtggataaaagaaaggctgggaattatcctcctgtgtgaaaactgaggcacataggaagggtcagaagagaaaagcgagggaaaagaaggggcaagagggaggagctcagatgaagggattctgcatggccagtactcagggtggacaaaagacatagcaagaagagtatgcccgcagtccatccatcctaagaattttataattacaagcaattttccaagtctgtgcctttcttgggagttttatattgaggctgggagcaagttctggttgttctgtgtaaaaagctctgattggctttttggttggaccattggttgtttcattcactcattcacccattcattcaattctttctttttgacatcctttatatgattattaacttgttcctagtaagtgttgggtactttgtagtacttgcagtaactgattagactcacttctttatccatattaagatcttaaactacctctctgcaagtgacaacattattttctaattgtttaatttctcactgtcttaacattaccttttgtgacagcgcttatttcattggggattttttttattctcccagaattcatgataacaaccactgttctgaaccaattgcttcatttgttatatcagttgtgtgcctacactataatgcatttgtcacttgtctacatattagtaatttatttcatgtttaacatatgctatataaatccatcttttgaaatctttattatcaattaaaagcattatagaaaaagaagtctcttctggaggtcgacaaagtagttcagctcttatatgaaatcttttctttctttcttttttttttttttgagacagagtcttgctctgtgtcacccagactggcttgcagtggcatgatcatggctcactacaaccttgaccttctgggcccaggtgatccttgcacctcagccttccaagtagctgggaccacaggcatgcatcaccatgcctggctaattttttaacttttttagagattgagtctccctacgttgcccaggctggtctcgaactcctgagctgaggccgtccttccaccttgtcctcccaaaatgttaggattacaggaatcagccacccacctggctaaatcttttaactatttccttaagaaaagatgtagtgcgattattaactatgtctagaataagcagactccaaatacataataaaaaagttaatttttttagactagatttttgtttcggggtaattaccttccccaacccaaggcagctttatgttgttaacagaattggttttcttgcctaaatcctattactatgaaaagaaggtctagcttaatagatagagcagtaagtgacaaggatgttctttatggaattgtaaactgtgccactttcgcatgaataagattgactttgtcaattgatcactaacatttttcagattagttttaagctagatataattacagacatatcttagtttttgtgcagaatatcgtaatttgcagaagagtttcatgcacttaatctcagttgtataatgtaggcaaggagagctctctggcctctttttaaagatgatgggaccaagggagattgtgacttgcctaaggccacgttattgacatggcttattatagacagaatccagtttttagttcagatcttcctaattcaaaaataagcattcctcccaatggtatacccatcaatgtgtcaaaactgagccaataaaaaggcctaatttattattaggtgacagattgctgtggttccaaatatatgccttaattttatttgaaaaagaaaatgttgggaatagaatatttgtacccaactttgaattttgacttggattttattgcatgctcctacgttttaattctgcattaatatttcttttgccatacttcacaaaaaatcataccatatcctttgattcccctggccttcactgataatcaaaaatgactcccgtcaagtctcctacatgatattttttaacaagttccattttatatattctatttcagtgaaatctttagccccagaaaatgttttcagcatggatttttaaaatgctaagtgaattgtatttctgcctggtgagttattgccttaaaggggttgggaagttgcaacacataaagcgtttccgttttgtagtataaatttcaggaagcccagtgtcaggttcagcgtgattgaacatgtgcatcaatctgtgttaacaccagctggaaaagcttgccactgtgtgcagtggacttcctttgatttaataggatgctaaatgtattttgccctgggagaaatgccggcagtgctaacgttccggatttaattttttttttttttaaattccagaggcatgtctctaaatacagttgttatcacctcaatacatatataatatcttacatttatgtagcctctccctttgaggcatctcctatatattatagtgttcctatgttaaaagaaaaaaaaagcaaggttatactgagtcagacccaaatggtattgcatgcgtgtgtgagtgtgagagtttctttcagagtgcagtgggagtttgaaaggagtgaagtgggtgacagttgtccctcatgttgtcaacacctgaaatctaggccttaccgtgacatcatggatcagtctttcatatttatatttagacctttccagaattcttcacattttcaactgagtattaattccctaagttgactacccattacacaaaagcatctaattgtaccatttatactcctgtgaagttttgggtgatagcattctaatattagtaaataagcttatgctcattttttcaacatacgtagagtgattttaacacgcctagtactctctgttgccttttatatttgctgttttaaaaatatcggctcttctccttggacagcccctattgaatccatcttaaccataccagaatctgacttccaaccccatatacattatatttctgtaatcagttcagtttggggagcactggttaaatgaaacatacataacccttaccttcatgaagaaaatctttgaaagaaagaaacagctgcacaaataaacattacaaaatggctgctagaatgtaagcttccccaagacattggtttaagccaccctcatctctcacctgggttgctagagtaacctttcaactggtttcctgcttcctaccttccctttacaatccattcttcaccccgtagtcaaggtgatcttagaaaattacagagtggattgtatgcctttgtcaattagagctctttaatgttccctaggaatatttaaggcccatctggcacccatggtttccatgctacttatcaccctcactcactcatgagccgctgtcaataacctcctctcactttttcatgatctttgctctctccttggaattttcacctgaatatttttgcagctcataccacacaattcatacattctaagtgtacaattcagtgttttttagtatgttcagagttgtacaaccattaccacaactttagaacatcgtttgttacctcaaaatgaaatgccatacccttttctttcccactccaatccgtccatctctcctagccctaagggttttatagtttggctcttacatttatatctttgatccattttgagttaatttttgtatgtgatatgagctaaggattcagttttattcttttgcctgtggctgtcctgttgttccagcaccatgtgtagaaaagactgttctctttttatcaaatggtcttggcactcttgtcaacaaccaattgacagcagatatatagttttatttttgtactttcaatgctatttcacttatttatatgtctatccttatgcgagtaccacactatctttagtactgttgctttgtagtaagtttttaaattggggcatgttagtttcaactttgttattctttttcaagattgttttagctattttgaggcctgtgagtttccaaatgaattttagaatcagcttgttaatttatacaaagaagccaacttgtgttttggtagaaattgcaccgaatttgtagattatttcagggattatcataatctcaacaatatgaaggcttcagttcagatccatgaacatgggatattttttccatttatttagatcttcgatttctttcagtaatgttttgtagatttcagagtttttgatacttttgctaaattttttcctaagcattttattacttttgttgctattatatatgaaattattttcttaattttacttttgggttgttggttgctagtatgtgggaagacagtggatactgtattgattttatattttacaaccttatgaactcagttattctcattgttttttagtggattccttagaattttctctttatgagagctgttttacctcctcctttccaatctggatgtctttaattttattttcttggcaattactttggctgcaacttctagtacagtgtggaatatagatggcaagagcagacatccttgtcttaaatcttaaggggaaagcatccagtcattcaccatagaatattatgttatctgtaagatttttttgtgtaacccttgtcagattttacaaatgcccttctattttttgtttgcagaatgatttatcatgaaatgttgaattgtgtcaaatgccttttctatgtctatgtggcttttattttttgtatcttcctttttatatatttctggatttcatttgttagtattttacttaaaatttttccacgttcatgagggatattagtttgtagttttcttctggtattatagtatctttgtatagtttttgtttcaggactatcgagtctcataaaatgagtaaaatttgatagtttttcttttttgaatgtttgaaaaaattcattattgacgccatctgggtcttgaattttctttgtgggaaagttttgaattatgaattgagttttttgatataaggctcttcagattttctgtttcctctagagtcttttggtaattctcatgtcttaaaaatgtacattttggccgggcacggtggctcacgcctgtaatcccagcactttgagaggctgaggcgggtggatcacctcagttcgggagttcaagactagcctgaccaacatggagaaaccccatctcaacaaaaaatacaaaattagccgagtgtggtggtgcacacctgtgatcccagctactcgggaggctgaggcaggagaattgcttgaacccaggaagtggagtgagctgagatcacaccattgcactccggcctgggcaacaagagtgaaactccatctcaaaagaaagaaagaaagaaaatgtgtagtcccagctactcaggaggctgaggcaggagaatggcgtgaacctgggagccggagcttgcagtgagccgagattgcgccactgcactccagcctgggcgacagagcgagactctgtctcaaaaaaaaaaaaaaaaaaaaaaggaagaaaatgtacatttcttgcaaatcaaaaccacaatgagataccatctcacgccagttagaatggtgattattaaaaagtcaggaagcaacagatgctggagaggatgtagagaaataggaacacttttacactcttggtgggagtataaattagttcaaccattctggaagacagtgtggcaattcctcaaggatctagaaccagaaataccatttgatccagcaatcccattactgggtatatacccaaaggattataattcattctactatgaagatacatgtgcatgtatgtttattgcagcactatttacaatagcaaagacttagaaccaacccaaatgcccatcaatgatagactggataaagaaaatgtggtccatatacaccatggaatactatgcagccataaaaaagaatgagttcatgtcctttgcagagacatggatgaagctggaagccatcattctcagcagcctaacataggaacagaaaaccaaacaccacatgttctcgttcataagtgggagttgaatgatgagaacacagggacaacagggaggggaacatcacaccctggggtccgctggggggggtggggggcaaggagagggagagcattaggacaaatacctaatgcatgtgcggctgaaaacctagttgatgggttgataggtgcagcaaaccaccatggtacgtgtatatgtacgtaacaaacctgcaagttctgcataggtatcctggaacttaaaataatttttttttaaaaagtacatttcttctgagttagtctgtattgtccccatttttattgttaatttatgttttccatttttcccccctttgattgattggtccaaatagctgattgtagtttcactgagttattttattctttgttttgtatttcaatgatttgcttttcttcttctgagtacagctggctgtgatttttctagcttgtttaggtgaaagcttacgtgattgattttcagtttttcttctttttttttgagacagagtcttgctctttcacacaggccagagtccagtggcgctatctcggctcactgcatgctccgcctcctgggttcacgtcattctcctgcctcagcctcctgagtagctgggactacaggtggctgccaccgggcccagctaattttttgtattttttttttagtagagacggagtttcactctgttagccaggatggtctcgatctgctgacatcatgatccgcctgttttggcctcccaaagtgctgggattacaggcgtgagccaccgtgcccggcctcttcttttttagtgtaagcatttcaagttagaagtttttctccgttgttttagcagcatctcacacattctgtaatttcattatcattcagtttcaaatattttcttttgtaagacctggggcctgttatttagaaattgagaatttgtttgttttcaagtattcggagatatccgaaacattttgttactgatttctaatttaaattatgtcctgatcaaaattcatagtctatataattctagtccttcacaatttgttgatttgttttatgggcctgcgtattctctagttggtgaattttacatgcacacttaaaagttttatgtgccccatcagtgttccataaatgttaggttacattagttgatatgttataactcccggtaatattgtttttttttttccttaagttagttttcttaaataactttagagaggaggaaaaagtttttcacattgactgccgcttctctatttaccatttctgatgctcttctttccttgatgtagataggcgcttccatctggtatcatttgcctttatcctgaagaattttttcttttgtatttattgtagtacagttctttttggtcattaattagcttttgtttatctgaaatatttttattttgttttcagtttttggaggaattttttttcaggatatgaaattttaggttgacaggttttttattttttttacttctaccttgcttcaagggtgttttcttgtctctggtttgcattgttttagtgtctttcttacattgttctctgtgtctatttttctgtggcctcttaaaattttctgtttatcattgggttttagcagtttctcatgtaacatgttctttatttctttttgacagttttatggagcttgtctcatatatgggtttatagtgttcataaagtttgataaattttcagccattttttaaaattaattgattggttggtaggttagtaattttcagcctttttttttattgattgattgatttcccatctctctctcctctcctagaacttacattactcttgtgttagatcacttgatatcttccacaggtcacttatacaaaactttttatcttgttttgtttcttttcatcatcttcccccctcccctcccccaccatcccccttttggcttcagtttggatagtttcttgtgcactgtcattaagttcagtgattttttttgttctgtagtgtctaatctcctgataagcatattcagtaagatttattgtttcagatgttgcatttttcacttccaagtgtatgcaaggtatagctctttttataatttcatttctcaatttagatactatttatttccttattatgttcatgtttttctttaaatctttgcacatattttaaattgctgttttaacatttttatctggtaatgtaatttctgattctgtttgcattgatggatttttcttttgtttgtaagccacttttttcctcttactctgaatgtctagttttctgtgggtttttttgttttttggtttttggtttttactgtatcgtagacattaagaatagtacatttttggttgtatgaattctttttgtctttttttatggtctgttgggtttcattctagcaggtcgttaatttttggttagcttgattctttcagggctggtttttaatgcctgttagacttggtccttactagtctttactcctgggctagattaaccctaatcttaagacttctgggattactgcctcttgaccagggtgcttagtaacatcgttactctctggctgatcagagtgtgagtgttttctagttctgtgaaaactccagtgattgtttagcttatatcttccttgtaattggtctttccctggtagttatatcttccttgtagttggtctttccctggtagtttttgttttttctttcccagcctttaggagtcttgtcctgaacattgtagttaatatttggcaaagattcatgggaattcctgtgcagctttctgggcctctttttcttcatagctcctttcctgctatgccctccttgccccacaaattccagctccttgagtagcctcaaactctgatttctgtcctttcaattcagcattgccactgtattgtttgatccactcttgcacagctgtctggaaatgcttctcagagaaaaccagagtgaatgtggagttttccttactcattttccttccctcatgcatcatagtcctgtgctgcttgtttcctgatacggtttggctgtgcccccacccaaatctcatcttgaattgtagtttccataatctccacatatgggagggacccagtgggagacaaatgaatcataggtgctgttagtccatgcttctgttcttgtgatagtgagttcttacaagctctgatggttttataaaggggtttttccccttttgcttggcacctctccttgctgccgctacgtgaagaaggacatgtttgcttcccctctgccatgattgtaagtttcctgaggcctccccagccatgctgaactgtgactcaattaaacctcttccctttataaattatgtagtcttgggtatgtctttattagcagtgtgagaatggactaatacattgcccaatatctagaagcatttctattatacattttgtccagttacttcagaatgccagaagcaaaagtctggattaatttttgataactgccaatgtggaaaggtataattatttttctgctcttttcttacccatttacacaaccgccagaggttatttttgctcaggtcattccctcaaccctgcattcactggctggattccatagcagacatagcggtattaggatgcatatcagacttcatgttatgtacacatgttctttaagaccattttcatctttattcttggtattaacaagtttttaacccctagaataatttcttggtctttattgctttttaacttatctgttaatgcactattatagccgagaccaactgtattagtttgctgggtctgccataacaaagtgccaaagactgggtgacttaagcaacagaaataaattttcttgtgttcgtggagattagaagtctaatgtcaaaataacagaattggtttcttctgagggtttaagggaatgattttttctagacctcactccttggcttgtgggtggcccttttctccctgtgtcttcactgtgccttccctcagtacctgtctgtgttcagctttgcccttcttgtaaggacaacagtcatattggattaagatccactcatatgacctcattttaactaaatcatctctgtgaagtcaccatttccaaatagtcacattctgagatattgagggttaggatggaattcagcccataacaccaaccatttctcatgtttcttactttttgctgctgagccttggtgtaaaacttgatatcctgtgatactgttgcattgttcacctgcttattcatgtcatcattctttttcattattgcaacaataagtcaagttaccttaagccattatttttcatcttttcagaaatctttgagaaacaagtgaaacctatggagataacccccccaatatatattttcacatatgacattttacatctaatttggagagttttaagatgcccccatatccacgcatgtgccctttagtgcagaattcccgccccaaatattcatcattgtaaccctttattctaggttccatccactgactggtatagatgtcattcatgtataactaccagatttccccctgaatcacatgcagatgaagaagagtgtgtgagcacaggattcatgaatgcctagtgcaggaagttataggtattgaaagggaaaagcaatacatcactcatttgatctgctctctttcagatcataggatgtagtggtagatggtcacatattaaactttaaagaggtgttggctttcttcccccttgcatttaaaaggtgatgtgctgcaatgtgagacaaatcatgattcactacaacagtgttgcagtcagttatataaattgccaatgaaacactaaatctgtcactttgtgtgttccgacagtttagcaattggagtcgtgttggaagagggctgactgggaacaaaagaagctgatatagtggcagatgcaattagcaagatcaatggttagtgttaaaggttcattgtttggtcattttggttgactgaattgaaagcaattgctatctaaaagactttgccagctgtaatttgctataagagaatgcagaaaagttagttgcccaactttataacatcttggagactgttatttctcaacttgctgtgttcctaggacagtgaccaaaagattcagcttgttcttctcattcaagctcattcaagcttttaatagatactctagaatttctgcatgttcagtatatatacgttttttactttagctgttcacctacttctttcacaaaaatttttgggtccgtgttatagcctttataacagttctttgaaccctaatttattacagctttctgttgcttcagactatgagagttttcgctgatcactacttgaactatagcaaacaccactttgaataacattgggttttctgtttttgtttgtttgtttgttttgcgacagagtctcactctgtcacccaagctggagtgcagtggtgtgatgtcacttcactgcaccctctgcctcctgggttcaggcaacactcctgcctcagcctcttgagtagctgggattacaggcacctgccaccacgcttggctcatttttttttttttttttttttttttattgtcgtagagatggggtttcaccatgttggccagactggtattgaactcctgacctcaggtgatccgtccatctcggcctcccaaagtgctgggattacaggcatgagccaccatgcccagccgggttttctattttaataagatttatataactttgcatttcagtgccttaaattgaccagtttttagaaatgaatataggtgaaaatatttgcctagtaatgatgatggctgatgatactaatagtccatttatgagtgcttatcttccctaagataggtcatcttaaataagatatttctgtgagctggagttacttttttcccattttacagatgaggaaccttaagcttagagtaacctgtcaaagccatgcaggtagactttatcaaactccatccatgcttccaaccttggaagttaaccaagagcttttaaccacttctgcagaagtggttaagaacctatgaaatgtttattaaattcttatctaatatcttcgtaagcctttctgaaaggcacaaaaggtatgacccagttctgtttctaacagagctactaacctagtgaaacttgaagaatagttaacctgttaaattggaacaccaggtgtcactgcagtagaaatgtagcctgggcagaaatcatcatggcttgagatagtctaaaaaagcttctgcagtatcttagtcagcttgggctgctataacaaaaataccatagactgggtgacttagacagcagaaatttatttctcatggttctttgggctgggaaatctgagatcaaagtgctggctaattcatttcctggcaagagctctctttctggtcccaggtgacacatcctttctgtatcatcacatggcagagagatcatttttcttgtgtctgttcttataagagcactaatcctatttataagggctccactctcatgacctaattctcttccaaggaccctacttccaaataccatcacattagcacttagggctttaacatatggatttggaggggtcataaatactcagtccacaggaagtagaggtgagattttagctggcacatagcagaatcaacaatggtaagagaaaatgcaaagcagtggtatatattacatttcatgacttgaatataaatttaaactgttgttaggctatggtctctgtccctttgtgtacttcccatgagcactcatcagaactgcttttcattcagttaggtcttctgtgactagttgggtaatactgaggcatcagtttggtggaagctactgatactgtacttcctcatttagcccagttggttctcagagtttataagtccattggccccttaaggaagtcaatgaaagccatagattctgtctaggaaaaattgtatatacttgaccatgggacctgggattaaatatctctgccctgtcccaacaatatcggcttatcttaaccactctcaaaagcgttggagataaatggcagaaagctactttttatacctcagtagaaaaaaaaaaatgagcaagaacagatatttcacaagagaagatcaatgaccaagcctataaaaaactggtcagccttagtagcagtcaatgaaatgcagattaaaacaagttactattttttagaatatcgattaacgaagattttaaaaatgataatgcaaagtgatagtaaaggtttggtgcaatagacattttcatgcattgctgttggattgtaaattagcgtgttaattctagacccatttttggagtatatgccaggcaccgtaaaagcttccaaccttttgttgcagtaagctcccttggaattctatcatcaagaaataatcaggaactcagaaaaggttagtataaatatgtttcttgccacagtatttttttttttttttttgagacggagtgtcgctctttcgcccaggctcgagtgcagtggtgctatctcggctcactgcaagctccgcctcctgggttcacgccattctcctgcctcagtctcccaagtagctgggactacaggcgcccacccccgcgcccggctaattttttgtattttttagtagagacggggtttcatttgccacagtacttttaacagtagaagctttgagccaccttgatataaaaatggttaaattaactagtagatgatggaacataaaatgacacgagaatacttataatagcacattataagattgcatttacaaggccgggtgccatggctcacgtctgtaatcccagcactttgggagtctaaggcaggtgcatcaggagttctagaccagcctggccaacatggtgaaaccccatctctactaaaaatacaaaaataagctgggcgtggtggcgggcatctataatcccagctacttcagagactgaggcacaagaatcgcttgaacccaggagacggaggttgtaatgagccaagatcacgccattgcactgcagtctgggcgacagagtgagactcagtctcgctgaaaaaaacaacaacattgctttacagtgtgattccagttacagagaatattcacataggtgcataaataaatgaaaaaattattggttaatgtctctgtatgttgggattctcagtgattttatttttctactttttattttttataatttctccagtgtgttggtgttagctttatagattatatcaagtaaccttttgctgcaccaaaaaaccccccaaatctagtggattaaaacaaaaccatcttacaattttgtcagaactgtctaagctgatatttactgggctctctcctgaatgtggggtcagctggggggttggctaatagggtaccctaggatggtctcactcatctgtggtggttggcagaccgttgtccaagacactgcacttctcttccgggtggcttctcacgccttctgatgtgctagcttgggtttgttcacatggtggtctcttccagggatagtacaaggtacagctcacgtgcatgaggtgcaagttgatacagtttggatgtttgtcccctccaaatctgatgttgaaatttgatccccagtgctggaggttgggcctggtgggaggtctttgggacattggggcggatccctcttgaatggcttggtgtgtcctcatggtaaccagtgaggtcttgctttatgagtccccaggagagctgattcttaaaaagagcctagcacctcccttccgtcttgccctccatcctctcgctgtcatctatacacaacagctccccttccccttctgccttgagcggaagcttcctgaagccctcacaagaagcagatgctggcgccatgcttcttgtgcagcctgtggaaccaggagccaaataaaccacttttctttgtaaattacccagcctcaagtattccattatagcaacacaaaaatggactaagacataagcccaggtacacaagcactttccaagtctgttacattcacatttgctaatgccctctctattgaccaaagcaattcacttgattaggcccagagccagtgtacaaggaaacaccaggggcatggaaggtacagaggagagggcgggatgatcacagctgtttttgcaaacaatctttgacataaacagtgatatcaatgccataaaaaagaaaaataaacccctaacccatctgaatcctagtgcagagccttctgagagtgatagtatctttatgttttgactgcttcagaggtctccatatcttttcatgcctttgtggttacaaggagtagcgaagacgggggcgggcagatcagtgatcaccttccttggccttccttggccatctagcatacagttaaccttccttgactatctagccttcagttcccctaccactcccttttcagcctgagtggccaggtacttgggcttatctgttaatttttctttctctttcactgaaacttcctgccacacccagaagaaaaccaatagcatggtactcacagggaggtgaatagaattataatcgaagagtgctcattttgtgggtctgaattggaagtgtatttttgtttttgcaatatcactaataatgtttcctagccttgtgtaagaattaaaatgtgttgcatttcattgcaaattttctgtgccaagacaaaagtagattattctactctcactttgtgtaacaggaggcaaaagcttccatagatgctttatgaatagtattttgaggcctagaaaaataagttgcagagtagctgaaagtgctaatggagataaatacgcggcatatgtttgcatagtgccttagtttcctattgctgctataaacaatgagcacaaacagtggctgaaaacagcaccgatttattctcttatgcttctggagggcggaagtctgagatctttttcactgaattagactccacatgtcacccaagtcacttccttcaggaggctctagaggagaatggctccttgcctttctcagcttctagtgagtgcctgcattccttggcttacagccccttccttcatcctcagaacctaccacatcattctctgctaccgtcatcacattgcattctcctctcactctgattcttctcccatccctcttataagcaccactgcaattatatcaggcccacccagataacctccccaactcaagatccttcacttatccacttcgacaaagtcccttttgcctcatgagctgatatgcgcaggttccagggattgggacagaaatatatttggggagccatcaccccgcctcccacacatagtaacacacctatgaacctcatagttccgttgcgtttgtgaaagtggtttctttcccctgcttcatgatgggcctatgtgtcatcttctggatgagctggctggtctgcagggttctgcctcacttcctgatcctgattccactgggatttgggtctgggtatgatgaagggtgtaggtgtatatgtgactgatttttattcttcatattggggagaaatgaagtttattttgctctcctccctcattctatatattgatattatgattaatagcttttgacaccaaactattttgaaatatgagtcttttatgacgtattttgacagcagcaatggcatgcttttcgctgttgtaacaggagtaaatgacaggggccactcgctcattattttatacccaagtaatcaaccaaagatgtcatgtccagaaataacactaaaatgtcaaccacccaaatctcttgcaaatagtctcattcagagggttggaatctgccttactggcagttttgaaagatacaatttgttgaagacagggagccctaagtgatttctttctctctccgagatgccagatgggtgttgaatgaagtccagtttttagtttttctgtagataatttttttaagtttgtggtggtgtttcggatcttcatccgtgtgttctccctcctctagccccccacggctacccacagcctggcagcggtatggttgccttggtacctgttcctgaaggctgtctgcaatgaaatttggttgtctaaatagcacgacttgtcatctaaaagtagaagtcattagcacgatgccgtttggctagtggtatcttgaatgctgttttaaaaattttcttattttatcactttactgttactgtttactcatgtcatcactggagatttcagggcctgcttcacactatggatccggagtgaaaaatacgaaatgttctccctaagagtttcccagaacttgcgccaaaaacagtggcccgagttggacattttgtatatttttagagacacagattttgaaattccagccgttgttacctcgcgtgatcagtaatacttgcatattggtagcggcaatccatgattgaacagccttctgctgtttctgagggaaatgaaatttctgccagcttctgtttgaactttaattggccttcactgtggtcgtgaatttgccagaaacacgtatttatctcagaaaaggtagcatgttttttaagtttgatataaaagttgaattgggtgctttgggaggatttgtgtccatttgcctccaatcaagttatctcctctgtgaaattataacaaaagatgcagccaggcggaacatcgtcactctttccgcccaggtgagtccactctgaagtcaatgactcctgtcactataggtaagatgggaggccacatcctgttcccttgtggtaggcatcttggcaaaaaccaccaactggcagcctgtgttgtgaggaatgcacattaattagttccttgaaactcttccctcattaacttcaggtaagttgttaaagcaaatgttctggagttcagagtgttgcttttgataatgagaaaacaagtttagtcatcagaatctgtcatcttgtttataaaacagtcaaaccatatgcaacgcccttctgcatggtggattttgttttgttccttgaacctactggctcgcttcatccaatgcctacagatagtaaataaagaggtccatttttttaggtacattaaatactacaaattttgggaggggaggtagagtaggagggtggtgggcagaaggcagccgggccatttttttggcaactaattcaatatgagaaaaaagatggtattgctctcataaaagtaatttatattcattgttttcaaccaactgaaacattcagaaagctaaaaacatttcagtcaaattcccaccaccttgaaataatcagaagtatgttttggtgaccatcattcaagatacgttcttggccgggcgcagtggctcacgcctgtaatcccagcactttgggaggccgagatgggtggatcacgaggtcaagatatcgggaccatcctggccaacttggtaaaaccccgtctctactaaaaacacaaaaattagctgggcgtggtggtgggcacctgtaatccagctagtcaggaggctgaggtaggagaatcacttgaacctgggaggctgaggttgtagtgagccgagattgcgccactgcactctaacctggtgacagagcaagactctgtctcaaaaaaaaaaaaaaaaaaagatacgttcctaagatagacagaaaggtaggtcaagaagcaggtaactatattgacaaatgaagaagcataatatttttaaatgtaaatttgaatctaagaaaggaaaatcagatgaagtaatttctgaacttttactatgtgagtccaagaatattaagctattacttcctaaaatattactgtaaagtaaaaataacaattattgacaatattgagaagttttatatgtatatacacatatatacgtgcatatgtatctacattctatgtatgttttatacatatataactgtattttaaactgtaattttcaaaatagttttgatagctttttgatttgttgcttatttggctagatttaattgccaagaattttatttttgtttatttcaaatatggtttatgttacatatcctttgttcctgcatactagatgccttagtccattttgtgctggtttcacaaaatacttgagactgggtaatttataaataatagaactttatttcttaccattctgggggctgggaagcctgagatcaaggagcggacagattcagttttctggcgagggctgcattccatctggtgacactgcatcctctggagaagagaaatgctgtgtcctcccatgacagaaggcagaagggcaagaggaatgaacttcccttcttaagccctgttataagcgcaccgaatacctttcacaggggtttaggtgtgcttgtaaacatcatgacttaatcacctcctgaaggccccccgctcaagatgctttcgttgataattaagtttgaacttgaattgtagagggaacagaagcattcagaacctaacacttcagagtatctgttcctttctcatttaatagataattcgtctaggtataaaaatctcgagtcaccttttcttttactggaatcttgtagatactgtctttgggcattgaatttccttaatgtgatactgggggctaacttgagttgcccacttaatgatgacttgctttctctgctaggatgtacataggattatttatttttatttattcatattctctctctcttctcccatctctactatatttattaaagcatcgtacatgtacacaaaagcgcatataacataagcttatagttcagcgaatgatcaacatgccaaaactcacgacaactattcaggtgaagaaatagaacaccactggagtttcagagtttcctctgatctcctttcagtcattaggcaggccttcctctctgctcaaaggtagctacttcttcagcttctaatatcattgacttttgctgttttgggattctacatgaacggaaccattcagtatgctttctggcttctttcactcaacattgcttcttgagattgatcccgattgttgcatagagcagtatttcattcattttccttgctcccatgatatgtgaattatctgtgtgtcagccctagttctcgtttgagctacttactggcttaagcaacagccttgtcacttttgagtcattccccactttgggactggcagtgaaatagaggctgtcagtgggttgatgagtgagcactatgtcccctccctcgttcctgtcacctccttctcggacagtaaagtcactgttcgtgattcccccttctgctcctcttctgccacgtgctgttagcagggtttctctggggatacccactgctgccccttttcttttagtatgttctcactcagatcttagccctttagccaatggctcatttcagtggtcttttaggacggagaaaaatctgtgtcatgcttgcgttccaaggagccatgtgttcattgctaatgccctccctcattttggtccagtttccctgtattcagctaatgttcattatagtttgtggtgttggagtaataaccatttatttatgaaaccattttattatattttattcttttctctttcacagtagattttagggaaggagaatatacagaaatgtttttgttccttcctgtttaactgcatgtctcagctgggcccggtggctcatgcctgtaatcccagcactttgggaggcgaaggcaggcaaattacctgaggtcaggagttcgagaccagcctggccaacatggtgaagccccgtctctactaaaaatacaaaaaaattagctggacatggtggcaggtgcctgtaatcccagctattggggaggctgaggcaggagaatcacttgaacccgggagatggaggttgcagtgagccgagatcataccactgcactccagcctgggcaacaacagtgaaaccccatctcaaaaaaataaataaaaaggcatgtctcataaattagcttaggaataagtgcatttaacaacccaggactgataatgtgaggattactaacatggtgaatatttaccatgttggtatatctctgcacgggtggactgagtttccttttggggccatctcagtcaccttcttccccctcatttgtcccagcgtcctgccctccaccctctagtccatcttcctgcaggcctggctgtccactgtcctgtgttagccctgacacctgccaagccatctgaagcttcccattcttcttggaggctgattaactcagaagaatgctttaaccagagggggtaaactatagtatgcgactagctttatgttcctttataggtttttaatatcagcgaatggagaattattctatactgcctttgagtatgagcttaatctcattcatcatcaaaaagcatctggaatctgccattggagctcttgctcaaatgcttgactgaactgtagggaggtgctttttgttctagtgtgtataatgtgtataatttggtgccaacatggcagccccttcagatcagagccataactttacagaaggaacagtatctctttaaaaatagacacaggtttaagatttaaagtgacagcaacatttttgagaaaattttttatctgaaggttgaaaaaacgttggatcttatataattaaagagaaatgtaacctttatgtctgactgtatctttgctttccagttcaccaaaatggtacccacagttgaaaacactcataagaataatgaagtcacattgcgatggactttgctctcccagctcaaattatgtgccaactaatacagcaaatcgtatgatatatgtgtgtatatatatatatcacatgatatatatgtgtgtatgtatgtctatatacatatacatatatgtgtgtatgtttgtgtctatatgcatatatgtatatgtgtgtatatatacatatatgtatatgtgtgtatatatacatatatgtatatgtgtgtatatatacatatatgtatatgtgtgtatatatacatatatgtatatgtgtgtatatatacatatatgtatatatgtgtgtatatatacatatatgtggctgtatacatgtatatatgtgtatatatgtatatagacacacacatacacatatatacagatatacacatatgtagtttgagttatataaaaagtgtgctcttaagacagatagcttgcttttctctaacctctattgtctggaatattgtctatttggcccttctgtaaatgctatgtagacccataatatccttaactttaattttggatttcttcactcatgagttctaactccatatccccaacctagctagacctctcacctgataccccagatgataaatcttattgcttggtggatattttcactttcatgttccagaggcacctcacattgtaacaggcctgaggttgggctcctccactcctcttgaattctgtgcttaggtcgatgacaccaccattcatacatccaccagctagaagcctgggtgtcagctcccatgcttcatcaaatccttttcctggatcagaggttcttacttttcatctgttttcttaaacaatattcccacctcattagtgtgggatatgttccaagacccccagtggatgcctgaacctgcagatagtactgaaccctagaaaaacagtactctgtttttctgatacatgcatacctttgataaagtttaatttataaatcaggcacagtaagagattaacaataataatcaaatagatcagttataacaatatactgtaataaaagctatgtgaatgtagtatctctctctcaaaatatctcttcatactggactcaactatttttggaccatgagtgactaaaaccaggaaagtgaaaccacggataagagagaactactatgatagtacagtggcagtagcaatagtcacggtagtaattaataataaaaatttctcttgtacttgctatgtagccggctttgttctaacagctttacattgatgttttaatcccttagtaaggtaagcacttataatccttatttttagatgaggcaactgagatgcagagagggtaaatatgaacttgtccaagttcatattgctagtacatctgggattctaatggcaatgtatggaaatggagaaggaataccagggcgtcgattttccattgcagttatcaagtgatttgccacccacgtctgtcccactcagaaaagcctattgcaatgcaagagaatgagcgtgataccattaaagggttgatcttggatctagtctaatttgtgaagaacattttataagtcactcaaccatcatgagtaacaaatcgctggggaagtggcttaggcctcccagccacatgccaggaagcctgtgtttggcaatgactgttgctctgtacagaatggctcaagtgttctattggaagcagttggaccttgtggctttcatgctgtcacccttgtattatttcttggtgtgtccaggtaaagctggagctccttagcccagccagaaaggcagctcatggtgcagcccctgcctgcctctctggactcatctcccctgcttccctgtttgcattgtggtttttgctttccgcctccagagatattggagactctgctgtattcactatgatctggttaagcatctcctccagaaagtcattccgagcctcttcactgttctctctacactgggtcaagagcctgtggtgttctcatgagctctttcttcagtatccatatgaaccactagaccaagagcacctgacggacaagttatttatcttcatgacacaaactgtactaatggaatgtttgtgaatgaaaatgtactttgatgaaccagaaccagatactctatttatttatttatttgtttgtttatttatttatttatgtgagatagggtcttgttcagttgtccaggctggagtgcagtggtgcagtctcagctcactgcagcctcaaactctcagggctcaggtgatcctcccacctcagcctcccaagcagttgggcccacaggagtgcaccaccatgcccagctaatgactgtattttttgtagacgtggggtttcgccatggtgcccaggctgtcatggcagccctaacagatgaatccagtggcatatgaaataactgctaagaaccatgtgatagctggatgggggtttgtctgtgcacatatgcacatacacacaagacatccacatgtgtgaaagagggtgttgcattccttaagagtagtatacttatttatgtattctgtgtaggatacttatttatatgagaaactctagcgcatgagaaaatgttgaacaagaatttaagaggattttctgtttaccctgagtttaactataaaattagagttcttccctaaatattattgttaatattatacatgttgttttttgctgtaaaatattcagagattatctaagtaattctgccactatctgtcatgatgtagtgactatgtgcatttctgttggacatttaatttctatttgataatttatttctgttcaatatgtatatttgtagaattatttctgagatatagatgttcattgctatccagaatattttatgtaataaactctatgttttctgtcataactatggttaggtactggtttagggataatcagccagttgccttgaccccaaagaacatcaagatttatttgccattgccactgtcatgtttctttaaagggaagagacggggaaaaaggaaagattggaaagagttgcgggaaggaaagcaaatgtcccttcagacatgtgattgtgccacataggaaggaacagaccctggtttgaatcccagccttactgtgtattgaccctgtgacctttgggagatgagttaatccttgcaccacattttccttggctgcaaagcacctcaatttgcaggttcctttgagggctgagattatatacataaagcatgtgggctagtctcctctggtgtatatatgcagaaagcattgtccccaatcttgaattgttagatattcatttaaggcaaacatttttgttttctttttccttactgaatgagagaagctggtaaggaaacggtgggatgtggccaggtgataggagcgcagacatagcagccattgatgcagacagagcttagagaaggcgtcatcaccacgcatcacactgagcaagtctgtgcggcccctgtgcccatgaggcttacagtgcagttggaaaagcagaccaaagggaataaacgtgaacaagataattgcaaaatatagtaagtactgtgaaacaaaccaatagattctgggagaaactaaaataagaaggagcaacttttagtggagacatccaggaggcgtctctgaagaggtgacagcaaataagttacgttttgggaagcagaggggagaagagggtattgggtaggtgaagaagcgcgacagcccatggtgtgtttgggtgatacaagtgagccaccattgtctgatggaaagggactggaaaagaaactggattgctgtaagaatgattttgaatgacattggggtttttctggtttgtttttgtttttgagatggagtttccctcagttgcgcaggctggagtgcagtggtgcggtcctagctcactgaagcctcaaattcctgggctgaagtgatcctcttgcctcagcctcctgagtagctgggactagaggcatgcgccaccacactcggcgaattttttatctttttgtagagataggttgtcactgtgttgccgaggcttgtcttcaactcctgccgtcaagcaatcctcctgccttcaagcaatcctcctgccttagcctctcaaagtgttgggattacaggcatgagccttacgcccagccaacataattttttttttttttttttgagatgaagtttcactctctgttgcccaggctggagtgcactggcatgatctcagctcacttcaacctccacctccagggatcaagcaattctcctgtcccagcctttcgagtagctgggattacatgtgtccgccaccatgcccggctaattattgtatttttagtagagacggggtttcaccatgttggccacgctggtcttgatctactaacctcaggtgatctgcccgcctcagcctcccaaagtgctgggaatacagatgtgagccaccatgccgggccaccactttttttgttgttactttattttacaatttttaaatacagttgtataaaatttgagccatgagtctgaccattctgagaaggcctacttttgtttctcctaagatgtgccatttaccgttttaaattgtcatcattggctaggggacctggctctccattagattagaggacaccatttgttcacatttgttgatgtcagactactaccaaacaaaaatttttgcccttgtgaccatctctttgactttccagatcaggataatcaaataaaatgataaatacaaataatgtataacatgtcacatatagtttatttactgcctaaggttgttattttgtgtttaaaatgattcttgctactgagtataaattctgtgtacccttttttgatgtcaatttttattatattaatgctaaggaatattagaatagtctggaatttgggaattgatagtagcaagctggaatttgggtatggaaaatgctgtgtaaaccagtagcaagaagtgccaatgcttggagtcaagccagggcccagatattcaagctctatttctttttcttttctttctttctttcttttttttttttttttaaataaattgagctttggaaacaccttcacatttgaaaatgactttgtgtttgttgattgttttctttcttgagtagagtatcatagtactttctttttttgttatttgttactgtgacagtatttcatatttttaacccaagacagttggctttccaaaaatactggaaacaaatgcatgatgtaatcatcctcacccgcgtccaaaattgtggtagatctccactttcactctgttatttatagtaatgcgttttttttgtgttaggactggtaagttgcctaagtagatccttgagaggcgggatagacattttttcccttgagtcatatagttaatttgctttcatttttcttgagtcctactgttaaatttttgaagtacaacagtttatgtccttggtctgtgcttgactgtggagtaatactagacaataaggcatcctttatttatattagctttggtatgttgtttttgcttttctcagatttctccagtcctaaagaaggttatgtacatttatctgtgtgtttacatacatggttatatggaaataattgctttcagatagttgtggttttcttttcattgtttcttctgaaatattcttgttaaacctgagaacaagtgaaaatgtttcatgaaaatgcattaaaatgcattgttaatatataacctaaaaactattggattggtttatttttagcatgaagaattttgaattcactggaatttaagttacagttgttgcagtttttatgtagacttggcagttatgtcacttatacttcttaattatctttgtacatattttatatgacataatatctgcacactcaccatctccagcctctgtagagaatgtaacacatagcaccaaagtaataaaaatataagccccagagcgggaagcaaagctgaaacaagccatttttacatataacttaagtttaggttctgtatagtaggttgatcccttacttaacctttaataaaattggattcaagggtatttatatgtaaataaaaaaataaagttaatttcgtttcatacttccctatgagcaagtgtctagtaatatattacaatgacatttaaacttcagtatttgtcctattggctgaaaaaattcccatacttttttagcaacagggtttgaggttagacattaaaaagggaaggttcttaagatgaatattaagattacgtgatcatatgcacagtgatgaaatcagtctgtatttgtttgacctcttgtctcctatgaaggtatctaagaagtcatttcctcctattacatattttagaaattaaaatttaataacgcttcataccctccaaacttctctgaaagggctctttagttgtacaggcatctagatcatggtcagactccttttctaagtaatgttatcaatagtgtatttgtatacgtggttatagatcaaaggttgaaatacgcttatcagtgcctcctgaagaggcagtcccctggagtcttcttatctcacctgatgagtgtggtcttttggtgctcatatcatgtatggaaggaggtggcagggatcaggagggcatatcccctttgcctctcattccctacccgacttcccagagaaagcagcattttcaaacttgcagaaatatgtgagggctctcagaactgcttaggatcagccatgtacattgtgaaaagtgagtcatggctttttctctgcaatagtgtagacgtttctactcttaaaaataaagatagattaaaatataacacctcaactccaagagctccaagcctcccacagaacatcgtagtcctgctacactcagttgaacatttatgccctggccctggcacccacctcccttagcctgcctgtgaaggcgtctctctgatgccctatctagacccgttcttccttttcctacatttgaactttttctgagatagtttcagtttccataatctctgtgtgatgattttcatcaagaattccgactaaggagattttattcttttaagaagatttgttcaacatatacttacatgagattttgttctttttaaagactgtgtaaataaattatctgattaagaaaaatttttctactttgttttgactcttgaatagggaaatgcttgcctatatttaaatgcaacctgctaaaaatacttgttctgacctattagtgaagtatatcacactatctaaagcaatctgtagatttaatgcactcgctatgaaaatctcgctgatgttttttgcagaaatagaaaatcccaccctaaagttcatatggaattgcaacagacctcaagtagtcaaaacaaccttgagaaagaacaaaactgaaggatttaacaattcctgatttcaaacttgctacagttccagtagtcaaaacagtgtggtactggcctaaaggcagatatattgaccaatggaatagaatagagaccccagaaataaatccttgcctaaatggtcaagtgattttttgacaagtgtgcccaaaccactcaatggggaaaagacagtcttgttaagaaatgatgaagtgaaaaactacataggcatatgcaaaagaatgaagttggacccttgcctaataacatatagaagaattaactcaaaatgaataaaaaacctaaatgtaagaactacaactataaaaattttaggggaaattgtaggataaaatcttcaagacgttggactttaagatgacttcttggctatgacaccaaaggcacagacaacaaaagaaaaaataggcaaattggacttcatgaaaatttaagaattttgtgcatcaaaagacaacatcaacacaatgaaaaggcaacccagagcaatatggccaatgagagttgcctagtgctcatccctcccccaaaaggggatctaaacaacaagtaaacaactatatttcaactagagtgacgaggaagtatgctggaccgcactaggggagcagcaaacttcctgtggtgcatggaaggccaggacagcaccatggacaggtgagcgaggcatcctgcctctgccacagtctcccccagtggagacttggcagtcatggggtgctgtttatggggaaatgtatgctggtgattcccagcagtccccattgccaccagaaatgctagcagtctttgatataggagtcccctaaacttcacaggcccccaatccagtttggagagtagccgggagctcacacagatgcaatgcctcagtgtccacattgaggacccgcaacctaagcagcttcaactctgtcccatcttgaacctttcccactgctagagtgcatcctgccctgcgcaccagtagcaattgactcttttcatcctggaggcctagctgtccttataccacattcacacaggtacctgcagcactatgaccatagctacccaaagcataggtcacatggaatgactgagaccccagtgttcaaacccaagtgacacaccacatccccccaccccccagggaacaggcagatctgtacggtgctgaagtcactgaacagtcagccaattacctctcctgcacgtacctgcaccatagccacctgtcccaccaagcgcggtgcatccatagctggtccaactgttggtcctgtggcagcctcgttcccgcatacagacacccaaagagcagctgaatgctgctattctatgtctagcctgacagctggtccagtagcagccctccctcccaaataactgcaaggctgcccaaccccatttcacactggcatccagcccaagagctgggccagtggtggacctgctcctctagacagactcctacagggccacctgacacagctgcacctatgtgcagctggcacagcatcagaccagtagactcttcatccatcctcttgaagagacagccacgtagctgctcagctagccacacccatatgcacctaagctcagcccaacagccagactagtggtggccccacctccctgaaaagcctgttggagagccttttcgccctccacacccatacatattcagcccaacagccagcccaacacccctactcccagcaaaaccacacactacgaccaccacaaatacctacagcataggccattgaggcaattgcagacattgctgatgaagattgcagctgaaaaaactacatgtagaccatgctactgagtccacccagaactaaagctaactcaccacactcaaatgacaccttgggacctatctacaggaagaattatctcctaatgaaagttacttcataaacctggaaagggtcactattccactagatgttcagatatcagcatagggacacaagcaatgtgaaaaagcaaggaaatgtgatacctgcaaaggaatacaataagtctttagtaaaagaccccaaagaaaaggacatttatgaaatgcctgaaaataagataatcttaaggaaactcatggagatacaagagaatacagcaaataattcagtgagatcaggaaaacaattcatcatccgaatgagaaatgcaacaaagataagtgtcataaagaaccaaacagaaatcttggagctgaggaattatgaatgaaataaaaagtgcaagtgaaagcttcaacaacagactagatcaggcagagtaatttctgaacttgaagacaggcctcttgaattatcccagtcagagggaaaaaaaaataagaattttaattgaagaaagcctgtgggactcatgcgataccattaaatgaacaaatgtgtgcattataggaacttcgtagggagaagagttggagaaagacacagaaaacctatgtaatgaaataatagatgaaaacttccctagtcttggcagaaatacggacataggaattcagcaagttcagaggtccccagttagattcagtcctctctgaggcacattataatcatactctcaaaagttaaagacagaattttaaaagccacaagaaaacagtgtcacatcacacacaagggaatgtccattagactactagtagatttctcagcagaaaccttgcaggttagaagagaatgggatgatatattcaaagtgctgaaagaaggggggcttgtggggaggaggaactgtcagccaagaatattatatccaacaaagttatccttcagaaatgaaggagaaataagaccttttcagacaagcaaaggctgagagaatttgtgaccagtaggttggccttataaggaatgcttaagggagtgctaccactggaaaagaaaggacaataattatcatgaaaacatgtgaaggtgtaaaactcactagtagaggtaaattcataaaatactctagtgatttaatggtcctatgtaaatctctcaatcctctagtatgaagacttagaagtcaaaaaggtcaaaaacaacaacaaccacacttagtggctacaaatatataataaataagtagattaaggcaacaaaaatattaattgtgtatggggttaagtctagaatattttcatgcaaccagatttaaattgctatcaggttgatgtagtctattgtaactacaagactcttatgttagccccatggtaaccacaaagaaagaaattacgacagaataataaacagtaaagagaaagaaaacaaaacttcgcagcacagaaaaccaccaaaccgcgaaggaaaataacatgagtaaaagaaaggggaaaaggatctacaaaacaagcagaaaacaacaatatggcaggaataaatttttattgatatgaccttgaatataaatggattaaagtctcaaatttaaaaacacagagtggtcgaacaggttttaaaaataagacccaactatctgctggctacaagaggctcacatcatcattaaagacaaacataaactgaaagtgaaggaatggaaaaacatattccatacaaacagaaaccaaaagtgagcaggagtagctataattgtatcagataagacagattttaagtcaaaaactggaaaaagaaaaaaggtcattatgtcatgattaaaggataaattcaataagagaatattgtaacaaatacatatgcactcaaccctgaaacatacagatgtacaaaacaaacatgattgcacataaaggtacagatcaactgcaatacaattataaaagggaagtttggcaaagaaatatcagactaaaactacatcaaagacctaatgcacctagcagatatttacagaacattttaacagctgcagaatacaaattcttctcaattacacatgaaacattctccaggatagagcacatgctaggccacaaaacaaatcttaacagatttgagatagagatcctatcaagtatcttttctaaccacagtggtatgaaactagaaaacaacaacatgagcaactttggatactttgaaatacgtggaaattaaacaacatggccctcaacaaccagtgggtcaattaaattaacagagaaatgaaaaattgctttgagacaaacaagaatgcaaacacatcttaccaaaacctgtgagacacagcgagagagcagttctaacagggaattttatagcaatacacagctacattagaaaagaagagagatttttaatgaacaacctaatgacgtaccacaaggaactagaaaaacaagaacaaactgaacccaaaattgatagaaggaaaggtagaataaggctcagagaagaaataaagacaaattaacattcaaaagatcaagaaaacgaagagttggtttttttgaaaagataagcaaaatcaacaaactttaagctagactaaaaaaaacaagactcaagtaaaatcagagatggaaaaggagatgttacaactgatactacagaaatacagaaaattatagagaatattatgagctgctatatgccaacaaatttgataatatggaagaaatagataagttcttggacatatacaaactactgagattcaattataaagaaattaaagatctgaacagactaataactagtgagacaattagttataaaaagtctttcctggatagagaaaatgtggcacatatacaccatgtggaatactgtgcagccataaaaaagaaagactttatgtcctttgcaggaacatggatgaagctggaaaccatcattttcagcaaactaacacaggaacagaaaatcaaacattgcatgttctcactgataagtgggagttgaacaatgagaacacatggacacacggaggggagcattacacactgggacctgtcggcgggtagggggtaagaggagggatagcattggagaaattcctaatgtagatgatgggttgatgggttcagcaaaccaccatgacacatgtatacctatgtaacaaacctgcactttctgcacatatatcccagaacttaaagtataataaaaaataaaaaaatttaaaaaaaatgtttcatcaaagaaaagcttaggacctgatggcttcactactgaattctacaaaacatttgaagaagaactaataacagttctcctcaaactattccagaaaattgataagtggggagtatttgtaaaattttatgaggccagcattaccctgatcctgaaaccagacaacgatacaacaacaacagcaaaactacaggtaagtatctgtaatgtgaacatagatgcagaaattcttaataagatattaacaaactgaatccagcagcacattaaaaagatcattcactgtgatcaagtattactcataccagtgttgcaagggtagtttaacgtatgcaagtcaataagtgtaatacatcacattaacaaaaagagacaaaaacaatatgatcatttcagtagatgcagaaaaagcatttgacatccttcaacattctttcataaaaactcaacaaattagttatggaaggtatgtaccttaacacagtaaatgtcatgtatgaaaaacccacagctgacatcatactgaatgaggaaaagctttcttttaatatatggaacaagacaaggatgccaacttctgctacttctgttcaacatagtactggaagtcctagcctaagccattagggaagagaaagatataaaaggcatccaaattggaaaagaggaagtcagattgtcctgtttgcagacatgatcttacatatagaaaaccgaatgggagaaaattttggcaaccttctcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcgttaaaaagtcaggaaacaacaggtgctggagaggatgtggaaaaataggaacacttttatactgttggtgggactgtaaactagttcaactattgtggaagtcagtgtggggattcctcagggatctagaactagaaataccatttgacccagccatcccattgctgggtatatacccaaaggactataaatcatgctgctataaagacacatgcacacgtatgtttattgcggcactattcacaatagcaaagacttggaaccaaccgaaatgtccaacaatgatagactggattaagaaaatgtggcacatatacaccatggaatagtatgcagccataaaaaatgatgagttcatgtcctttgtaggtacatggatgaaattggaaatcatcattctcagtaaactatcgcaaggacaaaaaaccaaacacctcatgttctcactcatagatgggaattgaacaatgagaacacatggacacgggaaggggaacatcacactctggggcctgttgtggggtgggggaaggggggagggatagcattaggagatacatctaatgctaaatgacgagttaatgggtgtaacacaccagcatggcacatgtatacatatgtaacctgcacattgtgcacatgtaccctaaaacttaaagtataattaaaaaaaaaaaaccaaaggactctactaaagaactggtagaactaataaatgaattcagtagttatgggatacaaaatcagcatacaagaatcagtagtctttctatatattaaccattattaatattggttcattaactatctgaaaaagaaatcaagaaaacagctccatttacgatagcttaaaaaaaaaaagataatagaaacaaaaccaaattgaaagctctctatattgaaactctaaaactttaacaaaagaaattgaagaggacacaaataaatggcaagctactttgtcttcatggtttggaagaattaatatagttaagatggccatattacctaaaataatctacagatttgatgcaattcctatcaaaatactaatgacattctttacacagatagaaaaaaaaatcctaaaattcatatggaaccacaaaaggacccaaatagccaaagcaaccctgagcaaaaagaaaaacctgcaggtatcacaccaaccaagttcaaaatgtacagttgactcctaaagaacttagatttaaactgtgcaggctcacttttatgtagattttcttctgcttctgccacccctgaaacagcaagacaaatccctcaacaggaagcctactcaccaggaagacaatgaggatgaagacctttataatactccacatccacttaataaataataaatatatttactcttccttatgtttttcttaatgacattttctctagctttattgtaagaatatagtatataatgtatgtaacagacaaaatatgttaattgactatgttatccgtaaggtttctgatcaatagtaggctattaatagttttttgggggaagtcaaaagttgttcaagggtcactgctactacaaagttatgggaacctaaacatgttactggctttaaaaacagacgcataaaccagtggaacagaatagagagccgacaaataaatttacatacctatagccaactaatttttcataatggtggcaagaacacacattaaggaaaagacaaatctctttagtaaatggtgctgggaaaattggatatcaacatgcaaaagaatgagtctagacctctacctcttaccaaaaaaaagaaaaatcaaaacagattaaaatgtaaatgtaaaacccaaaactatgcaactactggaagaaaacagagaggaaacttttcacagcattgacctggagaagggttttttaaacaagacttcaaaagcagcaggcaacaaaagcaaaactagacaaacaagattacatcaaattataaagcttttgcacagcaaaggaagctattgacggagtgaagaggcacctaaagaatgagagtaaatatttacaaagtatgtatctggcaagaggttaatattcagaacataaaaggatcataacagcaaaaaaaaaaaaaacctgattaagaaaatgggcaaactaccttaatagacatgtgtccaaagcagacatacagatggccaacatgtatatgaaaaaatgctcaacatcagtaatcatcaagaaagtgcaaatcagaaccacgataaaataccacctcactccagttagcatggctattgttaaaaagagaaaataagggttggcaaggatgtggagaaagggaaacacattgttggtgggattgtaaattaaccattatggaaaagagtatggagatccttcaaaaaattaaaaataggactaccatacaatccagccattccattactaggtatatatccaaaagaaattactatgttgaagagaaaacttcaactcccatgtttattgcagcactgtttacaataactaagatacgtaatcaacctaagtgcccattaatgcaagaatgaatacagaaaatgtatatatacataatggaatattattcagccatgaaagtatgaaatcttctcatttgccacaattggatgaacctgaaagaagtcatgttttgtgaaataatccagacacagaaagacacataacacatgatcccactcatatgagatctttttttcttaacaacaacaaaaacagagttggtatccttgaaacaggaagtagaatagtggttaccagagactgggaggggcgggaagagatggaagggtgcagagatgttggccagtgggtacatagttacatttagacagtaggaataaattttgatgttctgttacacagtagagtgactgtaattaacagtgaaatattgtatattaggaaacagctagaagagaggctttcaaatgttcccaccacaaagaaatacgtgcatgaggtgatgaatactagccacccagattggataattatatagcatagataggtatcaaaacatcaaattgtacccccataagtatgtataattccactgtgtcaattaaaattttttctaaaattttctaaaattattttttctaaaaagaccacccacggaatgagagaaaatatttgtaaattgtatatctgataaaggattaaaatttagagtatatagagaactaaaactcaacagcagcaacaataaaaaacacaacccagttgaaaaatggcaagggacttgaataactttttcccaaggaaggtacataaatggccaataagcacatgaaaaaatgttcaacatctctagtcattacggaagtgcaagtgaaaactacaatgctatataatttcatatccattagggtggttactataaaaaatttacaagtattaaaaagatgaggttgggaacccttgagcactgttggtggaaatggaaaattgtatgacagtttctcgaaaaattaaaactaccatacgacccagcagtttcacttctgagtatattcccgaaataattgaaaatggtctcaaaaagatatgtgtacagccatatttatagcagcattgttcacagtagctaaaatgtgaatgcagcacacgtgtacatcaacagatgaatggataagcaaaatatggtgtttacatttggcccttcgtatccacagagtctgcattcatggattcaaccaaccacagatcaaaaacatttgggctgggtgtggtggtgtgtgcctataatcccagctactcaggagactgaggtaggaggattgcttgagccaagaagtccaccaccagcctgtgcaacagagacagcatctctcaaaaaaggatcagccaataaataaatacaatgtgtgggggctggatgcagtggctcactcctgtaatcccagcactttgggaggccgaggtgggctgatcatttgaggtcaggagttcaagaccagcttggccaacatggtgaaaccccatctctactaaaaaatacaaaaattagctgagtgtggtggcactcgcctgtagtctcagctacttaggaggctgaggcaggaaaatcgtttgaactgggaagcagatgttgcagtgagctgagatcacgcctctgcactccagcctgtgtgacagagcgagactctgtctcaaaaaaataaataaaatgcatggggaaaaaaaacaaaaatagcagaacaacaattttaaagatacatattttaaaatatagtataaaatcatttatgtcacatttacattgtattataaataatgtagagattatttaaaacatacagaggatgtgtataggttatatgaaaatttacactattttatatgagagacttgagcatccgtggatttttgacatccacaggggtcctggaacctgtcccccatggatactgagagatgactgtatatacagtggaatattagcctttaaaagcaagttaattttgacatatgctacaacatggatgaaccttgaggaaattatatgaagtgaaataagccagtccaaaagaaaaaatgctgtgttattccatgtatatgagatacttagaacagtcaaaatcacagagataagcggaatggtggttgccaagagataagggaaaggagaaatggggagttattgttgcatggttttagaattaaggttttacaagatgaaaaaaagtcatggaggcagatggtacagtggtgtttgcacaaaattacaaatgtattaatatcaccaaaccatacccttaaaaatcatgaaaatgataaattttatcctatgtgtattttaatgcaaataaaaagtgggggaaaaattaaccagtcaactaacaaaagcagagtattttatttttttaaaaataaccaatttaaagtagaaccaaaaaaactaatcaaaaagaaaagaaagtgtattcacctaatgcattaccccactagggtgttttaatttaaaaataaaatttctgcaggtaatagggctttcagcccaaagggaatgattctgatgacagaattctgggccctgtgagggaggtgagtgacttgtttttgtgtataactccccagtgctcctaaatcatctcacattattgattataccaacaatattcaataccttttgaaaggagggagaaaatctgttaagtgtcatgtactggaaagaccaaggcctctgaaagagccagataaattggtttttaaatacctgcctggctgcctactagtcacatgaccttgagtatgaatcctaaacccccaaaatggtagttgctgcttcttaattttaagatgagatcataataatgccttccatgcaagattattgtgacaccctggaataatgtatgcaaagctcctgaaatgacacctggtacatggtacatgtataacaaataaaaaccaatattattatgataatgatgattctccagttggtaggtttttatcctttgtagaacttgtgatagtatctaaaaattcagatttctttttcagtactcaaaatagatttaattttttcttttatttaaaattttaaagttctaatgttaaaaattttatccttgtgaaagaaaagggattttcttttagagtgtggtccttcgaccagaaacaccatcatccactaagaacttgttagaaatgcaaacactagggcttcacccaagacctatgaaactaaaaactctgaaagttgtagtcactctgtaaaaaatattctgatgcacactcaagtttgagaacgcctgcttcaataaatctgggaaacagaaaagggtagcatttatgatctgtcatccaaaaataaccactttaaattctgagatttttttccagtcttttctctgttcatatgcatatacacttatatgtgtatttcttctagtctttttcctatacacctgtgtatatatttatggtgttttaaaaagttaagatcatgctgtataagttttacagccttcattttgaccttcaatattatgtcatgaccattgccccatgtcattaaattttatttgaaaacatttttaatcatatggctacatattataccatgctctgagtgtctcataattatgaaccaaccccctagacatctgagttgtttctagttgttcagaaggacataagcaacactcagttgaaaatctgtattcataaatcattgttaatatgagtgattatttcctccgcataaatttattactagggtggaattaccaggtcaaacagtatgaacatttttacaactcttaatagaaatcgccagattgcttttcagagaagaggtgccagtttggattctaaccagcaatgtagggaaaatgtttgtccattcctctaacacaaccaacgctgctgtattagtctgttctcgcactgctataaagaaatgccttagactgggtaatttataaagaacagaggtttaattggctcagagttctgcatggcgtataggaagcatgatgctggcatctgctcggcttctggggaggcctcaggaaacttaaaatcatggcagaaggcaaagggggagtgagatgactcacatggtgggagcaggagcaagaaaggaagtagggaggtgccccacacttttaaacaactagattttgtgattactcgctgtcactagaacagcaccagagggatgttgctaaatcattcatgaaggattactcttatgatcctgccacctcacaccaggcctccctccgacattgaggtttgcagttcgatctgtgacttgggcagggttgcagatccaaacgatatcattctgcccctggcccctccaaatcttgtattcttcttacattgcaaaatataatcatgccttcccaactgtcccccaaagtcttaactcattccagcattaactcaaaagtccaaagtctcacctcagacaaggctggtcccttccacctgtgaacctataaaataaaaaataagtttgttactttcaagatagagtggaggtataggcattgggtaaatactcctgttccagtagggagaaattggccaaaagaaaggggctacagctcccatggaagttcaaaacccagcacggcagtcattaaatcttaagacatcaaaattatctcccttgactccgtgttccacatttagggcactctaattcaagagatggccttccaaagccctggatggctccctgtggccttgcagtgtttagctcctgtgactgctctattgggctggcgttgagtgcctgcagcttttcccggtgcagggttcagcctgtcagtggatctaccattctctggtctagaggttggtggtcctccactgatagccccagtaaggcggttcctcagtggagactgtgtgtctgggctccaaccccatatttctccttcacactgccctagtagaggttctccatgagggctctgcccctgcagcaggcttctgcctggacatccaggcttttccctacattctctgaaatctaggcagaggcttcccgtcttcaattctttcactctgggatttgcccaagtcagtgaatagttcttgagatcaggagccagatccaccagagttttgtccattatgtcctaacattacctgagcaataaaaaggaaatctggcaaggaaaaacaagattgcctcccacatttagaagaatgattgagaaatcctaaatgaatgccaggtttaaaacataaattatttacttaacagccatttcaacttgcaacataaggcaaccttggaggtgactgttgaggatggcactgttctgttgctggttaattatatttataagcaactgagagcttcttctatcccttcttaacctggaccacagatatcaaatggccaagaagagcatcagatggaagcaatgtaaaatgctatttttcttcattggcataaggacttctgggcctcttcacaccagcacacacttaaatcaggtgctgcttgtgttggaactatttggtagggtggtggttttctctttttaaatctttttgtgtgtgtgtgtgtgtgtaagttgtactatcttccccgactagatccgaagagtagccgtttattttagtatgtatcttaaagcagcaatgcaatgcatgcattaaatgtacagaatgcctcttttaaaaatgtgttgctggaaaggccaagcagacagttgccggaatgacagtgtggccttgcgttccccacagaataaatttgagagctgtcatgagacatcccagcttacattgcgttgatgatgtacagaaagaaaagcaacttcagacctagattctcattccacttaggtttttagaccgtcatctattacgcagacagaagagaatgggccacaagcgtgatgttcactgcaataggctatacttaaattaaaggatactgttttgtaccaattagtgtgcaccatgtgcttttaatttgtttttgaccattccctttcaatgtactttaatcttttttaattatgagaataatccatactgttaacatggaattctccaaatcggtaattaatgtttatcctttgctctgccagttcaacctcctgccctaccttaatttgagaaaaccaacattaatatttcccttatttgagaaaatcaaccttaaaaacttaatattatccttttcttcttttacacataaacatttagtcatatacatatatggatttctactgtattttttcaaaaattggttgatagcaagcttggtagatcctcattgttttaattatagttacagacctccctccaggtcagtgcatacaaataactctgttttaataactgaatagcatttcacagtatggctatagcacattattctgcttatcacctggtaatgaaatttccggttgtttacaatgtttagttactgccgacactgtctattacaatatgagcattttataggccttctgatcattttccactcagtaaagtgtgttcctaaagaagtgaaaaagtaggaactttccagagtcggccacttgtctgtaatcatgcactgctataattagtagcctagcacatgataatgagaattatggagacttatgtgtagaatctttgtctatgtgggagagtccctaaatgtagcttttattttgtatcggagtcatttgtggttagcttccatgtgaggattcgccgcagagaagaggtgatctttcagctgttattatgtcccatctcgatcctttctgagcaaatcaattgcttggttttggagaaatctagtatagtaatgatgggctatacccaatcagccacttttttttagttttaccttgttagaccacaatcttagatatttatgagtgaatgagagagcgtggcttttggagtgcattaattttaaaaagctctctgtggtactattttgaaattaggaagggagggaatgctactttgatgacgtgaaaaatttgcccagatcgcctcgattgcttactatgtgataaatggtgccgctagccacatgtttcaggattttgaatactcaggaagaattcttagagtgtgattatggaaacaaccaatttccataagtgaaaatgagcatgcttattaatggggctgcaattgtctattgcattcagtcacatttataaccagcaaggagaatgagtgttttgcatgatttaatgtttacacaattgcagttgcatggcaaagcttgctgtactagaggctttggaaagaagcatatgtggtcgttttgcaggtaataaaatggaaaatccaatttgcaattgcagaataagcctctgagtgatatacgatcttcatagcagcatcggtcagagggtcactgctaatcacggcgctgcctggcttccccagtggcctgcgccttccaactgaggagtgagcaaagtgaatctgtgtctgggagccagccagcgtgtctgtagatgcaccactttctagcttattagatcctctttgtcacagtgcttaatcctgctgcctgatccttgttagaacaccaccagagcgccgctcagccttctaataaaggggatgggtgagggctcctaactcaacgcactgaagcgtgtggcgtcagagcgattgcaggctgactgacagcggggtgagatgcttcctgcatgttattacttaaaagggaacctacctccgacagctgacagacgagctctgccgaggcaatggtaacttgttgctaggccaatatgagtcgggtgtcatcttttcacacaatataatggccagctttactctaattatattaaccctcttctgaaattgcttcatccccaactggtgcagagtgaggcaagagaacccagagacaaatcgcttgctgggagggttgcagcgctacagaaacaggtattgtgttatccaccggtgacattaagttgaaaaacaaaacaagcatgccctattacagcaagtcccagttctaactccaaagagacattgctctgtttcgctcgcgcggtttccatttctgtcatttataatagtttcctcctttaaggtttgccacggacattatacctgggtttcatggctctttgttaaaaagaaagaccaacatcatacaagaagcttttttcttttcttttttttccccagggaaccctaatcattcttttctattaggctcttaagttcatgtagctttaggaagcacttggggatttaatttagtagcattgcttgatactgaagtaagtaaatgagggtggggagggtaacccagtcatctgtaccctccttgccactccccatcccagctaaaatatgcagatgggttggaagtgatataagtgaagatgatcgtgaatagcctgtggtcctttctgttaactctgacttgtagacatcagcgtgtgactccttttcccttaagggagtatgtctagcttgcatccagcgtctcctgtgtgctccagttagcagccatcattagcaatctgtgatgcctctgccgtctccactgacagcacctaaatagagacatcacttgggattgacagatctccagggggttacaggcttcagacaaaagggcccagagaacatggctgacctttcttggcattattctccttccatgagtggcagtcagggagcatagaactttagtacattattttcagaggattaccactgaaaagactgcacacttagtaagatgctgttaataagttaacaagaggctgtgtgcgttccagagtggttttgcaggccgtcagtagtagaacacgagtgcttctttcccgcagaaatacgtccctattccttaagttcaaggaggggtctttaaaaccagctttactcataacataccttcagtttcggatgatcgagcaaggcttgggactcggcggaagggagcttgtgatgcaggctagaaaagaggagtctcttcccctcattatcccaagcaagtcttcccagggaaaatttgaaatagctgagacttgtgtgtgtcatccttcccggatcctttccctgctccacgttgttctcatgcttgccaagggccctgaaaatacagtgtggtgagaaatgctgctctgtgcccaaatgtagctgacttccctcctcttctccctcttcccaaagtaaaaaaaaaaaaaaaaaaaaaaaaaaaaaaaaggtgtgttcctgcaatcacccctctgaaccagatgttaaaagcaaagcagttgtgtaaatgattgaaaatcctggacgcttcttcaacagagtaaaattctaccaactagaagttccgactatatttctcattaggataaccaattttgcagaagaaggaaagatatttaggggaaaatactcactaactagaaaatccccttagcttaggaattcatttctgtgctattccataaatatgtagtttatacttttcatggcttctgctgcttttttttcatctactttgcaatacacatattttttctttttctttttttttttttaagacagtcttgctctgttacccaggctggagtgcagtggtgccatttcggctcactgcaacctccgcctcccaggttcatgcagttctcctgcctcagcctcccaagaggctgggactacaggtgcgcaccactgtgcctggctaatttttgtatttttagcagagactgggttttgccatgttggccaaattgccttgtggtctggaactcctgacctcaagtgatccacccgccttggcctcccaaagtgctggcattataggcatcagccaccactcctggccaagaatacacatattttttccaaacacctcaagtttatttttttcatagttgattcatgctgatgtctgtgggcagagattagaggcatgaagatgacaagatgtaagcataggttgtttctcaggtgaatgttttaagagagatatattgagctgcagcactaccattcccagctgatgagggcattgctgcaccgtggtcactgttgtccagtttgtaaccccttcccttactagtcctgcctcctgtgcacaatgggcaacataccatcgtgcacataaaatacgacacatcagaaatagacttgtttttaaagggatggcttctttccaggaatgtatattatattcatttttaggaaaaggaaaaattagagaaaaaaaccatgaaggaattatatggaagacaagataaattgagtgcagcaaactagattttaagaggaaataagaattatagagaaatgtaaacaaggggtcagtttcattcttgggactctaaaaaccccctccctaagtaaagataaaaacaaagatcaatggcagccccttgccaacaagatgaaacccaggtgagatactcagctaagcagaatgcataccacccctgggttttcattcgccctaggcagctttctgactcatggtttagagaatcaagctcactaatttcccaagtgacttaatatctgactaacgatgtttaaccattaagatgaggaaattgacaatattgataatcttggagagaaatggatctgcttatttttgtaccaagcgccaacaaattcttagtagctttggaaacatgatgaattactctctcttgatatttagtagtgtgtattttcttaaaaagattttgtgaaattgtagtcgtttttcttttgtttttctgaatagttgcaagttcatagaacaaaaaggaaagattcaaagtatctattattttgttttaacaagcaatattgcattatcttcctcataaaaaaattcatttatcctttcatttccaaagctcagatcagctaggcaatgatttgctttgtacttgcgtcccaggatatgttttcattgtcctgagttaccatctatgaaaacataggcagtagaacctgggaacagcaacagcacgtaacttcggttgtgtcttagcaaaaatctttgctgtgtctctaggttcaaacagtaccaggccatggatgagaagtgtgaaaattgatttcctcagtaggacttttagggacagaccttcacatatatccctgctgcctaacttctctttctctgcttcttgctttcataggcgagcgcattttaggaagttctttcacactttgccttttccatttttgaatatatcaaaaagaaaaaaaaacagtcaactggtcattaacagaggatatccagatgaggggtgcttgctggcttttttatgctaccttcattaaatcaaccttatctaaattgatatgtaacctgatggcctcaccagacactgtagaaggtgtatgagattgagcatcagcttgaaatcttcatgctggctttttctgatcttgggcatattagttaatttccttaagtttccatttcttcacctataaagtaatattagtatctgaccttccagattgctggagaatgaaatgaggaatgattttaaaaggtaattagtctttatcactgccatgttaatgagattcatttagggctgattccgagatgtgcttatgctcttatacttgagtaacaacggtttggcttgggtaatattcctgtctttctccattcatacgctgtcttgattggtgaaaaaagtggtgttgatcagattgggcccagatcagccaggacaaggcatgatgcatactgacatggtcaagatagaattttaaatggttttcatattatcacttctcttaattttgaacaagtcatttttgtctctgcagcaaatacctccttccctctgctctgctttccttttccatctgtcttctttcttccttcctttgttcttaatttctggggccaaggtactgtcatgactgtgtacctgtgatgacttgggttaagaaatttaaaagacatcaaatgatccaagaggcacttagggtttgatttagggtacttaggctgtgattactgagaaggacttcttagacctgatctgtattggatgaagtgaccttcactttttttttccccccccccaggaaacttggatttaactggccagaagcaggtattcaaagcagagaacaatccctgggtgacccccattgcagaccagttccagcttggcgtgtcccatgtttttgagtatatccgttctgagacatacaaatagtaagtagactctgattttctgaaatagtagactgtgattttatagtatttataattacgcctttaaaaatattatgtgacagtatcctattgatggcagttagcacttagcattttaagatgttttattaaaaactgcatgtcggccaggtgtggtgtggctcacagctgtaatcctagcatttggggaagtcgagactagaggattgcttgagcccaggagtttgagaccagcctgggcaacatagcaagaccccgtctctacaaaagaaaaagaaaaagaaattatccaggcatggtagtgcatgcttgtcattgtagctattctggaggctgagttgggaggatcacttgagcccaggacattgaggctgcacagagtcgtggtcatgccctgcactcgagcctggatgagagagcacgaccctttctcaaaagaaaaaaacaagaaaaaacagcatgtggtcattgtctctatttgtaaattgttttttattgatattttcaaggggatttttactgattttctttagagaatttttgaggtattaaattagttgaatattcatggcactaaggaaattcaccattcagatcagaacatattttttttcttctgtgaatgcaaagaattacaagtgttctgaacaaaattgttaagcagtttatttataaaatcagtagagagtactagcaatgcgtcattctattatagagaagcttgtactgtagtgagatgataatctcttagagaaaaggggaaggcaggagaggaagcggaatctgccagcttaaagtcacagcatccaaatacctcaagtcctcactccaggtgaaaggagtctatgcaaaactgtcccaaaaacctcacgattcctgcttctttcttcctccatgtgtcaaggttgaaaggaattctgccacttccacgtgcttctgttgttatatgtaccgtcattattttcctaccttatcccagcccccagctgcaaaacaaactgtcatttatcaaatacttgcctgaccccaaatgctgagatctagtataattttaagcatatacaaaaaagacaaaaacatccctactcaaatgtaatctgtttttgtgtctgacatcaacttttaaaatttattttttaattaattaattaattttttttaagagacagggtctcactgtattgctgggctggagtgcagtggcacaatcacggctcactgcagcctcaagcgcctgggctgaggcaatccttccatttcagccttccaagtagctgggactacaggagcacaccaccatgcccagctaatttttttaattttttgcagagacggggtctccctttgttgcccaggctggtctcaaactcctggtgtcaagcaatcctgctttcatcttccaaagtgctgggattacagtcatgagccaccatgcccagcctggcaccaacttttgagaatctaacatcccaactattggaagaaagctagaagattgctaaaggtcacatttagttaagagtttcttttcttttttttttttttggtatcagaaatatgtcccacactcaagaaaaccctgtgaatctgtgccaggccagtgggtcgggattgattggcagggcagagcctctgcccagaagtggctggctgcatttctgcagtcttgcagcctgagcgccatgctcctggtcaaacatttagcacttgctgtggccatgtttccaccagacagaaacagagaagacaagctgtaaagaataatggccagccggagcatggtggctcacgcctgcaaccccaacactttgggaaggcaaggcgggtggatcacttgaggtcaggagtttgagatcagcctggccaacatggtgaaactaaaaacacaaaaattagctgggcatggtggaggggcacctgtaatcctagctattcaggaggctgaggcacaagaatcgcttgagccagggaggcagaggttgcagtgagctgagatcgtgccactgcactccagcctgggcgacagagcaatattccatcccaaaaaaaagaaaaaagaacaatggccttaaaatgaaatacactaaaattgccaaaatgataccgtatcctcctatataaaagcaatgtaaagcgtggtttagattactttagacaatactatgacacttacagtataagtctaaagacttaccttaaggataaaatgagataggtataggatgtgtattaattgtttcataagccatatagatatgtacagttattacagattcaattttttttaaaaaaatacgaatgtagctcacccttagaaattagttaattatgaaaatgtgtgaaaatatagtcacaaattagcagatgattgtttatcttcttctttgtaaattgttaatcattgctatcgtgagttttagatggggctctaattttttcttagtaaacaggaagctatttagagcttggtttgtatggtatcttgaaaaaagtcattctgtatatgatagtatacagaaaaatgcatgaacaaactcctagccatctggaattagaggaaattctctgtttattattctggttaacaatttttagttttccatagatcactttataatttatagaggatgagaatacattgcatatgaaagtgcttttaattttaaaagattaaattgtgagtttctggattttgtattacctcaaagtaattattaggcaattaatcaccattctgcactgttacagactattttaactgatttgaatgtggttaggattctggataaatgagaggtatctataacataattggtatatctgtttttatgtctgttattagcatcctattttggggggttggcgtagtctaagcaatgtgtctgctaactttttctgtttcatttcctcatggagccttggattaccttttatgcagttaagtcaacattaaaaagtttcagtaggctgggtgcggtggctcacgcctatgatcccagcactttggggtgaattgtggggtgattcaccatgaggagggtgaatcacttgaggccaggagttcaagaccagcctttccaacatggtgaaaccccatttctactcaaaatacaaaaattagccgagtgtggtggtgggtgcctgtaatcccagctacttgggaggctgaggcaggagaatcgcttgaacctgagaggtggaggttgcagtgagttgagatagatggcgccactgcactccagcctgggtgacatagtgaaactgtgtttcaaacaaaaaaaaaaaaaaaaaaaaaaaaaagaagcagcagcttcagtaagcaccggagagccattgcctcctttccacggggaccagctggttccataacagctgcttttaggggcatctacatgatgctctgctgggaggtcacaaggtacatgagctatgctagggcaggggcctgctgtgagttctcttctgtcctccttgggaaggagaagaaggttggttactttgtgtatttcagtttttttgtccttctgtcattctcctgtagcagctgtcgtcacccctttgtcaaacatactagcccaaaatatggactgttagctgataagacaataagtcaaactcttaatcattaaaaaaaaaaaaaaaactgcacaaaaatgccgctattgtgtttcaccagattaacacaaactgattttcaaaattaagggcctcctttatatgaatagatctgtattatattaagtatatcctcatacaattagaacccaactcaactctttgtgtgaagcagccatttcataattaggggatttttagtatcctatctgaaaaatattatgcgaattagcaggtatttggctactttttaaaaacgttttacatgtggcagccttcaggggaggcagtttattcatgatactcatagtttttttaaaaaagcaaatttcacattcattgccttagtttttgatcttctagtctaaaacttattatagttcctaattttcacttctttgtctctgttgtttaagccgcatacttcccctttattaaaaagaatccttacttatatatttatcagtgtctgtgtgttgcggatgtgtatttgtctatctttaaactaccatgaaaacatacttttggttttggcacttaaaacgcctatgaacctcctcctccttcccccaccccaaccgcttttttctaaccagttaacccattacctaaatgagaggaataaagaactaaaaaacttaccggaatgttttcttttcattcatgtctatgatcggcgttcacagtgaccttcctcagagcacgtcctcaagttcttctgagtctagggcagagaggatggatgatctgatttataggctctaatggactccaagaggagacatggatacttgaaagaaaacaatgaattcagtgtgtcaacagaattaaaatacttggagatgacttagcttcatgaagatgggaacttgttccattaagcaggaggggtgtggctggtaggatggtgaggtatagttcttcagagattgctctttggagtaacattctgggcattaatcacggccccttcatcatgtctcaggtggaagctgctgtctcttcatctttcgtgccttccacaggggaacttgttggctgatgtcactgagttgccggttaacatgaaattatgagcttggttgggtcgttgaagcttacatcctacatgctccactgtgtttttaaactgtcgctgagttatacaattacctgttaactctttatttgatggtggttgtctcttcgacctcttttatttctttgaagcagaattatgatggaatactcatcacttaagtttccagaaggtagatttttttcccccaggagaggcagtcaagttgaagtcagcacccttgacaagattctttgtgaaagggggtaactcacactttgcacatttccatcaaggaacgtggataccaactgcaagccattttaaaagctgacaagttaactcttgtcaacaagttaacaaaagaggtttgacaaatgttaggctggaaatgcttcccttgaaagaggtatttggcaaacaggcgtcatcatgaaaactgcaatttgccaagcatggcagtcctaaagcctcatttccagcatggcatcactcacaggatgcttcctcgtcattctgcctgtctttttcacctttcttttctctctccggaaaagttccccactcatttgtgttttgtgtgttccgtttttttaaccttaaatgaaagaccagccatactattattcatattagttaacaaaaacattttaacaaagcagtctttggtgaatggtgggaaaccatgagataaaagctgagaattcctctttattagaaatctagccaaataaatcatcctgtttgatttataaggaaacattcttttggctgttggttattgtttttcacattgttttacttgtggaattaaagctaattaatgttttatttttcttctgcatgctgtgcaaacctgttacaagctgtaatggacgtacatgggctttattaaacaactactatatcctctagtgactgctgagtcagtggcctagaaattctttaaataacttcactgatacaaccagtccaccacaaggctagggcatttcaaacctaataggtgagcccattcattttaaaacagcccttcactgtaggaaattatctctaagaaaaacttaataaacatctgatgaagtataaatgggtgcacagagctagcaggtgattttataaatatcttcacaaagatggaggagagggttaaatttccaggatctttctagtggttagtaaattgaacatagtgacaatcagtatgtagaacaatgtagactcttctttttcattgctgtatctgaaaatagctcaaattaagccacagaaaaacaatttctgtgtagtagacatgaaaatgaagaactgtttttctttaaagctttttttttttttccttagggacacagtatcactttgtcacccaggctgcagtgcaggggcaccatgatagctcactgcagccttgatctccagggctcaagcaatccccctgcctcagcttccctagtacctgggactacaggcacacaccacaacgcctggctagttttctattttatttttttgtggagactgggggtcttgctatgttgcccaagctactctcaaacccctggcctcaagagattttcctgcctcagcctttcaaagcgctgagattacaggcacgcaccacggcacctggcttttaacataaaggtagtttttacattttacaagttgactatgtattctcttcctggtgatatatattttcttcataaatggtacatatttgtattattttttctttttttgagacggagtctcgctctgtcgccgaagctggactgcagtggcgtgatctgggctcactgcaagctccgccttccgggttcacgccattctcctgcctcagcctcccgagtggctgggactgcaggcgctcgctaccacatctggctgattttttgtattttttttagtagagacagggtttcgccttgttggccaggatggtcttgatctcctgacctcgtgacccgtccgcctcggcctcccaaagtgctgggattacaggcctgagccaccactactggcctatattttcttttttaaagttgaaaatgcattatcacattttatccataatatgtgattcaaagttttggcatctgtggacctatttgcaagaaaatatgttgcatttaaccagtattgctaaaaagtatcagagaaaagggaaacccatataatatatttggggtatattgtgtcacatctcttatttcatgttaacttcaatgataaaattaggtagcatcacattttaaaacacaaaaaactccagaatgtttattctactgaataaaagtaagccaatatgtaatactaacttttgaaggctgggtgcagtggctcatgcctgtaattccagtactttgggaaggcgaggcaggaggatcacttgagcccagggagttcaagaccagcctgggcaacatagtgagacttcgtctgtacagaaaatgaaaaaaaattagccgggcatggtggcacatgcctgtagtctcagctacttgggtggctgaggtgggaggatgccttgagcccagaaggtcaaggttgcaatgagccaagatcacaccactgaactccagcttcagtgatagagtgagaccctatctcaaaataataataataataataatttgattttttgtttaattgctcaactgttcctgtatgtgatcatgaggtatcagttaccctgctaaattgatacctccctctttaatatgacaggaggaatacagaggatgtaaggaagaatacgtaagttcttactctcttccaaatgttgtgatagattgcttagtgtattttgcatttaaaggatttttttttctgccttgtaacttggttaacactattattcatatatacttcacaggtaactagtatttttcccttttttgcattttcataatttattcaatatatgatgttttcacaggcttttgaggctttacttttctgtaattttatagctcatgcaaaatggttcagttttttaaatggaaggtgcttgttcccatttgatatttccaggacacttggattctgtgagttaagttgggaacttccatcccctaatcctatgaaggtcaaaggtgaaactctactagggcttaaaaaccagcttcaggagactagctgtattcctgaagacatctagtaagactccattgtatacgtgtcctactctggagtgtttttcactgtgatatgcaatagatgcaaataaagacttggaaaatgtaccctcccatatccacgttgctttcttcactacttccctctggtcctctaatgtggttaatcctccagcactctgtgcttgcctgggagctctgactgggacctggtaggctcaggtttgaccagtgagaaaaaaccctatgctccttgccttttttactcaatgcaatttgcattttattcaatgactagtgtacttatctttgaagagttgtggataactattagaggggcataggggaaaaaaactacagctgcaacatcaaagggagaagagagatttatcctgaaccttgcactacaaaaggcttttccgtaggactttaaagagtaaaactatctcagtctctctctgtgtgtgtctctctcctcctattccagtcccctctttcccctgttcccttctccatccccctcacttgattgttgactatcaagcctgcatttggcatgccttatacagctcctaaagtggagcatgatacattacagtatcaatttaaggtaaatagaatatagataatttgtctcacttgacagaaggaaaataaatatcagctagactccatccatactccaaaaaacccataatgtgtcaggttacattctcttcaagaggagctattctgagctccttttttttggatgctattcatttgatataatcatattgaactattggatattgacctcactgaagtgaaattggtcacctctacatattgattattaactcccaggagtcttaaaagttcaatgcttgatgctttctattcagctgagatgaattattgcctgcatttgctgtttttatttgagagataaatttaaaagtggcgcttttataatcaaacaaaactgtttgtggtttctaatctctacacagtaataacttgttttattacatgctggttttttattgaactctggtttcttatcctggccaggcattgttggaggttttgtggggttttttaaatttttaattttgggcatttaaggattcttctgtgttgtcagttattttagattaaaatgcaaaatgctatgaaaggagtttcaatcaactttatcagataaaaaacttaaatgtgagttatgttcacaggcatttatccatgcctcaatgtattcatcaagcattaaggaaataactttccatattttgttctactgtgtttgcatattatttgtttataagactcttgatattttttaaaatgtagtcaagaataaaatattattttccactttaatagttctctctgggacgcatgaaccagagcgactccatcttcaatggtaactgagtaaaatgaggctgagacctgctgggctgcattcccagatggttaaagcattctaagtcacagggtgagataggaagtcagcacaaaatacgggtcataaagaccttgctgataaaacaggttgcagtaaagaagctggccaaatccaacaaaaccaagatggcgatgagagtaacctctggtcgtcctcactgctaccctcccatcagcgccatgacagcttagaaatgccatggcaatgtcaggaagttaccctatatggtctagaaaggagaggaatgaataatccaccgcttgtttagcatatcatcaagaaataaccataaaaatgggcaaacagcagcccttggggctgttctgtctgtggagtagccattgttttattcctttactttcctaataaacttcctttaactttactctgtggactcgccctgaattctttcttgtgtgagatccaagaattctctcttagggtctggatcgcgacccctttcctgtaacagttcatttttaaataatcttatttggtgttgtttggttttgagacggagtcccgctctgttgcccaggctggagtgcggtggtgcgatctcggctcactgcaacctttgcctcccaggttcaagcgattctcttgcctcggtctcccgagtacctggggttacaggcacacactaccatgcccagctaatttttttgtgtttttagtagagatggggttttgccatgttggccagactggtcccaaacccgtgacctcaggtgatccgctcacctcagcctcccaaagtcctgggattacaagcatgagccaccatacccggcctaaataatctcatttggaacatatacaatactgtcattgtcaaaatgcacatactttatattctctatccaattaggtagtgtctatttggaaattaaattattgaagttttggggtttttttgtgacaggttaatgaataagtacagtggcttttgggtgtttctttttcttttcctggtgacagctgattttgtctttactatttgtattcgtttgctttggctgccataaccaagtaccacaaacggcatggtttaaaagcagaaattcattgtctcatgttctagaggccggaagtcccagatcaaggtgtcagcaggattggttttttctgagggcagttagggaagggtttgtctaaggcctctctccttggctcttttacccctgtgctgcttcacatcatcatctctctaggtatctctgtctctgtgtccaaagctccccatttcacaaggatatcagttatccggggtgagggcccaccctaatgactgcattttaacttgattatctctttaaaaacgctgtctccaaatatgaccattgaggactaagctctggtttttttatcttgccaaaattcgtatctagagagttggggagtcatgccctactaaccataaattcttatcagatgggttttatttaaccctacatatcctgacttactttccaatctgactctggcataacattatgtgacaaagaagaaaataaaaatcgtttaccccaaaacatgtttctttgctatattttgaaatggccctgcacagccatcctttgtgggtgaaaatgcgcatctgtaaagaatctctgctagcatagctagatctttttctttcaccaccctcccaatcctgaggagatgaactgagtgtctagcaccttgtataggtctgaatagggaacatttgtcatctgttgtctctaaggacagccagtatgacacttcaagaatcttggtctccacaatcttttatcttaacctgagcatttcctttctattaatcccaggtcttagacaaactcaaccaattgtcaaccagaaaatgtttaaatttacctaaagcctagaagacccagcttcgaattgttcgaagttgaacaattgaattgaagttgaattgttgaaccgcctttggaccaaaccagtatatttctcaaatgtatttgattgatgtctcatgcctccctaaaatgcatgaaaccaagctgcgccccaaccaccttggacatatgttctcaggacctcctgggggctgtgtcacgaccgtggtcactcatatttagctcagaataaatctctccaaatattttacagagtttctcctctttttgttaggaggttaggacttcaacaaaaaagtatttggtaaatttgccatataaaataactaaaacttcaatgataatttactcagtctccatataaacaacatcaatcaaaagtatgtgcgtgtcaaaggtgatagaattgtctgtcttcccaatgagatgatttacaaattaaccattatagtggaaaacagtatttcctgggctattttttaataccatgaaccttataaacacatatgaaataatatacaaacacaatagaatgaaatatttattgttactcaaatgcccagaaacggcattgagttgtttatgaatttgttccttcattttcctctcttcatctgtagcctctacaccttcacagggagacacgttctgtttatgagccagtgtgtttaaatggctctccaagtcttgatccacacccctaccacaacacacacacacacacacacacaccacacacccattcctctcttaaggcttgggtttcaacatcatgttattctccagaaatgcacatttaccactgtttcattgtaaggaatggcagaggggtctgttattgttaatcttttaagaatggaccctgttaaaacaaaagctgctttgaattcgaagatgcgttaggaatgaaaggtacctaacaaaccacctctttgtcctatttggtagagaattcatgaagggagggttccacagagcaccaacccctattgtgtccttcactcataaggagggcatgtgcggtgtggagggtctgtgtcatgtgatgggaccccctccagtaggtgtggatcctgggacctgtgtggtcctgtgtaatggctcttggagttttgttacaggaaaggggtcccgatccagaccccaagagagggttcttggattttgcacaagaaagatccagggtgagtctgcagggcaaagtaaaagtaagtttattaagaaagtaaagtggtgaaagaacagctactccagagacagagtaggtgttcccgaaagtaagaggaggaacgcatgtccaccctaggtaacatgcatgcatgtgtgtgtgtgtgtgtgtgtgtgtgtgtgtgtgtgtgtatgaatgattttaaaagaccatggagagatgtgttctgctacaagggtttctgataaaggattaattttcttaattactatattttgcaagaatcaatattatctttaaagcaaaattaggaatgcctttgttttccagatatcgggatatcaggacactcccaagtctgggtctgtttagtcaacattatcagtctgttcccgtaactataagcatttagaggctaggaatgcctagctgcctgggagtgcagcccagcaggtcccagcctcattttcctagccctcactcaagatggagtcactctggttcgaacgcctctgagggttttgccctatagagtgtggagtcagagattccctgtcccatcttgggactctggtcaccacatctacagccttcatgatttttgtctcatttttcctaccttgtcccaggagatctatggattggtgggtagcatcaagaggcacagaattctcttctcatgtagttaaagctggcttgctttctcagcatgccaagagaggtatcaaagatggagtgcttattttcataggatgcaccatgctgtaaagacacagtgactcttccgtgaaacactaaggaaaaaagaaggggaaataaggaatataggacttgttagaggaaaaaggctccaggtagagatggattgatttttattataaatttgaactttttaaaatcaaaataacatttttaaaaaacatacagcacatatatatggcatatacataggacttgttcttagattactcatcttagaggtggcttctagtgtcagttttctcatggcaaatgacctcatcccacccacctcagcttccccatctgcacagctcaagtttcaaactagatcatctctgagggtcgtcccagcaatgatttctaatcctcagttctttatttttctaggaaacatattttattgacatcaattcattatttttttaattcaatttaattcttaaatttgcctcccatctggatttgctttatcgatttttttaaggcaatagaagacaatgatgaccctgaatacaaattgttacgggaaaatggatccaagataaaattaccagatcaacctttttattccatattttatggaatatctaatggatgtttggcagtaacttattcttacacacgaattcctgacagtttcgattcttcagacttattaatcagtgtagtcagcaccagagcaattttatgagacttaacagtcatcaaaaatttattatcagataaatcagagaaacaacgagcatcttaataggttagagaaagtggcatgtaaaggatcatttaagatggtgctttttgtcagttgtgcgttatatttacaaccaatatctaagaacttactcataatttcatgcaaatagtcagcagggtgatagttgctgtcttaggtcaaccttttctctttgtttttctccagcagaatgttgtgtttggtgtaactataaggctaagactgctaaatagacacacaataggaagcatcatttcccaatgttaagcctatagcatttattttaatgcagtatctccattttcttctggattttattagagttgtcatccaaaattaagagttactgagctcagccctttcccttgggaacaaggtgctaaacttgagctctttgttttgttttgttgtttcattttttcctgacatagtttggatatctgtccgcacccaaatctcatgttgaaatgcaatccccagcattggaggtgaggcctggtgggaggtgtttggatcagaagggagatccctcatgaatggcttttgccgtcctcttggtgatgagtgagctcttgctctgagttcacacaagatctggttgtttaaaagtgtgtgccacctccctccctccccttccctttcctcttgctcctgcttttgccacgtgacatgcctgcacccccttcatcttctgccatgtttgtaaacttcctgaggcctccctagaagcaagcagatgccagcactatgcttcttgtacagcctgaagaaccatgagcaaattaaacttcttttctgtataaattgcctagcctcaggtatttatagcaacgcaagaatgaactaacacagtccttgttttttatttttcttcttcttactatttttttaaacttgagctctttggaatgtcatgggaaaatggtattcagattgcctttcttatgtccaggcttcacgtgtacattctgtcctgagacacaggcctgtgtctgctgtattctcggcactgtttttgataccccgttaaaggtgtaataagagaccagatttcttaaaaatccggtttttggctttgtgcgatgtctcacacctgtaatcccagcactttgggaggcgagggcaggcagatcacttgaggttaggagtttgaaaccagactggccaacatggtgaaaccccatctctactgaaaatacaaaaattagccaggcatggtggtgcacgtctgtaatcccaggtactccggaggctgaggctggagaatcgcttgaacctgggagggagagattgcggtgagccaagattgtgccactgcactccagcctgggcaacagagtgagactctgtctcataaaaaaaaaaaaaaaaaaaaaaaaaaaacttgagtctttattgtgccagatgaggggagtttttccatcaccgtatctttgccctgagtgttcctgcatcacagtatcctctagggcagaaggatggtgatggtgggccacgtgggagctgagctggcaatagagagccttcagacagagctgctgggaatggacccagaaagacaaggccgggttacatcccagcagagatacaacctgctttccacctcacgtccacgtgtgctgccttgtctgtctggaatgctctttcttcacatctttacctattaaatgcccagttattcttcaagtgtcaggttaaatatcgcttcctcagagatcttttcttggaaggtttccctactgcccatcaactctaagctccttttatcatctttctttagggcctctactttcattagtagtaattttaataataacagtggctatcacttctttcccaggtgtcagacattgtatgccttgtatgtactgtatgtaagtttctcactcaatatttattggtgtgaatactacctgtattttagtagttaagtatgtgtttttttctcctgtaagagactgaagtctttttgaaagcaagattccttcttgactgggctttgcacatgacatccccagtgtcttatataacttctgacaggtcaccctaatttctgaaaagtaagaccattctggggtctggagtgttccaagttatacagttcattgtttttggtggtaggtaataaaaagtactggaaacattaaaatgtgttctcactatctaatactcagcttagattatgacttccctatggtgcttcgttatttttatagatctttttaccacattactcttatggtgcaaatgaaacatttccttaaccaataaactaattatgtttgaaagcaagacttttttttttttaattcaaatctgagggatctgtgattcacttgtctgccttctctttttccatgatggagtagtccatggggcatgtggaatgcgtgattgtgcttgtaagtggatggaatattcctgaaggataggcaataaactagtaatgtagtaatggtggttatctctagggaaagaaactggatggcaagagacagggaggagtgggcacatcctcttcactctttatcctgtggtacctattgaatgtcctattttcacatgtattcactattgaaaagattatttcttaaaaaaagaaaatactccccagtaggaagtttttacttccccatgaatgtataaaggaagaaaccacaaagaatgtggctttgtaactggttttgtctacactatctcctattttcattcatttgaagattgtgtggaagtcctcctttttagtctccctttgatcaggtacactaaaaattttcaaggtgatatcacctcgtaaaatgagtcccgaatcttggaaagagacaatttgaaagacagcttgagagaaggtttctcgcttaatgcatggaccatcccaattcttggctgaagcattgtgaaatcttccactgtttataacacctgtcagataacattaggctttcctatgttcttggaagaatctgtggcagtctgtttttccttgagaatcaaatgagaaaagatggtcattcatgaagaccaacaaaagagaagaataaagaaaaagcaagaaaatggatttctacgttgggtttgttttgttttgttaggggtattttcccacctaagactttaagtgagagaaaagcttttctatttttgaaagggcatgagggtttgaaataaggaagaatggatcttgaaagaattgattgtgtcttaaaggatggaaatgcgcttcggattcctacagtgagacaaggattttttttttgtttcttttctccttaatttttttaagctgtcaactaagatgacgtgtgtgtttcagactgtttatgtgggattatgagcatgtttaatctgttcttgtgcattcccaatagaaactgcgtgagtggtgtgatcttttaatagaatgtgtcttgcaactaacaaatgtattttggtgctaaattctggataattcctaagaaatgtaaatgttgtcaataaaagtttttgttttgaaatacttataatcttggagctatattattttaagttttctgaagacagtctctgcttcatttttctaagtttagttgagacagggcaacaagaaaaaatactggccataaagtaaaaatattctctataaatttttggaacatggttagaagagaactgcaaatggggaaacagctccttgcaggccactgtacacatgcatgatacaagacgacttgggtttactctggtttcagtactaagagtattgagtggcttttactagaaaaattcaggacctgcattataaagtcagctactcccaacttcctacccccatttttattttcttcatgtagattagtgtgtgatacagtttgcctcaattacactaaggagagagaattgacatttattgacttctgtgttcctaccatgcacatccaggccctggtgaattctttacagaattcatctcctgtaggttcacagtttgcctctgctttcagacgagaaaacggacagtcatcgtttaagtaaaacaactgaggacaaagccagaaatcaagttctggccagtttaaaagaacgttgtctcattttccatgttgctttgagtaacatctgggaagaaaataagaaaatgttaagtttatgttgataccctcaaagggaagccagtgtatgaagtttaggggaatgtacatgatcatttgacttttctggttcttgaatcaaattcagcttcctacaaggcctcatcctcatactagggttgcaggcacatgcgacattcaagggtccctaacagtattcctactgccagctccttagtccctcagggctagcttcctgcaattcaccctgattctaatttagcaaccccttatctgagtggttctggtacaacaagtacaaatctatctttctgctagatacaccctcnnnnnnnnnnnnnnnnnnnnacggatacaagccgcaagcagctctccgtaagagggagccttgaatccatgaagaaataaggaatccccagaataagctagttatctagaaagatgttcgagggatagcccttgagtagccttgttcatgggcatcagagagcctagaactgccagaataacatggagaaggcaggtgagggtagcagaaaaattgtcgtggaaaatctggcatgaacaataaagaattaacaaccagaatgatgggagaaggttccaccaatttgtatgcatgtgcaggtatgtgtttgacaggtagaagtggcaaattgcatgcgctaaatgtgcgttcatcatgcctctattttggacacgtaaatttggttaaagtttttgtgtttgtttccctaatccaaaaatcccaaatctgaaaggcaccatatctgaacctttttgagtgctgacgtgacactcaaaggaaatgctcattggaacattttggattttcagactagagataatgcactggtaaatagagtacaaatatgtcagtccaaaaaatctgaaatccaaaatacttctggtcccaagaattctggataaaggattgatatggtttggctgtgtccccacccaaatctcatcttgaattgtagcttccataatccccacatgttgtgggagggacccagtgggagataattgaatcataggggtgggtttttctcatgttgttcttgtgatagtgaataagtctcatgagatctgatggttttataaagggcagttcccctgcacacagtctcttgcctgccaccatgtaagatgtgcctttgctcatccttcatctgctgccatgattgtgaagcctccccagccatgcagaactgtgagtccattaagcctctttttcttcataagaagtttaatttataaactactcagtcgtgggtatttcttcatagcagtatgaaaatggactaatacagggatcaacctgtgttattttgtagtcgggcttcagtctgttaatgcatattaaagggtatgacctttctctagaatacttactagtatttgtctcttttggacttgaggatggactcctggcttttcttggctcatcatgtaccaactgactgtaatcagattggccaggacagtctttaccaagctttctgcgtgatcccttctttgtctttgttttattagctctagactcaggctctaattctgttgcccatccaagaatgagcccttctccagggagctcttatccactaagtggaaaatcatattagcatccaaatctgaggcccaggaaagttttagagcatggaagcagaggcagggtgatgtcaggtctgccagctatttgagtgacaaagcagaaaaattactttctactcaaaggagcacgcgttcatgttgatgttctccatttacttctatcttttttacatttattttgtccttactatattaccagaatttattaatccagtccccctttgccaagccatatgtactaaatgaaaccatgtgtttatgtgaatagtgatcccatatttccaaattttccttttcttgtctcttcctgacgctggtctctagtgttctggaattggctgccaagtgtgtaagctcaggaagttccccttgttactgtccacagagcaatacctgcctgaaaagaaaaagaaacagcgacctccttctaggttttatactttaaaaaagaaaaaaagaagtgtgggccactcagtagtagaaagccttaggtcacctgatgtctaggtagaataccatttaattatggaacaataacagtgacatcgggaagacataactacaaaaccttttgaagtctgttacctcctgattttcttgggcactaatgtttgtcttttaacactaacagctttacacttttttttctttctttttttttttttttttgagacagagtctcgctctgttacccaggctggagtgcaggggtgcaatctcaccgcaacctccgcctcctggattcaagcgattctcatgcctcagcctcccaaacagctggggttacagtatgtaccaccatgcctagctaatttttatttttatttatttatttttgatacagggtctcactctgtcgcccaggctggagtgtagtggcacagtcttggctcactgcaacctccgcctcccaggttcaaaagatgctcctgcctcagcctcccgagtagctgggattacaggcgtgtgccaccacgcctggctaatctttgtatttttagtagagatggagtttcgctgtgttagccaggctggtctcgaactcctgagtctcaagtgatctgcccacctcggcctcccacagtgctgggattacagcttctggccggctttacacttatattcaatttctaaatgaccttaggcttgctgtcttatctcattcaagtttcagttcaaatgccatctcaacaaagttttttccattatcactgtatctaaagtggaccccatcgcccaccacccactcctgcctccaattttatcgtctctcttatgcttagaatggagtctcctgcaagagcgggagacgtagttttgtacactgctctgtcctcaggagcttcagacattgcctggcacctagtggactctctgaatattcgatgagagctgttgttgtttcaagcatactttgtcacctgcagtgtaaacatttctgttagaggatttaaaaaaaaaaaaaaaaaaccttccgtgacacatccgtgacacattttcagtgtttcccttttccttgtgtctgagttgctcagatttcatattattactgccacttccatcaccataaatgttgctctgatgtttccaaggctgcagcctttcccaaccagctatttcccatcaaatctagtcgctctttttagctaggctttgaaagaaactcctgcacacagaattttaaagggcaatatcgggggccagggggaggggaacaaaacaaaaacagacgctttgtttgacctggactcagcccacttgccttatattttgttttgtttttgagtcagccaggcctcccatcccctaacagacacctctgtgtgtaggacctagatattggctgctgagagcctcaggatgcaggtgttgcttttgtgttccatcacgatggtgtgaaagagcctataaaaggtaaattggcaggctttgaactatagtaattgcttgaaaataaacagcagaggagaggggaggggaggcagctcttcttcccagcccttaaaatatgtgcgggttacgttggcaagtcagaaaaagtacttagagcctgatctctgaacctaaggacctaggcagaagcgagcataaagagtccctcagtcatcacgcagtctttgggtgccagaggtctcctgatcagccccattgagaagcatctgtgtgctgcaggaggctgtgccgttgctcatccttccacctgcgtcatttgagatggagcctgacctgttgaacacagggacatccagcgccagtcaggcatgatcacgtgcttcaagaaacatttggcttttctccacacagaagaatcctgtcaagacagggcttctccatttgagcttaaattttctcacagatggaattaatttcctatattgctaagaaaaattctcccagtcaaattcccattgttaattaagtgttgaggagaaaattggtattttgtttctttctcctaaaatgtggaaataacatggtttcattttaattatgtatggcaccagtaaaaagaaaaatttgtagctgctctgttcatgttggagcaaatgtcctgcttttgagaataagtgtggctgcatgctatacaaaagagaaacagggactccacagcaattgtcagaaccacagtatcacagcgcttctggtctctgagtcctaccaggtaccggagatgaacgcttctcccagcgggacttatggaccctgaagaagcatttcaatggggtcaaaggacttctgaataccctctaaggaaatgtacaaaaactatgaagtgccttttaatgaggagcaggtgtagccttggagaataagcttgccctaggagacatgctaggttctcttccacctgtagaccagtgggtgtaagcctggccctggaaacaggctgcctgggttcaagccctacccttaccttttgctagctttgtgacattgggccagatagatttgtttttcttttaacatctttatttgacaacaattggcatacaacagactacaattagggtgtacagtttgatgcatttgataaatatatacatctgtaaaacaatcaacttaagacagtgaacaaattcctcatccccaagggtttttttatgcccatgtataaaccatatttctcatttgtgcctctcccttcatttcccccatccccaggcaaccactgacctactttctgactgtatgtttgcattttgtagagtgttcgataaatatagacatataatgtgtactctatttaaaaaaaaacaactggctcctttcattcagcataagtattttgagagtcattcattcttgttccatgcatcagtagttgatatcttttcattgctgatttgtagtccattgtgtggatatacctcagtttgtttatccttttgcctgctggtggacgttaggcttatttccagttaggggctattagaaataaagctgctgtgagcttttgtgtaaaagtcttttgttgaacatgtgctattgtttctcttgggtaaacacctaggagtggaatgcgtgggtcatatggcaggtatggatttacctttttttttgagacagagtcttgccctgtcgcccaggctggagtgcagtggcgtgatctcagctcactgcaagctctgcctcccgggttcacgccattctcctgcctcagcctcctgagtagctgggactacaggcacccgccaccacgcctggctaattttttttttttttttttgtatttttagtagagacggggtttcaccatgttagccaggatggtctcagtctcctgacctcatgatccgcctgcctcagcctcctaaagtgctgggattacaggcatgagccaccgcgtctggccagatttacctttttaagtaactgcaaaactgtaaaataagataatcctggattatctgatatacaatttctcacttaaaagcctttgagccagccgggcatggtggctcatgcctgtaatcccagcactttgggaggccgaggggggtcgatcacaaggttaggagattgagaccatcctggacaacatggtgaaaccccatctctactaaaaaaatacaaaaattagctgggcatggtggtatgtgcctgtagccccagctgcttgggaggctgaggcaggagaattgcttgaacctgggaggtggaggtagcagtgagccaaaatcgcgccactgccctccagcctcgcaacagagtgagactccatctcaaaaacaaacaaacaaaaaaaaacacctttgagtcaggtgtggtggtatgcgcatgtagtcccagttacttgggaagctgaggtgggaggatcgcttgagcccaggagattaaggatacagtgaactcagatcataccactgtactccagcctggacaacagaacaagaccctgcctcaaaacaaaaacaaaacaaccccctttggggcctttgaggaaatgactaattgcaggtccctatcaggagaatgtagaacaaagcctcaaacatcttaacaatccagaaagcaagggagctatcaaagattgtcaaaagatcacacctgtaatcccagctctttgggaggacaaggcaggaggatcacttgaacccaggagttccgagactagcctggacaacatagtgtgaccctgtttctaccacattttcttaatccagcccaccattgatgggcacctaggttgattccatgtctttgcaattgtgagtagtgctgtgatgaacataggagtaggtgtaaattgttctaccacaaggttctttcatttcagtcatttcaggagctttaacagggttctggctgggtgtggtggctcatgcctgtaatcccagtattttgggaagccgaggcaggtggatcacctgaggtcaggagttcaagaccagccttaccaacatggtgaaaccccttctctactaaaaatacaaaaaattagccgggcgtggtggtgggcccctgtaatcccagctactggggaggctggagcaggagaatcacttgaacctgggaggtggaggttgtagtgagtcaagattgtgccgttggactccagcctgggtgacaagagcaagactcaggcttaaaaaaagaggttctgtggcgctatccatggtgctgaccagtactgaccaagggaacaccagaagaaaaagaggcaaagcagggagcatgaaagatgagtttggtcttatgtgcactaaatttgaggttttgggagacccttaagtggagagatatctaattgagaatgtcttatgggcttggaattcaggaagcaagtttaggctggaggtagaacttaccttcctgtggccaagtcctcccagaaaccctgctttgattagtcaccagcctggcaacccctcattatggtgcagcccagaatactgcagcaacagaatattctagcttcagggccttttgctttgaagaggtaggttctcagtttatcaattcatgtctgtgggtatgcattgctagctgctttgaggagttttgtttatcagattgagtggccatatcttggatcttaccatggaataaaaaggggtctttagcatgtacgattatgtagcaagctcagtgaacactgtcgaaatctatctcttttcattttaggcaccaagccaagtttgctagcccctgcgctttcttctgtaatttaaaatgttctacgtttttcctccttagttattctccagcataagcaatgggaagtaaacaattcacctggtcagcttagaaaacaacttactgaattgatttgcactacatgggcctgagtagaaactgctttatctagatcttagttttataatttgggagaaaagatggacctagacaccatttgtgagagactacagtttctatgaactcctcttaatcagtctataaggtaagaaagacatactatatgctattaaataccagtacttttgccttcttgctctgactttgggcatgtaagtatgaataaagaagagaagatgaatttacaatagcaaagacatggaatcaaccccaatgcccatcagtgatagactggataaagaaaatatggtacatatacaccatggaatactacgcaaccataatataggaatgagatcatgtcctttgcagggacacggatggagctggaagccattatcctcagcaaactaacacaggaacagaaaaccaaacaccacatgttctcatttgtaagtgggagccgaacaatgagaatacatagacacagggaggggaacaacacacacacataaaacaaacaaaaaaaagaagatgaagaaatggcagcttttgtagatgagtgtcactgttaggaagagggaggtttctctttgatgatgtggaaagaagacattggcttggctttccctggggtgggtaagtagccaaacacggtgaaagatcagcagctggtagaaattccaaaaggggaattaatgaaaaatggttaaaaagcagtatggtgctttggggggggaaaaaaaacagaaaatgttaatttcaagaagacaatacaacagaaatcacatgggccttttagagtgaggcaggcctgggtttgaatgacagttctacattctgggtggtcacatgatcgtgagcgcattattttaatgccctgaattttttttcttctgtaacatattaggagttgcacgtttgtaggtcacactgtgcacagctctggtctagcatttgttttgggaaaaataagatctgatagcagaattctaacatttgtataaatgttcctcttaacagaaacttacaaagactctttgtaatagactgcaggtcaaagtagtgaggcttgaaccgctacagaaagcacaacagtattaaaggaaaagtgcaccacctcttggtgaatgaacatgtctatggccataactatatataagattatctgagaagtttggtaaccttaaacatataaccagccatatttgtacacaacaggctttctgaggagacatagttgcctggaatcatgtcagtggctgatactcttgaaacggcaaattgacatcacagtgggaaaagtgtaaaccaccatcaaagacagaaaatgaggtcactgcagtgtgcctccttttatttacagatctaggaaagttaataatgagggagatcagaggaaggggagtagaaaggagacaaaataggaatgctcttgaaatttatatctgaggacctttgtgactgcactgagaaccagggaaagcagtaaaacttggggggaaaaaaaaccatgttcaattaaatcctatttcaaatgttttatgatgttcaaattttatagaattataaagttcaggaaaccatagaaatgatctcattttccttgttactttttagatgatgaaattgagttccaaaatgattaaatgaccaacccaagacgatctagctaggtaatatattttgctcacaggatcttctcaaccactggtccctctgcctgaaacgtgtcttctatacaatactcatcgtccttcattgcacagttaatttccactgttctgcagattttaggtcttttatcactttcctttgggagtctaccctgatcactgcccccacatctcatcaaggtcaaataatgataataacagaaaacaacctcatctaatgttcattgaatacttattaatcatgataactctatgaggtgaatactgcttatccccattttctcaaaggagaagctgaaatacagggggattaagtaacttgctcaaggttacagttttaatatgtagtagagccagaattgaaacccaagcatttctcactgcaaactccaagctcagtcctagtctaccagttattctattatcagaataccttgctcctcctttagcatttattgttctcatatatttatatttatttgtgtggttatttgattaatacgtttttttctactagaatgtaacttttaggctcagattacgtatctttttgattcaccaaattttgcttagagcctaagtacctgatatctggcaggctcattgaatatagttcatatgtaaagtagaggtgataatagcatattttggccaggcacagtgcctcatgcctgtaattgcagcaccttgggaagccaaggtgggcagatcacctgaggtcaggagttcgagaccagcctggccaacatggcaaaacgctgtctctactaaaaatgtaaaacttagcccggtgtggtggtgcacgcctgtaatcccagctacttgggaggctgaggcacgagaatcacttgaacccaggaagcaaaggttgcagtgagccaagatagcaccagtgcactccagcctgggtgacagagggagactctgtctcaaaaaaaaaaaaattaataaataatagagttaatggcatattttatggtactatttaattgtaccctagtactaattgcattgtttggagaattgagataatatatacagagtagtcactagttcatgtcactcgctagtactcagtaactgaaaggaggttaattgtaataaatagatttagcttaagataacaagacagaatctgaatccaaatgctcagtgctcttaacttttattccctacccctttgggtacctataatgaacattattagaaaagtgaatcttagaaaatatattgcttcccagagatgatttcagattaactaacagacagctaaagtataagttccctccttggtgtcagttttattcttgagctggagatagacccagagtctttatgactcagtggtaattaacagataacttgtttttttctttgttttttgttgttgttgttgttgttgttgtttgttttgctttgttttggtttggttttttttgatgcggagtctcactctgtcgcccaggctggagtgcagcagtagcgtaatctcaactcactgcaaccttcgccccgcaatgctggggttcaagcagttctcctgctttagcctcctgagtagctgggattacaggcatgcgtcaccatgcctggataatttttgtatttttatataaagatgaggtttcaccatgctggccaggctggtcttgaactcctgacctcaagtaatccacccaccttagcctcccaaagtgctgagattacaggtgtgtgccaccgcacccggctgatggctcattttttaacaccctgagtttaaggtggctgtgagcccacctagagatttcccaggggcagttaggtctatccttgcaaaacacaaacttgttataatagttttggactatttttaaatactttagtgcaaacactatgtgatccacctgcctcggcctcccaaagtgctgggattacaggtgtgagccaccacgcctggcccagataactctctgaaccagcatctcaagctttggccattaggaaagtctaaagtaagtatcttcagatcaacatgttatttgagagtgcagttgtgatgtccttgttcagttactgcaggagaagggtacttgcttctttaccctttctttgaccttttagatgtatttgtttctacacgcattctgtggctttctgtgtatatttcaaagatgtagatatgatctattatttcaaatcatatccttgaagttcagcagtgctatctctaggtataaaagtacttgtagtaagggatcatcaatgtattctagtatacagacctagaatagctgtagaataaaaattgagttatattaataacctgtaaaatagtcacagataaaatggtgaagagatcaaaattaatcttaaaaaagcataagccaaaaatgcagatatcatagggtcaaaaatagtgatattcatgaaagttatgattaattatttaatcccaaggacacagtatactttaaaaatatatttcaggttcacaattgactagctattttatgtggcagaataccagctttgcatatttattaaaattattcataactgcatagcagcctagttgaactgttgagtccttgttcctttgtccaatatgttaccttgtccatttatcatagcactgtaatagaaatttgtctaaattttaggatgatccgtggaatatcttcagtgtcagcatgtcttaaatattttattctttccgttttgcctaatatgatctttttacataggtttagaagatatctccatggggaaaaaaatgcagtttttttaaggaataaattttagacagaagtctttgttcaaaacgaaaagttattatatatcattaatatttatgtgtcaaaatatttctcttacataaaaatctggacaagatgtgaatgctttttgtggaagaatggaagtttgtgttcttcatgcagattttgagataactatgtttgctttgagtattatttgttgagaatttaatgcattgctgtggtcattcaatttaacagtgtatttgggtggtgggttctggagtcagacttcctttagttcaaatcctgagcccaccacttagtgtttatgttgtttaactttctgagcaccagttatctcatctgtaaaattagatgataatagtgttcttcttggagggttgttaggaaagagtgtatgagataatgcatataagagcacttagaacgtgaccaggtgtggtggctcatgcctgtaatcccagcactttgggaggctgaggcaggtgggatcacctgaggtgaggagtttgagactagcctggccaacatgacgaaaccccatctctactgaaaatacaaaaattagcccagcgtgacagcatgcgcctgtaatcccagctactcaggagactgaagcaggagaattgcttaaacctgggaggctgaggttgcagtgaactgagatcgtgccactgcattccagcctgggcgacagagtgagaatctgtctcagaaaaaaagaagaaagaaagaaaaaagaactgagtcagacacataataagcattcaataaatactaggtgctgtcagtgttaataatagtatatcatggaatgcctcagcaagcataggctagagttttatcaagaatatatggtaaagagaagtttatttccggtattatgtctctaaactgctaaagacttcattagaagatgatgttaggaaagaaaagttgtacaactctttagctagaatattaattaaattatagtagagttcaaagaagtctcagataatctagtttaatgacctctctttgcgtaggtaaaaagtgtagttcccataggtcaagtgaccactgcaggatcacccatctgggactgcagactctaacccaggtctcctggttcaaagcctagtactcggcctgttttgaaacactcatttattagcaagaagcattcatcaatgttgtcttagatgcagcaattattttgggaaataagcagtacatgaaattttaggcagtatgtaacacttccttgcttctctgggtttggtgtcctagtgacttttaagcctccagaaatatctttccacatacctaagagtcacacagaaagtgattgactgtcgcagagctagagccatcatcagtgcgtgtgagcagctctccctgaattcctcattgggacgatagtggtcgttttggtatgggtacagaaaatggaatatccgtggagtgatctgtaatttccctcaagacctcataaacttctaaaattaacataaagcctttcttccttataaaatagagtcatgtgttaaaggagatgcattagatgcttctgtgcagtatattttagtaggttctataaaatttgcaataaaggaaaggtcagtgttggtaccataaacagtgttcgtggagtcatatttaaccctagtcccttctgtgactcctggagtgtagagtaattgaactactcttctttgaaaatgcccctgtacccgtcactgcccaagaaagaccccactactacccagcactcttttcttagaggcactacctgctcctggctctgggacccacctgtcaccaaagggcagtctgaaaagagggtggatttcatctcatttacagcatgggagtggaagcttcccttctggctcagccacagttttgtagttgaggtgaaagtgaaaagactgtcgtcacactgatctgtggggtatgcagagcagagtcctccttctgtattttggtgatcacatgtgaaactaagagagtgcaagggtgacctctgcatactgacgacacatgtagttgtactgcgcggcgagtggctattcatgtgacctttctggctgtaggcgtagcttcccagcctgcagaggctcctgcactgtataatggcagagataatggccctgggcttgttccacagagcagttttcaagcttaattgaagaatatttttaacccattatcaagagcattaggaggaaattttcgaagagtcttgcttgatacagctctttcaattgaagaaagtagactcccaagtaagcaaattacaaccttaaatagtaatccatctttatttgcaatcccttcatctttccaggataaagactcctctcttcactctgaaaagcatgaaaaggggcagatccagacagagcatcacacatgcttcttcctcctggtgtacaggagcacgtagggccctttgtttagaacaggatgcctttgaatggactgccttgaaaaaatttttcagaacgatcctaaccatgtctgccaggctctcatggcgcatacagatctggttggaagatatttaaaggtgttcaggcaacgtgaagggaaagcacccatctgagacaccatgaatgggcttttctttacgtcattatttctagctcctttctgtttctacgctgagcaaatttgctctcatcctttcaaacttagagggtttttttttttttttaaagattgctgagagatgcccccgaaattatgattaccacagccagtttctcactcagtcatggactatagtcaaatttaatcttatctttaacttcacagaatagttaatgttatcacacgcttgatttcttggattattttgtcttttacttttaaaatggcaggagaaaaataacccgatttttttctgtaattaaaataagtctgtatgaattagcatatgagtgatcagataatatctaaccagttgaagtttggaagttcctttcgtttaaacaaaaatagaatttcagcaccattttcatttattgattcttcttttcctgtatttcacagtttttaaaaatgtgtttgaagtcaccaaaaatatacttctaatgctgtgactaaatttgccacaattaagacacccaagagtccatcagggttaaagtaggctacaatatgtttataaggacaggcaaaaggtgtcagtgtaattttattaggaaagtgaaaaagagaagtctatgggcagtcaggaacaagctgagttatttaccaaaaatatatggtaacttctcttttaggtgtgtagtgtgtatctcaaagaaacacatgttagttcacaaggatttatgattttttgattaatcagaaatccattcaaaaaatttaccagtatttctcaaagagaagtgctgtctgtagacaccatgggcacatgaagtaaaataatctgtgaaaattctttgtcttgtaaaaataggagtgccaatctgatcaatgtattgtgttataccagctgtgtgggtgttacagaatgaattttggtctcaattttgtaacttacagaaaagctataattgcagtctctcctgcccacttgtatggtcaactaattttaaccatctctaaaaggcacttgcaaaaagggaaaaatgcccaattcttgggtgcatgggcaaaatatacatatagaaatgatagttcatgaggaccagatattctgaaaaccttctcaccatggtagactagatgcagaatgagtcagagaaatgtattttataactatattgctgaacttgtaagagtagaggaaaatcctcaaggggcagaaagaccttataataatttgaaaccaaagaaatgtgctaaaggagaccaggactgtctcaatagcaatgcccatgtaaggaactcagaacttaaccactatggaaaaagatgactaggcctggggtttggttgcagttggaggacgaaactctttcacaaagctagcacattcaaaggggctaccccctcagagaaagtcagagctgaaaaaattagcctaccaagaaaggaagcagatgggaaaatgtgtctgcttttgccattgctctacatcaaggaaaaatagtagtcatcatagtcatcttctctcctctcctaaccatttgtgactataagcttaatgttggatgggcatgcagtataagtatacgctacttgccaggtcatggaaactacatttaaaaaatgtagataatttgtttccaaattggtggaactctgtggcatttggtagagataagcataaatctggagcaaagcattaacaaaatcgtgtcctaaggattcctacagattcaactgatatgaagtcatcataaatacttacacacacacacacacacacacacacacacacacacacacacgcactctctacatatcacacatacactctcagggaagcaatgaaaaattaccaaacagggaataacataagccaaaatttgcaagactcagcagaaacaagaaacacagatctacatcccccatgccttataacattggggtgcagaatactgcatatagaaaaatacatgtgagctatatagagaaaaacgttgagcaaagagtcagcaaccatcaaaaacaaccagaaagatctgaaaaataatagaataacaagaaatgaaaaatataatcattgcaattaaaatttcagtagataggttaaaagggtattacacataaatgaagagagagtaagtgggccaggaacagtggctcacacctgtaatcccagcactttgggaggtttgcagtgggtggatcacttgaggccaggagttcgaggacagcctagccaacatggtgaaaccccatctctactaaaaatacaaaaattagctgggcgtagtggtacgtgcctgtaattccagctactaggaggctgaggtgggaggatcactttgagcccaggaagtggaagttgcagtgagcctagatggtgccattgcacttcagcctgagtgacagaacgagagccttcctcaaaaaaaaaaaaaaaaaaagagagttcaagaataaatgaactggaaactcatgaaaaagataacacaaaacacagagtaacgagatgaaaaacagtaaagagagagtaagacatagggatgacaaattgaaaagatttaacatatgttgattgaagatccactatattaaaatactgaaaatgagagaagttaagaattgggaaaggtttgagattttaccttccttccaagctcataaattagcttcccacagtttcatggatgctgtttgaagacacaacattcctgggtcaaacacaaaggactttatttctcaccgcacaacaggtagcgtgaactttatgttcaagccaattccccctgctccccaagtcccatggggatgatgtggccctgatgcacactgggcgtgcagtgagtttgggtcatgcccaaagacacctgagcttcggaagcccaagccttttaaaatggtctgtaagcaaatgtgctctttaccttggagggagacattatctttagtattatttatcgtagtagacagtattaccttactagacagtaaacaaatctgctgtctgctccagagagacactatctctatcttccaaatatccttgaatagttttttctgaactgatgctgtcagggcctctgctcacaaaatatgcaaaagtttgtgagtcccatggagaattatttcccactagtggagaaacaatttaagactgagacgtttcagaacgctagaacattggaatcctctgatacagtttacactttgtataccaagcagcactaatacatatatagttagacctatcatggtggacaccaaaaacaaaagaggagacattaaaaacaaccagtaagaaaagagttcaaattgacaagctaattctgcagttatttggaagagtgaagggtcagaaataacaaaaaccctcctgaggaagaaccaaagtagtagagatgggctgtcttgccttagagacattaaggtctgttataaagctataataacgaagacagcctggtattagggtgccagtgtagttacagacaaagagaccaatggaacaggataaaaagcccataaataatctcatgcatatatgcacacttgacttacaatggaaggagtattgcagatcagtggggagagactgaactaatcaataaatcatgcagttacaagatcatacatgtggagaaacaaaatgaaaccagatcctgaagtacacaaaaaatcggttccaggtatattgaatatttgtatttttaaatcaccaacagaaaggttttaaaggaaaggaaaacagtagaactttcaaagaactaaaaaaaaaaaaaaaaaaaaaagaatataacctcagagtagagaagggtttcttaccccaaactcaaggaaacacagattgtaaaggaaagattaataaattcaactacattaaaatgaactttctctttatcaaaggataccattaataagttgaaaagatgcaagccacaactgagaaaagtggtctgcaacacacacattgctgacagccgattagtatctaaaacatttaagaaagataaattgataaaaggtatgaacaagcatttcaaagaaaggaaaacatgacttgctaatatacatgaaaaatggtcaacttcagttgtaattagagagctagaaattaaaaccatgtgacagcattttatatgtaccaggttggcaaaattaacatttggaacaatacagtttgtgggcaaggatacggagccacagaaactctgatggtctcaatctaattccctgcaaagaccaaggcagacatgtatagtctaagttctctagggttttatcaaacataagaagaagctgatttaacaaaaatcttatctgttcttcttaacgagcaccaaaatatttttattatttatttattttagagatggggtctcactctgtcacccaggttagaggtcagtggcgcgatctcagcttactgcaacctccacctcccgggttcaagcagttctcttgcctcagcctcctgagtagctgggattacaggtgcctgccaccacgctcggttaatttttgtatttttagtagagacggggtttcaccatgttatccaggctggtctcgaactcctgatctccggtgatctgcctgcatcagcctcccaaagtgctgggattacaggcatgagcccctgtgcccgtccacaccaaaatattttcaagccaaattgttctctggtcaaaccttgaatattgagatagatgtgctttatattttcaaggggaaataaatacctgcagagaaaaatccactgcatcccagatggataccagttttgtttatcttcatcccaatttccaaggttagataattcaaaagagaaccttaaggaatagccctcttagatatattctgcttttatttctattgcaaatggaaattgacaaattgacatacaaaatgaaaaattaaaacacaaaatatgtagtgattggaataaaggaaaaggcacaaactgctaaaattctccatgtttgagagagaaatcaagcaactgagccctgttatcccctagaagaatcccccggggcatcaagttgcatcttgtcatgaaccaatgagacaggattacagaattttttattatttttttttgagacagattctcgctctgttccccaggctggagtgcagtcgtgtgatcttggctcactgcaacctccgcctcccagtttcaagcaattcttgtgcctcagcctcccgagtagctgggatcacaagtgtgcaccacatctggctaatttttgtatttttagtagagatcgggtttcaccatgttggccaggcttgtctcgaattcctggcctcaagtgatctgcccgcctcagcctcccaaagtgctgggattacgggcgtgagccaccgtgcctggccctttggattacagaatttgacgataatgggttcaaagctgtctggaggcataacctccggggcagctgaacaagattataggaaaggaataataaaatattctgaagtctgtctatgcaaacaaacacagatgtctactctggaagaataaaatgtaccctagaattgcttttttttttttctagtatgattgagatgttatggtaatattaaaaatgaaaaaaaaaaatcccaaaagtctaacctagaataactgcactgatcatattgccttgttctttaaattcttagtatccaaataactttcagtatttagtgagacatattcgtacatactcttactaccagacagcctatttattaaacattcttaattcttgaactaaactgaatggtcaagtaagttacctaattagccagggaagctaaaggaagtactaggagttaccatcttagggaaaaatttccacacttggatttgaatacttgtgaaactcggtagcagtgaactagatctgaatcaatatctctgcctgcaagtcatataacctctatgagaggttaatgtggctcctgtttgactctgtgttctccatcagctaagcatgtgcatgtgtcattcatattttgttttcagcttgttacactgacaggaaaatctctgcggaataaagaaccagttttctcagcctctaaagctatactgtatttgcatatttccaagatttaaagagaacagtgttttccttgtgtggacggttcttctatttgtactgtactggaaaacactgacagctaccaaactgtctctcattttgttcctgctcattactaattttgttgattcaatagtggaagtggggaattttttaattagatggcatatttcaaaaccattttcttaaaaaccctgaataaaatgtccgacttttgttaaagccactttgctttgtgcattacatgttgtgtttatgaaaggattaatatatataagccgattctgttaggtagataagaccttctagtttagctctgttaattccatacatgattgtgcatatgcttgtgcatacttggttggtcaaggatggaaaggaatagcgaagctaactgagaatcacttgtttaaatacattgattttatacaatctcactttgcaggccctggttgacaccttaaaataaaatagaattctttagctggtgttctctttattttgtacgtaaggtaatccccttaacaaacaagcaaacaaaaacttaatctcatttgtaatactaacaattggaaacaacagaatgccctgtgagatttgattgattaagtaaataacaatgcaacaatatgattgaatcctaggcagccatttcaagttgcgatgtataagatggtttaatgactttgagaattttcataacatactataaatttgaaaagccgagagtctatatcccaaggcaaatctgtatggaaacaaaaaaaaagctttgaaggatacatgtcaaatattaatagttttcttaagtggtaggattgtatgtgggttttttctctctttatgctttccagtactttgtaatttttctctaattattatgtgcaacctaatttatttttttctaacaacatgtaaatttcaataatttattattttggctaaaaacatagaaatgttttaataaactttcataatgagaaatatattaagaaaaaaatcacatttcttgtatttttattatcacagtagtattcaatataattacaggcaggcctcaaagatatctcagctccagaacacagcagtaaggcaaatagtgcaataaagcaagtcacagtgcatgtaacagttacatttatactgtactaagatatattgggcgtgcaatagcattgtatctaaaagaaatagtggacatacctcaatttaaaatatgtgctgctaaagatgctgacgtggaaatacaaagtaaacacctactgttggaaaaatggcacccaaaagcttgcttgacgtagggttgccacaaactttcagtatctccaaagcataagaaaacaaggtatgcctgtattataggcatatgctttaaatgcatatataattaacaattttatgaatatgaattatataataagcaattatattactgcatacatatgcaaattgtatataatatataattatcaaacagttattgtatatcacatactctgctaagctctttatacaagttttcaggcaggcagaaaacataatcatcgccactttgtaggtcagcaaactgaggatttgatcaagtgctttgccctcagtagtgttaacctctaagtgacagatcccagctttgacctggagcctaagtcccaagcccgtgctcttaagcattgcccttttgtcttttactttatttaattgttgtcaaatattagcagtggttttgcctttatccctttcttgtcttccatttctcattgcagaagaagatgcaaaattcatttgagagagaattataaagattgtcacaattgaattgaagcaagtgatatttttaaatatctattgactaattattagattgcatttcacttattttattgaatgatacagaatgcatttctctctctctctctctcttttttttttttttttttttaagggacaaagtctttgttgcccagcactccaggcacattcgtggctcactgcagcctcgatttcctgggctcaagtgatcctcccacctcagcctcctgagtagctagggctacaggcacgtgccaccacacccacctgtttttcaaaaaaaaatttttgtagaaatgaggtctcactatgttgcccaggctggtctcaaactcctagcctcaagtgatcctcccaccttggcttccaggagcgctcggattataggcatgagccactatgctgggcccatttctctatttagaaaggaaaaggtgcacttgggctgtgttaaaggttgtgattcttaaattcacactaaatcatttcctttttttttttttttgtttttgtttttgagatggagtctcactctgtcactcaggctggaatacagtggtgcagtctgcctcactgcaacctccacctcccgggttcaagcgattcttgtgcctcagcctcccaagtagttgggattacaggcacacgccaccatgcccagccaatttttgtatttttagtaaagacagggtttcaccatgttgctcgggctggtctcaaactcctgacctcaagtgatccacccacctcagcctcccaaagtgctgggattacaagcatgagccaccacacctggccaatttcctttttttttttttttttttgcaaatttaggtgtaggcaacaaaccaaatatggcacacatttgtgtttcagggtcacaccatatgagcggtggcacacacttgtaatcccaatgctttgggaggccgaggtgagctgatcacctgaggtcagtagttcgagaccagcccagccaacatggtgaaaccccatttctacaaaaaatacaaaaattagctgggcgtgatggtgtgcgcgtgtaatcccagctactcaggatgctaaagcaagagaatcgcttgagcccgggaggcagaggttgcagtgagccaggatcacaccattgcactccagcctgggtgacaagagcaaaactccatctcaaaaaaaaatgaaaaagaagtcacagttaccctcttactgtaggcacttagggttacttgggggtgtatggagaaacaggcattattaatgtagagcctttacttgtgtgtttataaatctagggattagctctggtgtcacattgggcatcagtgaaattctgtgaaattcctttgataattcaatctcccctctccccaattttcgtaccatttctagaaagcatatgccacttattaatgcacaggtagtatgctcttgtccgatattatcttctttctgctcttatgaaatctagtacagctggcttcaatcaaatcataatacaaattgcatactgaaataaaaaataatactcagtgtttgtagccagagaccccttttggccctaagtatttagcttatatgtatttttaggcacaagtattacttgttgcagaattttcaaccaaggagtgaatgaatatttaagaaaaaaaaatctcgattgtttcagttcatgctctcagtcaaagcacatcccggcacatttatactcatccatcctgtgtgggcgaggagggaaagccgtgttactaccatgtgaaacttgcagtggtttttatttttaccctctgcacacacacaacagagtattgttttgtgagaagaattatgtgtaggagttttagagatctatttgtatcctagctctttcctaattgtatatccttagggatgtcactgaactgttctgtatatttcatcaactttaaaatggagatagtgttaatagcctgttgtaacacagaaacttgtttattaaaagtaggtaacatatgtcggagttacacagacttgaagcctgcttcttccctttctttgcttgcctcatgagcactgttagagcctttggaaagatacttcttttccaatggtgatgcaaagtttagtggtttgtctcttggctttacttgtatttttttccctagatttttttagctctcccttgtatatttttctgttctctatgtaaagaaagattcattaaaaattaattaggccaggcattgtggctcacgcatgtaatctcggcactttgggaggctgaggcaagcagatcacttgagcctaagagtttcaaaccagcctgggcaacagagcgagaccccatctctttaaaaaaaaaaatgtagccaggcatggtggtgcacctgtagtccctgctacttgggaggctgagatgggaggatcatttcagccctggaggttgaggctgcagtgagccgtgatcacaccactgcactccagcctgggtggcagagtcagatcctgtctcaaaaacaaataaataaaataagatttttagttttgtatctaatacattcaaataaacttatacatttgccatgtttatgagttcttttttaattgaagtgtaatttacatacatttgtacagaccgtgtgtgtgtgtgtgtttgtgtgtatataatatagttccctgagttttgacaaacgtgtataacccagtataccagtttaggtatggaacattccgatcatcctggaaagtttgggaaatgtttttttccacttaagaatggctcatttctccagattctcgggtttttttttttttttttttttgctttggggcaggtgaatcatctcttgttatcagcgcccctcctgtagcttctgagctacagtctttctcaatcagcctccttttactgatgacatgcttcttgaagaggaaaaagtttgctttctttttctatgagaattttccagtttttcgttttgttttgtttattatcttcctagcatctctcttcctcatttccaggtgatgctggcaatctattttacagtttagcacaacctttagactctaaagaggtcatttaaaggtgctttccaataagaagcattttagtgttgtctctgaaatgtttttactctccccctgcaccactcagaatttacatagtttttgcgtacataaatgtgctctctcctcccccaaatttagtaaaatgtaaaagtctgagttactgtcaattttgagatatttaggaaatttaactcaataccaaaccagccatttacttgaagtagaaataaatatttcatttacttannnnnnnnnnnnnnnnnnnncaaacacatagtgttacattagtttaaactatgtctgttattttaagtcagttatttgttattttttaaaggcttcattaggtataaaagctatctgtaagtcaagcttttaaagtactattgagatttgtcagccataattcaatttttattctttgaatcaagacctaaactagtacctttagagtaatattgcaaatgagcactacttattagaactgtttttgaaagtatgcaaagtgtgtttgttctaccttgccttgtatatttacacctcttcgattttgctttatgaggagcaaaagaaactgtcactatttgctgtaaattgaagcttttaataactaagtcttttctacaacatttgtcagctttgaatattctgtcagtggaaaataaaaatagcagggaaacccagcagtggtgacactgagaatttatctgcttatgctacactaaggtaaaaaaataaaatcttcaagggtgagcatttgacatttttctttcaaacaaagtacatttgaactgacacttccttgaataaattttagatgaaaagttggcaaaataaatgaataagtttcatcattaaacacagaacaccttttaacctagaaacaagagaataaagaggttgcttcatatcattgattcaatcctgtatgccttgtttgacatgagcttgaaaaataagctttataaatacataaaaaggaacatcatagctcagtagtaaaaacgttgatgcatatggcatttaaagttttaaactatttcatagtaaaaattcatgtgcagatcatcttgaatatgtgacaataaaaattaatttatctaataaagatgattcaagtaaatcaaatctaaattccatactccacatttttgttcgtaaattgtgtgcatccgttataaatattaaaaacatgaatgaaatatacattatgaaaaactcctgctttctctttttggataaaaacattgaaagtttttcagccaggtgcagtggctcacgcctgtaatcccagcactttgggaggccaaggcaggcagatcacgaggtcaggagatcaagaccatcctggttaacacggtgaaacctcatctctgctaaaaataaaaaaaaaagtagccgggtgtggtggcgggcgcctgtagtcccagctactcaggaggctgaggcaggagaatggcgtgaacccaggaggcggagcttgcagtgagccgagattgtgccactgtattccagcctgggagacagagggagattctgtctcacaaaaaaaaaaaaaaaaaaagcttttcaggactccttattagtgctgacttccagttttagttagatctgcttcttgttcttctgcctctttcttttctttgcctgtctacttgtaagtctcttctcaaaagatgcctttatcattgtctttatgaataacagtgaacatttatggaggacctactgtgtggcaggtttgataaatgtaacaataggtcagcgctattttgaggaggaagaaaaatgttgttggaagtgtgcttaactatgctactgtataatcttcacttaaacttctgttataatagaaaggtgattaatgagaccccatgaacctgcctcctcctgtcaaccttttgacgtgtctgcaaatatacagaattttaaaaataacctctcagtgagctagagatagtctcagcttttacagaatggacatgcctgcatcttttaatttagctttctgttagcgtgattccattcttacagattgagcctgagggaaagagagaattattgtcaaaataaatgagataattacatgtgtgtaattttacaaagcgctctacaactgtgtttgtcagtgatgagaaatgcctagttctaaaagttccttgggaaggagtggaatttgaagagttttagatggcaagatgtgtttacttttggttttaaacaaaagtcctagtgtagtgttagggcctggtttttcacagtgataaattgggactttattgctgtatgaatggtggggttttttcccccaaaaattaaatctccttatgtctcttatgaaatctcatttcaaacaagattacaggagtcatttctggtaaaatttggacattaacacacattagtgatttgtgaagatggttgaattttttgtacggagaatttttatactaaattcagtaaatagttctgttgtgccgtgtgccccctagaaaaatcacgtgcctataaagaacttaatagggaaaattgaagataatgattttcctctttggcagttttgtcgctgatttgcaaggtagtaacagggcatttgagttcattttctgttttgtgtgtgccccttccatattgcaaagttacaatttttatttgcttttgtctttttttagtagtctgatttcgagtacctcttaggagttacaaagctgtcaggtacaatatttctcttttaaagactgataagattttcccctttgaatatgctttttctttttaattgtgttacttgatttggataaataagctactccaattgtttggataatgaaataagatgcatatctctgagaaggagactgatttaattcctcgttttcatacatgctgaatatgccttcgtgattcataagagccatttctaatctgcattttgttagggtatttgtcttgcttctaaataaagagaatgaaaacctttttaagttaagactgcattgatggttcaaaaaataaattaaaataaagatgagattgtttaaatctttgattaataagcaagctcataaagttcttgtgaattttaagggaaatagttaaatggatttttcctaaccatttaaaagtctcagaacggaatcattttatagagtatctactggaaagaggaaagtgaatataccacagaagtctttctttataaataaatgaaatcctaaagtcatctgctaatgacttttatactaatgcttttatagttgtgacttgggtaaactgtttaacattttacagcccacggtttcctgttcttaatagtaaagcaaagctatttatttatttatttatttatttatttatttaaagtatcttggttttcaacaataaactgtgaaagctggcagctctttgttctaaatcttctgaatatagtccaggtacatttaattttctggaaagcagtgctttcaagtagaatagtgaataattgaatttcccatttgattttagaaaaaaaatgaattcccattgtttactttagccatctgttcatctcccttcttcactgttgtccccttcctgccctttcaaacaagccatagacttggctaactgtagactacagcttctcctcctctctctcaaatgtggaggctcgtagcaaactttgacctatcttcgtaggcaatgtgaaggagaaaagcaataagctctctgcccagagtcagcacattagcatttgagaaatcaggttatctgactttggttgattgagctgcctttgaactgccttagtttccccaaaatgatcattctttgtgagatggaagacaaaagtgattcaaagacacttcattcagaagaaagcacgtaacgctaggtgtggaggctagtgcctgtaatcccagcactttaggaagtggaggcaggaggatggcttgagcccaggagttcaagaccagcctaggcaacatagtgagacctagtctcttaaaaaaaaaaaaaaattttttttttttttaaattagccaggcacaatggctcatgactgtagtctcagctacttgggaggctgaggtaggaggattgcttaaacccagcaggtcaaggctgcagtgagccctgagcaggccaccacactccagcctgggtgacagagcaaaaccttgtctcaaagaaaaacaagaaaaagaagaaagcacacagtttagcagtcatcccaattcctgcctatgtgccagtcaaagaatagtcagatgccaaagagctcatgtggtggtggagttttttttaaatagctttattgagataaaattcacatcccatacaattcactcattcaaaatgtgcacttcagtagctttttatatattcatacagttagcattcatccctacagtcaattatagaacattttataatccccccagaagatgccacaacccttagcatcaccgccaacttctcttcccccagcccttggcaaccactcatctactctctgtctctctacatttgcctgttctggacatttcatataaatggagtcataccatatgttagtacttaattcctttttatgtctgaataacatcatactatatggttttaccatgtttctttgtccattcacaaattgatggatatttgggttattctggctattatgagtaatgcttctgtgaacatttccgtacaagtttttgcatggacatacgttttcatttgtcttgggcgtgtacctaggagtggaattgccgggtcaaatggtaactatgtttaaccgtttgaggagcagccagactcttttccaaagcacctgcaaccactttacatacctatccacaatgtgtgaaagttccagtacgggctgggcgcggtggctcacaccagtaatcccaacactttgggaggccgaggcgtgtagatcacgaggtcaggagattgaggctatcctggccaacatggtgaaactccatctctacttaaaatataaaaaatgagctgggtgcattggcacgcatatgttagctactcaggaggctgaggcaggagaatcgcttgaacctgggaggcggaggttgcagtgagccgagatcacaccactgcactccagcctggagacagagagagactccatctcaaaaaaaaaaaaaaaagttgcagtacctccacatcctggccaacacatgttaccatctgacattttggttccagccccatttcacacccactggtatgaaatgctatctcattgtggttttggtttgcgtgttgattccagcctcatttcacaccagtgtgatgtctcgttgtggttttgatttgcatttccctaacggctttgatgctggacatcttatccatgtgcttactcacatattttaatattattagttacaatgccttgcaagctaatgcttgccaccatggtatctttgagactgttactcagaagtattgactgacatgtgccatgtagtaacccctggagctggaaggagcttgaggccctgcctcggtgacatacagggtaggaggaaggaaaaaaacactttaaatatatgaaataaagtgttcggggagctacgatggaagtgtgtgcggggaccaatgggaacatcagggtggaagggtttgattctgctggagagaagggacttgatcggggcaaaagagtcagagaggaggtgatggttcatctgtaaacaatgatgtttcagtcattgaaccaagaaggaggataccaggatgaataaaccacggctcctgactgtacggatagtgagcaggggctgttttgagtcttgattcttgacagttaagatgtttgaggccacagttgaacacagcgttcctgacctggtgtctttctcctttactgaaaccctcccaaatggggaacgggctttctcctatcactcagaaggggtgggatatcacaaaacaccagaatgagagctgtgcccagtggttccagaaactgctttcttgctgttgcttttgttgtagttgtggtttctgttttgaatgcacatttatatatgtatgtgtgtgtgtgtgtgtgtgtgtgtgtgtgtatatatatatacacatatatgtatatacacatatatatacacatatatgtatatacacatatatatacacatatatgtatatacacatatatatacacatatatgtatatacacatatatatacacatatgtgtatatacacatatatatacatatatgtgtatatacatatatgtatatacacactactatgctatatatacgtatatatttttaaaaaccttctagacaaaatgtgactggtttttgttgttttttttgtgacagatctcgctctgtcgtccaggctggagtgcagtggcgtgatctcggcttactgcaacctccgcctcccgagttcaagtgattctcctgcctcagcctcccaagtagttgggattacaggtgtgcgccacacgcctggctaatttttgtgtttttagtagagatgaggttttgccatgttgcccagcctggtcctgaactcctgagctcaagcgatccgcccgcctcagcttcccaaagtgctgggattacagcgtgagccaccgcacccagccacattgtgacttgtaatctttgatttatgagagatgaagtgactatcctaggtctgttgcatacatgaaagaaattttttcttttggaaaagtttattttccaatgaaatgtttggattttcaggatttttcattattatgattcattctttttctgatatcttctatgacattttggaggaaaagatgagcttttgggaaacatgcaaacaaacaaaaccacctttggtactaaatctcacctagaatgaatacttctgcattttaaaaactctccaagatatggtttaaaagatgagagtagaagtgaccttcaccaaccttgctagcccaaatccttatttatgtttacgaaatttgcaactctgacatgatattttagaaagccatataaaatgattttgcccattggttatggtgtttaatggcttaaggaaaaatatatttgtatcttgaaacttctggacccattccaacaagactgctttttcccccctttaagatatatgaggaagcgtgttgagaaatcagagctattaaatattatcatacaatttccttgatttcattttcttgcagataaaattagaccaggaatatagggttttctggaatgctttcatgaaaaaataggtgattgcagaaatgccatgaaataattaaatctcaattatttgtactggtgttttcttaaatgtaatttaacctgtcacaatacacatttttgcttatcagatcacttttattaataggattgagaaaatgttcactcttacttcctcctgctatgaatattgctctcctgttcaccataaatattccctttccttttcttctttctgcagatccatttagcgggcaaaatcagaacactgcgctatgtgtggcagttaatgccacaggtctgggagacccagagcctggtttctgttctagagtcactactttttagctgtatgaccttgagcaagacctttaagttctcttagggctcaatttcctcttccgtaacatgtaaagtctgttatagcacatatatccaagcactactttgaagaataataagatagtgcagaaaaacacacacagccaggtatctggcacgtgggaaatgccactcacgtaatgtgtaatcaccgtatttgtggttatgtctccttagggtaggaaaggggagtgtttaaattcagatccctcagactatcgagaaacatgtttgttgtggagatgactcactttgaaaacatgaacttcctatataatttgtaagtcattttcattggggagcatagtagtgagttgtagataggaattgcctcagcttatagttattgacagctttgcaggtgccaaatacagctctagggactatataatcactcttcagtaaccataggggattggttctaggacccccccccaccaccctctgcccaccttacaataccaaaatctgcagatgcttaagtccctgaaataaaatggtgtatttgcatgtaacctatgcacatcctcccctatacttgaaatcatctctggattacttgtaatacccaatatgatgtcaacgttatgtaaatagttgttacactgtattggttagagaataatgacaagtttttttaaaaaaaaaaatcttcacttgttcagtacagacgcagccatccattgttttttctttgagtattttttttatttggagttgactgggcttgcagacatgaagggctgaatatacttgcattctctactttagccttaacagcgaccctttaaggcaggtgctcttagtatgcgcatttggagaaccatgttccaagtctgttatgtagatttggaaactgagacacagaaaagttagctaactttcccaagatcacagagttaataaaggcagataggtaactctatgggctgttttgcatactgctcactttatgttatgtgagtgagagtgaatatgaaatacaaggtgtttgtcattttaattcttggaaggaggagaagtaaggcaataagagttccaatatacttgtttctaacctaattttgtatgtaatatataatttatatattttaagtcatgcattcattattataaataaagcttctgcccacaaagtactaagttaataatctagccaattttttaatgtatgagcattatttatgtactgaaaataacttttacatcttcaaagtatctactaggaatcattgaagcaaagggtagctatcatttttaaggcaatgatggtatttcatgtctcagtaacagatcacatcttccatgctcttctataaattgttatttatgtgtttgaagtcatccagacaaatccatatcacccccatagctgggcattactgagttcatatactgtattatgattattaaataaactagttctgtacagattcacaactgtccttcaaggtgatatctctacatagccgtgctgttttacaaatcccatcattatgaaaatattaattttttttgtctcctaagtaaagtaagcagtaaacacttgtacttatcaaaaaggacttgttaacatttcacctcttaaaattaacattttaattataagcattggtagttttttgttttgacttgttatttaaagaataagcatgaaattttactgtacataaattatacttcaataaacctggcttttagaaggcaaaggaatgcataactattggaaaggttgagactggcgaagaagtatgcataaattcaaaacggaatttacaaggattttgtttgatgcggtggttagtcttttggaaataggtttaagattagtgcttttacatacataatatatgatttcagggtccatttagagaatatttatctgtatgactagaagagaatgttacaaattgaattttaagaataatgctctaattttacataacgccaagcatgatgtttctttgtttacctaccatattaaaagacatgccatcctggatatcattaatggccaaaaaacttaagacgaaagtggctcttcccccagcatgcagcagacagtctatgaaaaatcactgataggaaaggttagagactcaaaaatctatcactggtaatagattcctattgctaaccagagtccaaggtgagaagctggcattggtgcagtttctgcctgcaagatgccctctgtgggtctccgcagagcagcacgttgtttttctacagcttctctggattatcctgtttggttttgcatacatttattaccatgtcccttgcctcttttcctcctccctacctgcctgccttagctcatctcactgtttttttcagtaacgttattacagagaaagtggatttcagtattcctctctatcaggtgatgcgtcaggtgacagagaaaatcagaatcagactgaaatcagactgctgcctgttatcaattccatctctgtttccatatcctaaaaaaatcaagagcagcaggatgtttttataaacctgtaataccaagtttatgaaagttagctgaatcttagattgtcagcgctaaaaggaatcctgtgggacacttttcacacttggagcagccagcttgtcagagggtcctgggccaggttccaggccctgctgcccgctctgctacatggatcaggtttctgatgccttaccctgctcagagccaaactgtacaacccagcccgtgccttcctgctctcctgcctggatgggaagtcggtctgctgtgaaagtgggcacgactgctactggatgtgaacctgggatgaatatccctgggtagtagcagaagttgaagaattacccaggctttcaggctccaagtcacattctgggaaggcaggggctgttgttggcaatggaaatctggcctgagagtttcagagagccaggttcattaatgggcccacccaagccctggctgtgtgcttgtcctaataaagatgtacttacaacaaccaattccatatgcagatgtgagtgtgggtgtgtgaataacctttttaatttttttttttttttttgagataaagtctcaccctgttgcccacgctggagtgcagtggcacagtctcggcttactgcaacctccgcctcttgggttcatacgagtcttctgcctcagcctcccgagtagctgggactacaggtgcctgtcaccacgcccggttaattttttgtatttttagtagagatgggtttccaccatgttggccaggctgaaactttttaaagtcttcaatctgctttgaggaaacaaacaacctgaaaacataaccaattagttggtggactgtagtgttgtcaggtgattccatttgtgatcctagagcctgagtgtttattttatttcattttaagttccagggtacatgggcaggaagtgcaggtttgttacataggtaaacgtgtgccatggtggtctgctgcacctgtcaacccatcacctgagtattaagcacaacatgcattagctagttttcctgacgtagagcctgactttaatggtggccatggtgggaacaatgatactacaagccttcttccctaataataatgctgtgggaggacccattgttcaattccattctttcagtcgcagcattgcctcagaacctgtttcatgtttatgacaggcccttggctaagggattcagtggtgcctgaagacagggagcttcataaatagatgtaagctcaaagcatggtgaatcaggctgtgctatgagagcttgtaacaggggacccaacagccagctgaacccctgaagaggggcaggagctaaccaggtgaaggaatgagaaggcaggtaccatccgggtgtgagcctggaaggcattcccagcagagaaaagcacacatgcgaaggccctgtggcagcagggggtaaggcccatttgagaaattgactatgcttggagtagtcaccagtggtcccagggaaggtcagaatgcaagcaggggctaccttattccaggcccagtggcccatgttcaggatttttatcctctagtagcaaatgtgaaagggcaggggtgtgatcagattgactttttgaaaagattgctttagactctgtgcatagaatgaggtggagaggccggttgctaggctatttcaggagccagatgagagacagtggaaactcagaccagggggatgatgaagaggttaacaaagttacttagggttgagaatttggcagcacctaagtgatgattagataagaggaggtgtgaaatatcaagggttgtttctcggggttatgctcccaccacaggcaaaataaatacaggatctaaaattaaaaatgcaattctaaatgaccagagtccagcatttatcctctttctctccctctccttccttctttctccttttccttccctctcttcccctgtcataatttttctgattttctggtttaaactcaggcagaaagattgggtacttctaaagaaactttggaaactttggcccataactttgtagatacccaatgctagatcggttcccattaatatgaaatggaattttgatatgaaacctttctaaaatatattgtctcatttatattaaaaagcatacaacttctgagcatttatttgaagctcgctggtgagataaaacatgagctggctgggttgtttctaggtgctaaaccaaatgtccgcttgaattgcggtgttgctgtaaatatttccaggcacagacagatagatgcaataggaaaaacctgaacaaattcttaggatgccaatattgtcacaaagtctccatgcagaatgaagttgtttgacaaagtgtttccctggtgatttggctgcagatgaaaatgtctttggcaataaaatttcatgcccgagtctcagctctgtgctctcatcagtcaacaaatgacatatcaaggatcccttttgctgtattagttaatatgttggcagaaatatgtgaaacattgttattcccctccagttctgtgcatagatttgtttctacctttaaacccgcattaattgtaccaaaatattttgccagctataatttaatactaatcaataggattgccttagaacagagataaaaggttctttattacaagggttctcttacttcaccagtattagaagatataatagtaagggctgctgttttgccatcgtttgaaaatggtttgagggaaatttaaggattggtaaggcaattagtagtgaagcatattttaattatagtaactggataagctgctttcagctttatggattaatacgttattgtttaataggccggagtcacgtgtgattttgatcacacttctcactgtagccacagttttattagcagtggtgttttataacttaataatttatacataatgagttcagaagttccatttacatgatatccaagaaataatttaccccatacattaccactcgtcaacaggaaagaagtccttcaggatcacaacgaaataactgtccgagattgttttgcattaaaggatacttttaataatgagatcattttacactgcattatgttatttctgttgatgccaagtctgggttttacaaagtcatttaaaacacaggaggaagatgaatcacaataatttcacacatatttaataagcatgaattatccactgaagtctacatccattctttaagttgtgaaaaccataaggtgtttgagttaatgctctgttgtagaattttctcgtctagcgcggccctcctccgtgcaccccaccattcccgccaggcctcctcgcatttcagaagctgttatatggacgagattgagctgtgtgtattttaatgacacgtgtgtcatggtttagcttagggtttgcaaagcctctgtatatgctagcctctgggcatccattaccatctccgagaacacagtctcatctcatccaaaacgaacctctcaaagagccccctgtgaggacaccttggggcccctgtccttgtgcggaagcaaagaaactaacactcggtgattgactactttacagcagatgccgtgctagtttatacttgtcattttcctaaggattttttttgaactcataaacccactggggtttcagttctgcaaagtcttttgaggccacgatgtgtgatattgcagaatcttttggcggggatgatctgcgtaagacacaaggatgttaaaaggtactacacacatgcgcgcgaaaaaaaggcattacgttcaaatgagcttggaaaccttggcgagactgttttctgatatgcagttgtacatcatgagtgtccagggagccgacccagcttgcagcatttcccaaacttaattgaccatagaaccctttttggaagagtagcttaacttcaagttctttgcctataaaatatataaatctaaatcaaaatatatgaaaaagtacatcgctacaatcttctggccaccactcaaattttatcagggcagaaaagacaaggtatgttcaggtgatttacaagctggaaagtaccataaaaatgcaacagatgatgatttttttctcctttggtctttttggaaacagtgtggaagaaatgatgtgcccatgctttaattgttcagagtctagggatgcgggtactgttctttgtgttcctttattcttcctatccaactctcctctctgctaggaaaatcactttttttttttttgaggatccatattactaattgcagaaaattgccgttagtcagcgcttggtcttgagttctcattttaagtggctttactagtcatgtttacgcggtcatctaaatgctcactcttataatgcctagaatggcttctcttcataatggggccctatgattatctgtgtgttccctctgttttccatgctctgcttttccagcatggcctaaggtttactaaaagaacaaaactaaaaaacagggagtcttgtgtcttacacagatcatccccgcctaaggattctccagtatcacacatcatggcctgaaaagacttcgcagaactgaaactccagtgggtttatgagttaaaaaaaaaaaaaaaatccttaggaaaatgacaagtataaactagcacggcgtccactcttaagggagtcaggatgggggagcaaagttcactgcagattccccgctgcacaggttggtagatggcaggcccctgcgtaaaccccattttggtccaacctcctgatccctcctgtctaactagtttacactcacagtggcatgttcatgaatgtttactgaattaacagataactgtggatatcataaaagtgctctttttatttcatgtgggggcaagattgaatttcttcatggtttgatttggtgcagttgaaactgcttatggtggcttggagagcagtggcctcagctagctaatttgttaataatgtggtttatctgtaatgctttggttgcaggaaataaaggaacatgttccactcaatacaagcatagccgtttttttattattcattcatttattcagccaatatttatagtgcctgtttcttacaaaagggaataaaatacagaatccctgtcctcatgcagtttggagtctagtggggagacaaacagtgaacagatggctgtgtattgtgcccaatggtgggtgataagaatgtgaggggtaggggatgtgagggaaggagattgcgcagttatagcggatcaaagaagacctcagagacctaaaggatgtgcagaaatttagagaaagaatgtttcagacagtgggactggcaagtgcacccaccctgccccccagggataagcagcttcacacaggagagagctaggagacagatcagataggaggtctcctgcaccatttgaaggagtttggcctttgttcacaaggagacccgaaagcctgggtgggttttaagcaaaagagtgacaagatcagagtaattttttcaaaatgatcactgctacaaggaggtaaaaagggaagcgcagaaaacaggaggcaactgcaatcatccaggcaagagctgaaagtggcttggcccagagtgccaaccacagacaggatgagaagtcgtaaaatgctaggtatttattcgaagcgggagagggacagagtttggcaaagaattggatgtaggttgggagagaaggagaggagtcagggctcactttatattttagctgagcgacttgaagaatgatgttggcattactaagatgggggaatattgagagtgaacagatttgaaggagggggcagtttggggatagttaaaggtgagctgcctccagatatctaagtggagatattcagtaggcaggtggctctaggcatctggaggcaggattgagatcttggctggagatagagatgtgttgttggttgataatgatgagtctggaagagatcacttagcaagtgagtataaaaagaagagaagtacttcatacaccaagcctggaggcaccagcagcaagagaagagactagcacaggaaactgaggaggagcagccagtcatgaagaaaaccgagagggcgcagtgtcctggaaaccaagggagttgagtatctccagaagataaacgttgttcgctttgcccactgctgttgatgactggagtaacattaagagggagaggttgcctttggagttgaggatgtggaggtcctagcaaggccaggagctggctttggtgacgaaatggggctagaagcttacccgtgatgggtacaacatggataagcccttgaagagtttattccaagtgaaggcaaataaattgcaattgctggaagaggatgtagggttaaggaatggtgtttttaagaaaggcagtagcacaatgtgtcttttgtaattgcagttggctaacagagtggggacaatgaggtaggagataggaccagttgctgggacagtatcattttgcagagaaaagggattgggatcttgaatgccagtggagggactggccttggccagagtcccagcgacaggggaaaaggcagaatgtatagtagcagcatggtaggctgctaagggtgtggggaccagacagaagttctctttggagtgtttcggttttctcagtgaaatacgaagcagggttatcagctagctgagagggaggatggaggagaaagtattatcatattagagttttgcagagagaggaaaggatatgaaatagttggttagcagagggatagagaatggactgaagaagaaaagtagaaagatgataattcaagaggtgataactcaagaaaattgaagtttctcttctcattgctgcatcaggagaatttggtttggatattggcaaaagcagccaatattccattgcacatgtataccacaatttgtgtatttcatttgcctatattgggcatgattgttatttccagtaggaggctgttacgaatacagctgctgtgaacattcatttatggacgtccgttttcttcccagaagcagaatggctgggtcatagaataggtatataataacttggtaagaaactgccaaacaattttctgaagtagttgttctgtaaaagtaaccaggcaaatgtttcagccctgaagatagaaaatgagctataataaatgaaaagtagaaatttacaagttagaaatttagatagaatttctatcactatagaaagtcagcttctgtcgtttctacttagccacagctaagtcttagcaaatcttaggaacatcaccgaacatccatggactcaatttccttaggtaattgaggtaactgggtgacctgtaaggtcccttccagaccccacattctttgatttttggtggaattgtgccaaatggtaatggatagaaagacacctctgtgtacatttttatcccatgggagttgagcagcatttaatatactggacacagtaagaaaaaatctagaacataagatgcagaggcaaaaggatgaggctgctacaaagtatatacttttgtgtgaaaatcacatattctttcaaaaaaccattgtaaggtgatacaggactctactcgtgtgtaaaaagttatatacctatgaatagctccaattctgttttaattataacaaataccgggagatgcatttggatggtttgaggaaaaaaaggttgcgcatccactgtttggaatcttgtggcttgttttgaagccagcgtaacaaaacatttgcctctattacttttgcagtactgctgggcaagtgttttgtctgcctgggctctctctagccaggagagaagaaatttctgtttcctcccaccagacagagtcggtagccccagggccatctttgcgctagctctggtctgtaaatgtatctaaataagccttgctataaatctttctctgttaatcttctagctgttcccaaacttcagcactgcctggtgaaggtgtacttcgccaaagactgaggagtcatggttcacttggtggaagctgtctgataaatagaggatgctggaaaagacagattgaacgtcagtgtgagatcgtgcactgccgtaatctgtctttcaggttaatgagaattaggaattgggaggggaaaaccagttggagatagctccgaaccaggtggtgatcagtggtggaggtagatgtccaatcggtctcggtcacccttcggggtccaggggttgtgagatcctgacccacccagggcaggacaaatgccctctgcttgtcactgcctttttggaagggactctgaggagtgtgagcattgaaaagtacacagaagcccatggaatcgtggagttaagacagtggaggtcacttaggccaaactcttgacctgggtggagtccttttcacggcctccctgagctggttgtcgtctggcccctgcttgaatacccccagtgacctgggactcaccacctcaacatagtcactgtataggactcaggcattccagaacattccttgaggactcagtctcaccacaccagtgctgaataacctttcttccatgataagaagaaagactaaagctagcttggggtaacagctctggatgtttttttttcctctccccaggtggggatgggtgttggacacaataagcattttatttctgttttttcttggaggcacaaattaacattttttcctacccaggggccatcataccctaagctgtgctgatttttaaattggtctatagagacaactcgtttcccatgttcggctgatgctctccatagctacccaaaagtccatttatttgtaactctaaagcaatgactcccagccacagcaatttcacacacacccccactcccgctggggacacttggcgctctctggagacactttggttcccacagctggtgtgggggtgctattgatatccagtgggtaacagccgggggtgctgataaagaccctacagttcacaggacagccccccaaaacaaagaatgatttgacccagaacatctcagtgccaaggctgagaaactctagtctaaaggtaccataaatagccaaccagtaggaccatctgcatttatatttgtcttcagggtttttttttaaattttgttgtttgagatgggatctcactcaggctggagtgcagtggcatgatcttggctcactgcaacctctgcctcccaggcttcagagatcctcccatctcagcctccctaggaggtaggacgtgtacagatgtgcaccaccacacccagctatttttttttgtattcttggtagagacgaggttttgccatgttgctcagtctggtctcaaacccctgagctcaagtgatatgcccatctcggcctctcaaagtgcttggattacaggtgtgagccaccacactcggcctgtctttagggttcttacagaagagtttgtgtagaagcaagcagtttgctgtagaaagaattcgtggaaaatcaggtgttgtggggcatggtggttgtgataggatgcaggggcactgcagtttgccagctttcaaccataactttcctcacagattggtggatatctttgaatcataattaggagcttttttttaaaaggtctctcgggttttgtaagacacgtccaacttattactaataaaccaaggaggtatctgttaccttcaattagaggagaagacagcacggagtcccaatcaaagagttttaaaaggccttgttttttcaatagcttattcatccagtttaagaaagcaatttctttgctgtagtttatggagaattctaaatctggtaaatcgtttattgcttcataggggtttgctttggttgatctcatgtatgtaccagggaagaccaaaaatattttttttgaaaaaacatgtgaggtcatgttttttctccttgactttagaagacaaagataatgatgcaagtgttgctatatggtggtgagatgatgacagacagaggcactgggtcattcccacacccgctttctggggtagggcccatgctgagagaggaggtggaagagcttgtcagtcaaggcagcagctaatttcactgagctccaggactctacggactcttccagaatcaatcacatttgccatgaacatcaggtccccttgtcccccatccccatgaccgagaccaatccaaacttgaaaatggatgaaatcaacatttctggggtgccccctctgtgctggccttatctgtggcttggtacaagatcctagaatgggaacaagaggtgtgcactccttagggacaaagaagttggggcaaggaaggagtcctgggcctaccatgtgctgtcacttggcaacataagaccagcagtataaacaaaggactgtgggattctgaattgtcccaccaggtaaaatcctctttttcttttctggcttgtaagcataatgattgagtgacacttttcacttttaaaatgaaaatggcaaaacttaaatgagggagtttttgttaagtcgtggtggcccagttggagtttaaagatgttctagggcacagtacagggatcctcctccaattgtgtgattattttttcccccatggtaaaagtcacgccgtgtttcccctccttgtgaggctcatggaaacacacagccgaggttctgatggtggccaccgctggacaagcgcactctctgagatgtggccatgtccctgccgtgctaacaggccccagtgccagtgcgccctgggcttatttgtggcttaaatcatctcagcaccctgaattcttccctctggagacacgctcggaaccgtccccccaattgatgacattgcagctgtcatgcaagagcttgccttcacatctctcctgtggaacgtgacagttttctctgtgatggccaaattaattattagaaatggtttgctagcagacagttggatgctgattacgattggaaccttagggaccctggaacccaaatgtgttgatgtttgttgttgctgagaaaaatgaaaaaccataaaataagaaagaaatgtttttaaactgaaaacaatgcagattaagccaggaaacttttggactgagttaactgagatctgagtgaaatctacccaaacccttgctcgcagtgagaaggtttagagaagtggttaattagttgctactttctgttagagaggggattgagcttggctatttctatgtaaagcaaaaagactggcattgattaaattggagatgacatttgggaggtgttctcagaatatctaagtttgattatctaatttgccttcatactgtgtcctgggtttgtgaagcctttctagcaagtaccacccaggaagaaatattttcaattaaatggatcatgaccactgcagaaggaatcatgaaacgcacctgtagcgtggggtcatggtgtgaacaaagctgccaggctcacaaagagacagtctgggagtcggctgtgctaatgccagctttgagcatcatttcactccttcccatcaacagttccattaatgagatacagagatgaaggcaggcagatacttcatggagctgtgtgacgcaagattgatgctgtcaccagctctcattggaacgaataagaaagaggccgacagacccttgatcattagaagggctgataatctattgtgagtttgtcaaaagaggaggaagaagatcaaatattagtggagaaagaacacagagtaaagaacacgatggaaacttcctaatcattttgtgtagttatgaaatgggtagctttatttagcaacacatatgatatgatacaggcaatattccaagcatgcattctagagtaatctttaataaataagtaaacaaaggccagggcggtggcttgcacctgttgtaatcccagcactttgagaggccgatgcaggaggatcacttgagcccaggagtttgagaccagcctgagcaacatggtgagaagccgcctttcaaaaaataaaaaaaaaaatttaaaaactttaaaaagtaaacaaagagcatccataaatacttttttggggattccgtgggattttttaatagtcatttttttctcaaagagagttaagtaatttataatttcttgttaaatgagggtggctgttataacagtataaaaaataagttttgtctaatgttgcagctcaatcgttattcatcatacaggactgtctggtggcagacacagaaatttccccttagtgtcacctgtggatgcagcaggtcagtgagttcccccacttcctttagagacacgtgaaccactctaaatactgtcatttctcagggaaaatttacacagaggtaatgacagatacataaattccattgttccagagcagaacaagtatggttgagggaggaatgatgttataagaaactgctttacagtccctgagattcttttccaattacatttagggttgaattttcagatactttttgttgcatccaaggaaggaattttaggggaattatatttattaaatctcatttttctttgcttcatccagcttttccttgatacttttaattcttaccatgcagtaattcagtgacctcaattctccctcccctgagccagaaaggaaagccctctgtgtttaaacagactcagagcctcctgcctgtcctagttctgcagaaaggaagctgcacctttacagagcccctcttggcacaggtagagattggcagttcggtcctgttcaaaaggttaaggagggtaggggccggttcagcagcataaacatctgatactcaagtagggtctcccaaacagcagcatcgatatcacctggtaacttgtcagaaatgcagagtctgaggccccaccccagacccaccgcatcagaatctgcatgtgcacagggtccccaggcaattcctatgcacactgaagtgtggagagctctgcaggtctagcaggctcccaggcagactccaagctgatagacacaggaacacagcctgagtttcactccatggcagcggtgttgatagtgctgtggccaagagtgatgcatttgaggaatatatgaggaatggaggacagtgaggagggatgaaaatgacctgaacacacaagcaaagctgtaaaagtgaaaaatctctcttcatggaccttgctgcttgtgtggttgagggagaatttttttcccaccgttggagaagaaattcattctacattgattgactggaaggtcaaacaatgaacgaaaagtaagaattaatttaaaaaaaggagagagagagggaggcaaaaacttaattataaaccaaggttctcatgttcggctaaactacagggcactttgccccatattttttccctgtaagttcacatttcttataaaacaactacaaagtaaaaaaatcgtatgtgtcatataaaacaattatttgtgtctcttgttgagaaaaaatatacagcatgcattaacaaatgcctttcctttctcatgtagttgtttattgagtttaaagtgtaaaatttcttgcagtttgtttattctaactaataagtgaacttgacacctcactttcacagaaagttaaatgatgtggtcagtgatgtttttaagatttatatcgaaagaaattaagtattaggtacacgacttaaattgattagaaggtaaatcgaatctactgagaagtgtgagcatataagtatgttagcacgtggtatgaataatgtgttctgatatggaggaagatgacatagtctttgattttataatgcgctgatattcttacagaaggtcaaagcaaatcaaagtgttgcaagaatgttcaaaactatccaccctaacttctaggatcatgttctccaaactgctaattaatgaaaagtcagcttcatatattgagatgtttaatcaattggcagattgttgtcaataaatatgtgtcgtaagtggtttgtaatagacaggctaatgaagtaccctctgtgagtgtcagagctatttggaaaaatctctctcccttctgggcggtttgccatacgttattagtctccctctaactcaaggaagagtgcccttcaacatcgctggtctcgcctctggatggaggagctggagaagcagaaagtaaatttcattttctactagcagttagtcaagcaacaggaggcggaaagaagggtggctactgataatattaatgatcatcagagaagccaacatttcttaggcagttgcttctatatgtgctggactccgcagtcagtaccataattcggttacttcttttttttttttttttttttgtattgagatggagtttcactcttgttgcccaggccggagggcaatggcgcaatcttggctcactgcaatctctgcctctcagattcaagcgattctcctgcctcagcctcctgagtagctgggattacaggcatgcaccaccatccatgcctggctgattttttgtatttagtagagacagggtttcaccattttggttaggctggtctcgaactcctaacctcaagtgatccacctgcctcggtctcccaaagtgctgggattacaggtgtgagccaccatgcctggccaataattgttacttcttaatcttcactctatgagaaagattctgcaacctctcagatccttcattacaaacatttttgtcatgccactacaatgctgaaatagatcttgtagctaacataacctactctacacgtaattgttttaaaagtcattataattccccaactataacataatgaagaaataaagggaatagaattgactgttgagtacattcaatatataagttacttgtttctggctataacggagggaagtaatagacatttgcatctgtgcatagaaatcctgcgaatctaacagctgtaactgcagactgatagcgaagtgatgttctagctactcacactagaactggtcgtcctgtcagtgaagtgatattataaattggtgaatacttcttagaaaagttccccaaattcagtctcacctcatttgcacaggaatatcagtatacattcttactggccagaaaatgctttgcattcacatataaaacagatttaggttctaggcacaaatatttgtaaacaggattttcgtttccacgactacccactgggacatcgagaaggtatgcagcctgggagaccactcccaatgctccaggcctggcttattcatgaaagacatctggcatccaaaccttcattcaataaatactagtagaatcccccatacatgagatcgatcatgaactgccctatagatttccaaaagtctacagtgaagcgttgccaccccatgagaccaggccactaggattttcatttctccttttcagatgtggcaactgaagcttcagtagtttccccaaagacaaagagctaggaggtagaggagttgggattcagactctgatctgtctgaccccagaatctctgcatttaacccactgttccatcctccccagtgcatccagacaggccaacattgccacagaagagcccgagtaggcttactggatcattttttagaattgtgcttatgaaaaggaaaaggattgatcaggcatggtggcgcattcccataatcccagcactttgggaggccaagagttcaagaccagcctgggcaacatagggagaatctgtgtctataaaacataaaaaaacaagttagccaggtgtggtggcatgcacctgtggccccagctcctcaggaggcctaggtgggaggatcacttgatcccaggagttcaagaccagcccagacaacatagggagaccctgtctctacaaaaaatttaaaataacaaattagctggacgtggtggcatgcacctttagtcccagctattcaggaggcgagatgggaggatcacttaagcctgggaggatgaggctgcactgagtcctgatcgcatcattggcactccagcctgggcaacggagtgagaccttgtctcaaaaaaaaaaaaagaaaaaaggaaaaggattggttgaaatgcactgagcgcccatcccatctcttgccagctgtaataccatgccccagtgttttgtgtatgttaccgaatgttcacaacagccctgcagtgtagttagttgtgagtaatcccttttcacaaacaggaagcctgagtctgagccctttccccagtcaaccagcctatgagaagaactggattgatttcaatcttgtgttgacttcaaagcccaacctcttgctcctactccttagaccagaatgggccctcaagaggatgggtgtgtataacctgttgatgccattcacccacctcgtcttgatttccgtccactttctttctcattacctgataagtaaggtgagcaaataatttattggccaggcaaagacatttttgagactgacaggggacacttccaccaggacattgatgtgggtcactcagtgatgcctgtttcagggccttgaagcaggtagcagccttaccaagtcatggttgatgcttctgtacagagttggaaacgtgtcgtgggtttcccgatcagaacgcactggggaccctgccgtcacaggaacaccgctttgcttctttcagtgaatgcatgattatcttgaggatggtgagatttttctgttgagatcttttctagtttaaaaagtccccactgttttcgtgaggcagggataggtgagcctccggccatcatgagagtgggtaggggcgggcctggtgaagacaaaccagaccccacgagacagaagctcttcccagttggtgactgggagagagtctgcttcccaagtccagtctggctcacttcctctcaggagcaggacaagagaaggcttccttcagcttacatgaaaagcttgcagtaaaagagtacaagtgacggattctgcctgaatttccccaagtttctgcacttgtctttgtttattatattaataaatactatgcagctaatgttcccatctggcagggcagagaaaagagcataaaaatgaagttgtggctacatcacttaaatactaatgaaggtgatacccacttggcatggtggaaaggtgggtctttattttagagttcttaattaagaactgcaaagtgactaatattaattaggaagccagctgtagccttcagtttcatggtatatttcttcttaggaacctgtgacgggagtcagtctgaactttttttaatcaatcagcccatgagcaattacctattaaatataccttgtgtgcatgggaccagactatgtggacagagatttgtaagattctgtctttgccttcagaatctccacctaatcaaagagtgtgcacagatagagagccagtatttcagagagagaggtcaaagcattttcacaacactatgagtgaataagagaagtgtcgcattatgggggtcagggagcttttcaaactacactggtgcccttcctgctctggggttgcagtagtgagctagtgtaagtgatgggagggtatcatacccctgggagtctggggcacaagggtggttacggaccacctggcaggctgaaagctggagttcagagggaggattgacagtcatgggcagaaatagttgggatggctagaactgggctctcaggaggagggatcatatttccaaaaggtgaggagtgatgggcagccacagaggtggaaggaaagaggttagggcagtgggaccagaaagggaagtaactggcattgagctgggatgtctactccagcccttcagctctcagtcggtctaccagccattacattattgatattgttgactctgttcacacttacagacacacacacacatgtgcaagcttggcctcctgcagggacctgataccctgagctagagggcggggaagtggtcaaagaggggactcaatacactatgtgtagttgacatgaccacccagcacgtcataaaattgtacctagaacaatacctagttatgggtaatccctttttacaaacagaagactgaatgtgagcccttagactgagaagcagaactgggtttcatactcattttgacttcagagcccaaggtctaagatctaaggagccaggagcaagagctcaaaaagaagcaccttaaaacctatgttttaatgtctcttgacactgatgtattaatatccactgaattctagtttcttgaatctcttgtaactggagaagggttttatgaagataagttgtaatgaggggccaacaaacatgaaaaaatactcgacagcactaatcattagagaaatgcaagttaaaaccacagtgagatactatctcacaccagtcagaatggctgttattaaaatgtcaaaaaacaacatgctggcgaggctgcagagaacacggaatggttatatactgctggtgggaatatgagttagttcaatcactgtgaaaagcagtttggagattactggaacttaaaacagaattaccattcaacccagcaatcccattggtgggtatatatctaaaagaaatcattctcccataaagacacatacactcgtgtgtttgttgcagcactattcacaatagcaaaggcatggaatcaacctgggtgcccatcggtgctggatttgatgaaaagaatgtgatgcatatataccactgaatactacacagccataaaagaatgagattacatcctttgcagcaacatatggagctggaggccattatcctaagcgaattaacacagaaacagaaaaccagattactgcatgttctcacctataagtgggagctaaacattggtcttcatggacaaaaaaatggcaaccatagaaactgagggctactagaggcaggtgggagagagggagcaaggtttgaaaaactattgaaaaactattctcagtacatggtcaatgggttcattagtaccccaaactcagcatcacacattttgtccaggtgacaaatctctacatggaccccctgaatctaaaatgaaagttgggggaaaaaaaaaagattagaatgtactttttcttgatttacacagtgtgttaattattacagtttttttcaagttgagttgtagtctcacatgcagctctctcctaatttcatacttagacattcagatcattgaattgtatctgcaaaattgcagttcttttaaattagcttgccagagcgctgtgggtcctgttcaggggccctgaggccaggcagtctgtgactctgcttgctccttgataaactttcatgagtagcatttattttaaatcatccaagaacacctcaagggcaaggatccttaaccttgatcctgggccgtggtgattcacaaaggcttatcctttgtagatttaggctcatctttcagggagctcagtttgatatgcttttctctcctcgaactctgccattcaacattttttttcccatatctattctcactgagtgctaattttagttcaggttgcacctgtgtgtatgtgtgtgtgtaaaccctctgtagccctagtttatagcctttttcaataaaatcacatatccagagaaattgtttttccacatgagcactttttcagagtgttttccagaactctgcctgctgttctaaagtcaacatcagttgccctctttagaacgcttccctaatgcaatggttctgaaatccctgaatatattgttacaagcacagttctcttcagaaaaagaaaccttggaaatggtggatctatgcttttgtttttcattttggagcttggagaagtttgttgacctcacgtcatcatcagcctccagttgaatctgttaaacagccaatgtgaatagtatctatataaaaacacaaagtaagcacagaaacactttttcaggggaggtattttgtcatattgaaacagcacctgtattggggttttaaaattttaatttttgtgggcatttagtaggtatgtatatttatggggtacatgagttgttttgatacaggcatgcagtacaaaataatcagagcatggagaatggagtatccattccctcaagcaaggcacctgtattgttataatgtttttcctttaataagttcagttctcaaatttatttctaaaaaactatagcagtattctaaatgaaaactaggtttaatttgctatcaataaaattacatacatagtcattgatatggtttggctgtgtccccacccaagtctcatcttgaattgtagctcccataatccccatgtgtcgtgggagggacccagtgggaggtaactgaatcatgggtggcaggtttttcccatgctgttcttgtgatagtgaataagtctcatgagatctgatggttttataaagaggggttccccagcacaagctttcttgcctgccgccatgtaagatgtgcctttgctcctactccaccttccaccgtgattgtgaggcttccccaatcatgtggaactgtgagttcattaaacctctttttcctgataaattacccagtgttgggtatgtctttcttagcagtgtgagaacagactaatacagtcattaaaattgacaacttgcatcagtgtacacatagaatcttctcatacaacacctttgggaaccactactggaaggaaatgttacatttcagggactgaggctgggtacgggaaacagagccagtgtccatagtgttaatattcgtaggggcctcagatttaattttacctgtaagtttttcttacaccagaaattttcagccttagcactcttgatgttttgggccaggatgtcctgtgcagggtggcatgttcagtggcatccctgatctccacctgctagatgccaataacacacccccacaggcgcccaaggtgtgacaattgacaaccaaaaatatccctagacattgccaaatatcccctggcagaggcagaattgcacaggttactactgtgcctgtgtcacaaataagtcacacataagtcattttgttgctttaattcttctgtgtgtccttggtcttaaactgttacttggttaagtacgcagattgaaaaaacactgcaagggaattttttagagtctctctgcacctattctggtttcaggactgcccagtttgcattgttgttcaaaatggaaagaagagagggaggaattttttacaaaataaaattcactaccatttttgagacttttttttttttttgagatggagtctcgctctgttgcccaggctggagtgcagtggcgcgatctcagctgactgcaagctccgcctcctgggttcacaccattctcctgcctcagcctcccaagtagctgggactacaggcacccatcaccacacccagctaattttttgtgtttttagtagagacggggtttcaccgtgttagccatgatggtcttgatctcctgacttcatgatccgcccgcctcggcctcccaaagtgctgggattacaggcatgagcgagacttttttttttttttttaacattttgtacatatgccagtaactcccctcccgcaaaaatggaagattgtcttgacctctcgtgagacctgctgaggccacatctggttcccccactgtagaggtgagttaggtctccccactgaatgtcagttcccaaagaaatctcatgtgtaaatgaaagagcagatcctccctcccctcctcactgttttttgcttatatgtagatgtgattcctttcaagaaaactccgtgagaaattacttcactatcatccactattgacatcaacagcagcctacattttttcaagatacttaaagtgcattttcgcttttaactttcacaacactttaatgttgctggttaatattattgatccctacttttttatgagaaaaactgaacctcagataggttaaataacctgctcaaagccacaccactgacattgctattctgataaagcagaatatttgaagcagtttcccccaaaacagagcaatgttcacgttaattatgaaacatagcatgaattcataggtagcctgtcaataattatgagtatgtggtatactgatgtcataatttttatataaatgtataaacctgttggcaccctgtgattgttactggtttgtttttttaagtaccttggatgaaaacttgaaagaaatatacgaaaatagaagcagaagttatgtttaagtgggatacttctgcagttttcttttgaactcccttgtgaatttctaaatgggttgcaatatatttttacttctttggaaaatgaaatttgtaagttaaaagtgaagggagatagatatagctaacataactgccaaagttgctttttctctgtaactctagctaagaaatgaccatattctgtccatgtgtccataagtctaggctcaggagtctttcagagtttatttgatgtaccattgagctgagggctctgtcctgccaccttttgttcaaggaaacacacgaggcacttccttagggaacccagtgaagatacctactgatgggaagcaggacagttgattcattccctctgtttctgttttaatgctacactggggtgagattaagtggtacctcccaagagaaagagcagggaacccgatgtgcctagattggttcactgtgaatcacagcagttgttcccgttgacatcacagaggggacattgatggtagatcatgtcaccatcagctctccctagtgaagactcctatctggaaccacgtggagaagactgtgaggtgaaaacatgctactctctgtcacatactgccaggtagatgcttgctgctggcagaaggcatagaatattttgtaaactacgtgagtattctatcaagtaatatttttctgaagcaggcttccatctgtcttgccattcatttttaatttcttagcacttcatagtagacgtgttttgagtattttggtcagaattgtaaacattgtcctctaagggaatcattctcaatgaggtgctaagtacctgatgttcagtcctcataactactctattaggtagcaggtggaatgcccattttatttataatttttttaaagttctgggatacacgtgcagaacacacaggtttgttacataggtatacatgtgccatggtgatttgccacacctatgaaccatcatctaggttttaagccccacatgcattaggtatttgtactaatgttctccctttccttgtcccctaccccaccacgggccccagtgtgtgagttcccctccctgtgtctttgtgttctcatcattcaactaccacttatgagtgatagcatgtggtgtctggttttctgtttctgtgttagtttgctgagaatgatggcttccagcttcatccatgtccctgcaaaggactttaactcattcttttttatgggtgtatatagtattccatggtgtgtatgtgccctattttctttatccagtctatcatcaaagggcatttgggttggttccaagtctttgctgttgtaaatagtgctgcagtaaatatacgtgtgcatgtgtctttatagtagaatgatttataatcctttgggtatatacccagtaatgggattgctgagtcaaatggtatttttggttctagatccttgaggaatcgccacactgacttccacaatggttaaactaatttacactcccaccaacagtgtagtagtgtgcctatttctccacagccttgccagcatctgttgttccctgacttttaaataattgccattgtaactggtctgagatggtatctcattgtggttttgatttgcattctctaatgaccagtggtgatgagcttttcttcatgtttgttggctgcataaatgtcttcttttgagaagtgtctgttcatatcctttgcccactttttggtagggttgttttcttcttgtaaatttacttaagttccttgtagattctagataatagacctttgtcagatgggtagattgcaaaaattttctcccatttgaaggttgcctgttcattctgatggtagtttcttttgctgtgcagaagctctttagtttaattagatcccatttgtctattttggcttttgttgccattgcttttggtgttttagtcatgaagtctttgcccatgcctatgtcctgaatggaattgcctaggttttcttctagggattttatggttttgggttttacatttaagtctgtaatccatcttgagttaacttttgtataaggtgtaaggaaggggtctggtttctgttttctgcatatggctagccagttttcacagcaccattaatgaaatagggaatcctttccccatggcttttgtcaggtttgtcgaaggtcagatggttgtaggtgtgcggtgttatttctgaggtctctgttctgttctattggtctatatatctgttttgataccagtaccatgctgttttggttactgtagccttgtagtatagtttgaagtcaggtagcatgatgcctccagctttgttctttttgcttaggattgtcttggctatatgggctcttttttggttccatgtgaaaggtaaagtagtttttttctaattctgtgaagaaaggcaatggtagcttgatgggaatagcattgaatctatagattactttgggcagtatggccattttcatgatattgattcttcccatccatgagcatggaatgttcttccatttctttgtgtcctctcttattttcttgagcagtggtttgtagttctccttgaagagttccttcacatcccttgtaaggtggattcctaggtattttattctctttgtagcaattgtgaatgggagctcactcatgatttcactctctgcttatctattattagtgtataggaatgcttgtgatttttgcacattgattttgtatcttgagactttgctgaagttgcttatcagcttaatgagttttggggatgagacaataaggttttctaaatatgcaatcacgtcatctgcaaacagagacaatttgacttcctctcttcctagttgaatactttccttctcttgcctgattgccctggccagagcttccaatactataggagtggtgagagagggcatctttgtcttgtgccatttttcaaagggaatacccgttcagtatgatattggctagagtttgtcataaacagatctttttgagatatgtgctattaatacctagtttattgagagtttttagcatgatgggatgttgaattttatcaaaggccttttctgcatctatggagataatcatgtggtgtttgtccttgattcagttaatgtgatggattacttttattgatttgcgtatgctgaaccagccttgcatcccaggggtgaagcctacttgaccttggtggatacgctttttgatgtgctgctggattcagtttgccagtattttattgaggattttcacctgttgatcttcatcaggaatattggcctgaaattttctttttttgttgtctctctgacagtttttggtattagcatgatgctggcctcataaaatgagttgaggaggagtccctctttttctattatttggaatcatttcagaaggaatgatattagctctttttgtctctggtagaatttggctgtgaatccatctggtcctggggttttttttttttttttttttttttggttggtaggctattaattactgcctcaatttcagaatttgttattggtctcttcagagatttggcttcttcctgctttagtcttgggagggggtgtgtgtccaggaatttatccgtttcttctagattttctagttttagtagaggtgtttatagtattctgatggtagtttgtatttctgtgggatcaggggtgatatcccctttttattttgtctatttgattcttctctttttctttgttagtctagctagtggtctattttgctaatcttctcaaaaaaccaactcctgggtttactggtttttttaaagggtttttcctgtctctgactccttcagttctggtctgatcttatttcttgtcttctgctagcttttgaatttgtatgctcttgcttctctagttcttttccttgtaacgttggggtgttgatttcagatctttccagcttactgatgtgggcatttagtgctataaatttccctctaaacactgctttagctacatcccagagattctgatatgtcgtctctttgttctcattggtttcagagaacttacttttttctgccttaatttcgttatttacccaggagtctttctggagcaggttcagtttccatgtagttgtgcagttttgagtgtttcttaatcccaagttctaatttgattgcactgtggtctgacagactgttacgatttcattcttttgcacatgctgaggagcgttttagttcaaattgtgtggttgattttagaataagtgccctgtggcattgagaagaatgtatattctgttgatttggagtgaagagttctgtagatgtctattaggtgcacttaatccagagctgagttcaagtcctgaatatccttcttaattttcggtcttgttgatctgtctagtatggacagtggggtgttaaagtctcccactactattgtgtgggagtctaagtctctttgtaggtctctcagaacttgttttatgtatctctgtgctcctgtattgggtgcatttatatttaggatagtttgctcttcttgttgcattgatccctttaccattatgtaatgcccttctttgtcttttttgatgttttttagtttaaagtctgttttgtcagtgactagaattgcaacccctgcttttttttttctctccatttgcttagtaaatattcttccattcctttattttgagcctttgtttgtctttgcacgtgagatgggtctcctgaatacagcacaccaatgggtcttgactttttatccactttgccagtctgtgtcttttaactggggcatttagcctatttacacttaaggttaatattgttatgtgtgaatttgatcccatcgtgatgctagctggttattttgcacattagttgatgcagtttcttcatagtgtccttggtctttatattttgttatatttttgcagtggctgttacaaatttttcctttccatatttagtgcttcctcaggagctcttgtaaggcagggaatgcccattttagatatgagtaaatgaggctcagacctgttcacgattcttgcctcggtggctctgcatggtgatctattccttagtgagtcctcttgaatttggggtaagtctatttattgtctgtcatctaaggcagcttgctttttgtcttctggtgcatatcaaaaagtggctgtttcctcttttaaaagcttatttttaatttttgtgggtacacagtaggtgtatgtatttatggggaatatgagatactgtggctcaggcatgcaatgtgtaataatcacatcttggtatattgggtatctatccttttgagcatttgtctttgttacaaacaatccattgatactcttatttttaagtgtaaattattgattacaattctcttgtggtggggggactatagtgcctcatttaattattgttcattctatttttttttttaaccattaaccattgctacttttcctcccagccccctactaccccttccagcctccggtcaccatccttctcctctctatctccatgagttcaattgctttgatttttagatcccacaagttagtaagaacatggactacctggttcttgatttaacatctacaacattttcagattatttttgcttgtttacagtttttatatgttatacctaatttgaaatttagatattggtgaattaactgctaagcatgattatttccattaagtacgggggagctttgcttacctactttgtacttcttgttcctaaatgttagggttatatagctcatctcagcactaacattattccttacccatgttttgaacttttatttttctggcgttaatgctattgcccacaatccctgcgagtacccctgaatccgacccagtagttttgccttgtaacctccaattcccaaggaatatagcctggcaatagattgtttcatgtatttttacacacatgtgatcttcatatccatcagtagttagtcttctgcactcaccagaagcaagatgtcatgtctggggaaaggtttgttttttttgttttttttttttttaaagagctgtagacattttaataaaagtttcttctcagcttttctctgatgcatatcaggaggaaagtatagtaacagagaatatagcattactgcaacatgcctgtctgaatacatttcagttcattgagctagatttccctgaaaagggaacattcccagccaagtctgccctaaaatcacaaccaaggtggcaagcccagattcttgatgtctgccagtgtcatttttgtaatattttattctccagcacagtggcaaccaggatcagagctaatagtctaatcaaaacgaaagatgcccaggctcagatggggatgggatgaagccctacaccaagttagagtggtgaagtccactagtgtttctgaacaaggtgccgactcttggcatgaacccacacagtctctgaaccattgtgctggtcatgaccactgaggcgtggcaggaaggtggtctctgtggagactcacagcctgcttacaagcaattccaggagcaggaagcacagagacatatggaaattccactctcatgcttaatatacaacgtgcaaaatgaatttttcatattggcttttttaaaaaatggaagagttccagctttgcctcactggtgtgccttttggagttagtgtcctttaaagcagccagagggggaataactgtaatgtaagcagagtggtgtttgcaagtgagagctgggggagaggcgatgatgattttggaaacattattctgggtgttgaattgaacaaagagttattactgaaggaaaaaatacccagaaatgcattgttaatgctctctcagatttgggcctggagaaccatactgtgaactgagtggaagataaatagagaggaaaatagcaaattaaggggacaaataaccagggggaagaggaggggggaaggttgcctgctggcatcaggagaggagaatatataaccagtgtctgatgcatttccttaagaatcagtgtgtttgcaaattgctccattgcatcttagcagaatctaatctgggtaacgaagagctgactagcgaacatagttggatgaattccccaagtactcctgaaatataacagagcaaggaacagtataatgaaaaataacagagagagtagctggaggcttaacttatgatcagtgttcattacaacaaatgacattttcactgcagagttaccgtaagattattgactcttacgtaatatggttcccatctgaacagattcgagaacagcttagcctgtgaatgggagagctgcagaggactgaagatatactcagtccccttattcatgttttcagttagtccttgggagctgcctgttcaggaccatggacagagcaaaaagagtttgcaccttcctccaggcagaatcttggtgattgtctttggcaatgactggcatggtcatgtgtaatattcagtgaaaaccaggctcagaaagtgactaaacttgttggtagtttcatatccaaggcctcctccttatgttctctgccatttgctattttcctcaagcatacatattgcaacatttaaaaaatatatatctctttggaaagaaacagtgttttgtctaaaacgttgggcacacaaccataaggcatattgcaactctatggcttcaaccacatttgaatggacaaccccagttctgagcgtagtgtggcattgccttggtttattgagcacctgtttgatacctgctgagcactctgtatttctgttattttgtcctcccaacaaccctattgagttatgtgctattattatcagtcctgttttatggaggataaagcacttttatcagagaggttaggtaacttgtctaagggtacccagctgccaagaatcacgaatgaatttcaaagtcatttctaccagtctgctgtacattataactttcacacaggtgctgaacataaagagagattcattcatattcattctctctcactctctctcgctctctggaaaagcagcctggatagtaagtctatccagaagccttgctttcacccagtattcatgagtcataccagcgttgcttgctgtgtattttaaaagttaactctatacaggtgtctcccatgagaaagggtttactgtcactattagctggaggtgcagatgtcagcccccagtacatgggagttagaagcagagcaagagaacacaaagaggccagtgggtgaggggctgtcttgttgcagggaaagaagcaaagtggtatttggaaacaaatcaacagttgtcaaaagaataatgaagacatctatgggaactcagtagtagcgtcttcggatctcaccttttctttagttttcagttgtgtatttctaaattttatgggaaaaaaattcctcaacaaagaatggggaagttaaaaaatacagttagccctattataaccaggggatttctaagcagtttattgccttgtttataaaagcctgattgggacgtccctcctcctggccactgcagcctattctggagacttccctgcagcccgtcttccctggcaatgggcccagaggctagacgtagtgtggccactcgagaaggatcacagctgagtgaggaagtctggtccaccctggaaacggcaaactcatgaatgcacccaagctgtagtcactgctgcttgagcccccagggagggcctcatggataatgcactctagccagccgggcgctggggacctttggctcttaaagctgcttttatgtttttgtgctttgggggaagagaaggactgaacatattttctccaaccaagtagcatttacgggcttcaggagttattcattttggcttaaaaacctttccaatatcacaactattacaaataaggacattgggaaaatctctaggtaaacgggactctagataacagatttcctgtgtgtatccttccttactcgaaaccagcagtttccagcctttttggcaccaggcaccagttttgtagaagacagtttttccatggaccagcagggttgcggggagatggttttgggatgtgtcaagcactttacattatagtgtgccttatttctattattattacattgtaatgtataatgaaataaatatacagtacaccataatacacaatcagtgggagccctgagcttattttcctgcaactagacagtcccatctgggggtgatgggaaatagtgacggatcatcaggcattagattctcataaggagcgtgcaacctagatctctcgcatgtgcaatggggagcagctgtaaataaaaatgaagctttgcttcctcgcctgccactcaccacctactatgcagcccagcttctaacaggctgcggttaggtacctgtccacggcccaagggttggccacccgttttctaaagtattaaaagtaaccaagtgccaggatgacaggaaaggggccgtcagcctttaaaatgtctttcatctaagtacaagaaggtggctcaactccaccatattcagcttgtctatatctgctgtgcagtagcatagccaccaactataggtggctcctgagctgttgaactgtagcttgtctgacggacagtgtgctctaactctaaaatactcaccagagttcaaagacatagtactcaaaaaatcattaaatttatgtaataaatttactaaattattcatcatcaaattacagataacatagatcatgaatcatttttaaattgatgacatgttgaaatgatattttggctatattgggttaaataaaatatgatattaaaattaattccatccagtcttttttacttttataatgcagctatgagaaaatttaaagctacattcatggctcaaattatattttggacagcgctattctgcagagatatgtggaatatggaatgtgtctctgcaaattggacgtactaatgtgtgtttaagaagattttagaaacagcttatgagaagagaacttaactcactcgaggtattcagtgagcaaatactaaataaaagagggcttgttttacctttttggggagatatgttggatggaaatcttcttggatgatcgtttttcagggaagaatacttttccatgagaatattgttggggtagtaggagacgattgttacagaacatggttggttgacatttgaaaataaccatggtgcacactttcctttggaatgttccatccagtgtcgtcgtacggggcccgggaggtgcttggctttgcagacacctgctcctctgccatctccaccccacgcttttacttccacctcgctttcaccagctgtatttagcatgctctagcaccttccaggggtgttttgtgggtgagattcttagatgaaacactttggattcttggatgctaggggctgttatgacaagcttcggctcttccctccccacccacagccacagttttgcttgcagcctacggggcctgttgggggcatgaagcagctaaggctctcccctagccagaggcagctcctaggtgaggcagtgccagggtcccactcaattccttgctgatgcatggaatcttctcatagatcatagacatctttatttttaagctttttgcacttgcagaccatacatttttctgagattcttaaaaatctgattttaggctgggcaccgtggctcacacctgtaatcccagaaggtctgaggaggaggaggtctcaggccaaggcaggaggatcatttgaggccaggagttctatattagcctgggcaatatagcaaggccctatctctacaaaatatttaaaaatcagccagacatgatgatgcacacctgtagtcccagcactttgggaggctgagacaggaggatctattgagtccaggagtttgaggctgcagtgagctatgatggcaccgcagccagggcaacagatcaagaccctgtccctaaactaggaggaaatggatgaaaattattaagtctgctgaatctacccagggctacaagtatttttttaaactttaaactcttcattctttttcaggattttttttttccaaaaaactcaaaaatgtgaaagtgaaaaaagaggagatggagttcaaagtctcatctcctgttgagctctcggagatgccgtctccattatcccattgccaggtgttcacttgctcctaaataccactttgctctttctgcacaccagcagaaatgagatgctgtgtttgtggatagtatttgccacttcaaagagaacacggcttacatggggaagtttgtctttgccagggaagtgggaaaaggtaccagatgcagcttctccgagctgcttctgcctaaagctcacctggtgagagccgcatggataatgcacatgtaggtagtaggtagctgggtattttctggcgttgattcctaaggatttttaaaatatcattactctacttgtttttgtttttaaacagacatggggtattgctatgtttcccaggctaatcttgaactcctaggctcaaaggatcctcctgcctcaggctccgaaagtgctgagattataggcatgggccaccacacctggtctgctccataagtggaacgtcattcaccttccagaaaatccatgggcgatggaggaggggaaaataatacagtgctgtctaaaatctcatgatactggccgggtgtggtggctcacgcctgtaatcccggcactttgggaggccaaggcgggtggatggcttgagtccaagagttcaagactagcgtgggaaacaaggcaaaactccatctctacaagaaatgcaaaaatgagccgggtgtggtggtatgtgcctgtaatcccagctacttgggaggcagaggttgcagtgagctgataatgttccaatgcactccagctgggtgacagagcaagactctgtctcaaaaaaactcacgataattatagattatcatgccataatctaaccagagcacagaaggaatcttagaggtacaagccctgtagagtttcacgtaacatgatttggttaaggggtaaatatgttaatattaaagtgatttgctctacagggttcctgggcaaagcatgttaagttccattcagatgcccaaccctgaccaggctgaatcctttgcctggagtgctttatctttgtgaggtctggcacattccaacagagcacctgctcagtgtgtgatatctgccgtggatatgagatggggagtagcagtgctcaggccagatagttaccacccctgtttagatccacacacctcctttttctgtttggggaaatgcaaatcaccctgctagtggattaatcccaaagccttctgaattccaattcaccattctctgccctgcactctgacacctataggcctgaacttagattaaacgtgatgtccagctttccactgacatggtgtattagtccattctcacactgctataaagacatacctgagactgcgtaatttatatagaagaggtttaactggctcatggttctgcaggaggtacaggaagcatggcggcttatgcttctggggaggtctcaggaaacttagaatcatggtggaaggcaaaggaggcaggcacacatggcagagccagaacgaaagagcacaagggcgtcaatgctgcatgcttttcaacaaccagatctcgcgagaactcactcactatcacgagaacagcaccaaggggatagtgctgaaccattcatgagaaaccgcccccatgatccaaccacctccaacactgaggactacaattctacatgagatttggtgggaacacagatccaaactatagcacacggccatgtgtcacctgctgtggtgaaatcatcaggtcacctgggcagagagaaactgagagggagggacagtgccaagagcagatggccaacagccacaaatagggagaggaggaggaatatcagtggtgatactaataccactatgtatggtatgcttctaccgtttgtccttatcgtaaaacaagagaaagcaaaggcttctctctagatactggcattccttttcatgggacaccagatctgtgtaatgtcactacctctagagccacaggacaatgtgtgctccacatggtttccttcacgtgatattgcttaaggcttcaatgacttagtatatacaacgtggcagagaagcttcctgtgtgcacactacaggaatcctgccctggtgatgaccagcctaatgactcagaggtcatgaacgaccctcatctgcccatgtaggagcctcgtgaggccagaaagactctaacccttccatgataataaaaattcattctgattttttttccaacaaagggaagaaaacactacttttatgttaattttagctgggcctggtgagttgtacctgtaatcccagctactcaggagtctgagatcacttgaggtcagaagtttgacactaacctgggcaatatagcaagatcccatctataaaaatagtttaaaatatatatataatgttaattttaaccaaattctcttataaattactatcttcaactagttcttatcaacattaaaaatcattaacattctataaaagtcctttgtatcttaaaggaatttagtagaatcaccctggtcacggtactgtacaaaagtgtccgcaagaggacaatggcctggctcccagaaggcctcacgaagtggcgctgcagcacctttactgagtgcctggtcttccctttagccttagaagccctgcaagctggcaaggtgtgcctgtaatcccagcaccttgggaggctgaggcaggaggatcacttgaagccaggtgtttatgaaaaaaaattaggcatggtggcatgtgcttgtgccagctactcaggaggctgaggcaggaggatcacttgagctcaagaggtggaggctacggtgagccatgatcgcaccactgcactccagcctgggcaacagagtgagaccctgtctcaaaaaggcaagaaaaatgaaaccctgcagccaactgaggaaaaaacataagaagttgttggaggaaccggagttccaccacagaggataactgcccccaaagacgggaacacttgcctcggtctgcacagcacagatcccttcagtagacagctccaggtgggaagctgatggtagtcacctgatgagcgtggaattgaggacatcaggaagtgatgcttggctcagatgttcagtcactccatatttttggggtgacagttgtgtatgaggcaccaggcactggagaaacaaaagtgatgttggcctagtccctgtctcagaggcactaatgatccagttgggatccatgtatttggatatttgtaatacttcctagtaagtacagctatacacactttcattaagtcaatcaacaaacatttctagtgtgtcccagggacactgaacaagacagataaggttctggtgctctaggaatgaaccttctatcaggggaggcaggaaacagacatcaaataaataactagatggtgacgagtggtatgatggaaatgaacgtagtcaaagatagaaagtgtgggcaaagatggcctggctcgggaactcacatttgcagtagaccagagtggtgacgtattcatcaagaccagcattgctttgattacaaggaacacaaggcctaagagggagggggattattttgatgattttacactaaacatcatccagcaatacagctgacttcaggcattgggacccacacaatgtccttaggcccagtctctctccgtccctcactcctgctttgtctgctggcttctcccccaagcaggctctctcgccacagtgctaggacaaggtaccagcagatctgggctcatccttcctacttcaagtaaaacagaaaagaaaggacttttcttcccacgcggtttgagctcccatgtgaggcctgtttttctcgctggctcttgttggccccgtgcttgtgtgtaaaccagttacggcacccagggtgacaggacaccctgatggacctaagactgagtcatgttgacactaacatcagggaagcacagccagaccccggagtctgaacacctgcagtcacatcacggtatttaaactctgggccttgtttccccacctgtcaaatgggaatgggggtagcgcctgtctcagggggaccttgagatgagcattccaggcagagtgaatagtgatgggaaacagaagcccctaaggagttgggatcaggggcatggagggtcgcggcagaaggtataggaggggagctggccagaagctggaccgtgcaggtgtggatcgcgtgtgccgggtgggcggtgctgtgttgttttctgtgattcctcctaggcacacagtcccgccagggcatccacagaactcacagccgctggtccctactgcctgcattttctcccccgttttcagtgctgactctgatgggcaggttctctctccagctttgctgatatccctggtctgcttatagtcgaggcgcactggtctgggagttaaggctggtgttattttgggtgacttttcatgtttctgcttcgatctattctgtgttgatttttattacttaacacccaggggaaaaccttatttccccatacgttcaagttttggggtggtgcctcactcttgccccgaccagagtcatccccagctagttctgtgttggcagggcataaaatctgaagcaggtcatgttaatatatgggccaaagtgatcattggtgactgtatcatatcatcctccagctagaggacattttaagaggtccattagatgattactatttaggttctgagagctagattcaagttagtgcattttcatagtagtggttttgaagagtaatttttaaatgggtaaattgcccatacaaaaataattcctaacttacttccttatatttatgaataggtttgtgtatcgttgtattacaagcacatacatatacagttggatgtctctttttagtctctgcagatgccaagtactaaaatgattctttcttttcataaataaaagaaatccactccaggtatgaagtctatcagggaagtaacttaccattgcccttggactgatttccttttgcctttgagtttattctggaaattgcaacatttagcactttgcagtttaatttaaaaggattacctattttcttaaatgcttaagcagggaagcaaggtgcagttattgatttttctctgcctgtattctgtgaaagctccttccccagggaacatacctcctgaactgcatgcctgctggtgacagcttggacctctgatacataaccaaagaccttacctaatatccttgcatctgctccgggaatttttattaagtaaaagcatcattagagtagacaggatgatgaagtttaatgagcatcttttttgcatgatattgttagttttgctctgccagaatcctcatttctcccctccagtggggcagatcgtgagtctagaatatatggctgttttgaaatctgccttatatattatagcctatttttcatatagcttgctatctgtcttaagccaactacacatttcgttgtggctgtttatatagatgccatttgtgcatgtatgtttatactttctttctccactatgttgggaacagaaagcaggttataatggagaagaatgtgacagacacacgctgccattcgtaaattgcatggaaccatctcttggaggtttgatctcaaaaagaaaaaaaaacatttccttttgaattaatgagacttctcacaggaattagggtaactgttaattttttttctttaggactcagcaatttacatgctcaggttctgtcaccagcccctgatagccgccggctaggagaaataaagctattacaagtgcttattaataatctcggcttcacactttgtccacagatctatttgcagagattttaaatttagcatcctaccggaagattacagattagaagcaaaattatttttctccattattttcactggccatatcctgagattttaaaattggttcttttcttggtctgtatgaggacttgccatggaaacacccaaaacaacagtagggatacatatgacacgagcaaacgacttcagaacagcatattgcacctctcatatacctggcattctgaaagacaatatttacatagcacacaatgtgtttctagcagtgcctggagtgtatagactacaaaagaagttaagcctgcactccctgccctgcagaaaatggtagacttcttaagaaaacaaaaccaagatgggagatgaggtaacttagtgctttcagagtttgaactttggagtcattgcctgggtttatcggagcctcaagctgctaagcctcaatttcctcatctgacaaataatgatcataataggagcttcctcgctgggttgttgcgacagtgaataatgaatgcacgttagctgcattggaaatgttgtgctgtgatcacggcactctgctgatgttttgaggtaacatgccaaggtcaggagtcactttatgtatcatcaaggacttagtgatgagatcctgatacatcccgtagggctttgtgatggcagaatggagaaggggaggaggaagctgtgaaagtcttcaaggcctcaaaatatggacagaggagatctcagttgcagaggggacctaagcaggcattcctggcagtaataacacagataagcaacaacaacaaaaacaagccaaaaggaatgttggctgtcaggaaaggcttatctcaggcctcagattgagtgagccattttttcatttttcaatgggtgagcccaaggcaacctgattaccagttcacctgccagggagataatgagcgaatactccccttttccagttccgatggcagaggttctggaaagatataggactctgaggctactcagctaataggtggcagaactcacactcactccatctttcctgcactctgccctgcctgcctcaagcccagccttaccttgcacacgcctgttagtgcagaaagagaggacattaggcgagccagattccccagccacatgcgctgtggctgctccatgccaggtgccaggctaggtaccccatccaggggccagaggttgctgtttttcatccatgcaccaggaagagttcagacatcctgtgtaggacacactgggaagggaagtcacctgcatcgggaaaaccaagaagggaaccattataatatttgaatggccatgtgacatgggcctgattaaagaagaaaaaaggagtggatgatggaaataaatgaggtaccataaaacagctaattaatgagttatgggccctttgaggagctgatgaaaactgtggtccctttctgccgaaatatacatatacaactttacttagagtttcagacacttctagggtcctaggctaagaacttctactgtagaggaaactaaattcctatcagacctgattaatatggtgaccaaaaacaaaaagaggagaatgtcaaaataacttagcatttgctcctgaagttctggagacatggagggacagacctgtggaaggtggggtgagggactcttccctgccttttggggattcatagccaaagtgtcccagtgggctgatgaggacttggagagcagctgctcggagacaatcattaaagttataaaattagatggaaagaagacacaaagacagacaggaccaaagaggtgtccagagagaaaacaagaaccaggatgacatcctagagccaagcgaggacatttttaagaatgaatggctccgcggggtggggtcttccttgctgctgcagcaaagggatatgagacccttggatctgacataagactcaatttttccaaaaataaagatgcccatattaaataaaatccacctatcagccaggcgctgtgggttacacctgtgatcccagcactttgggagtgtgaggtgagaggattgcttgaaccccagagtttgaaaccagcctagcaacatagtgagaccccatctctacaataagattttaaaataagctgggcatggtgatctgcacctgtagccccagctacttgggaggctgaggcaggaggatcgcttgagcacagcggtcaatgctgcagtgagctgtgatcatgccactgcattcctgggtgacagagcaagaccctgtctcaaaaaccacccccccctaaaaaaaaaaaaacacgtgtcagtaatagaaaatcatgcataatatatctgcttaatcaaaaaaaaagttgcaaaatttattctgagtacagtggactggaattttttgctgtgcaatcttagctgtccaggcggtagtggtcagttgcacggagcttgaagcggcctgtctgcaggctgttttaacagcacgtcaccgaagtcaccagcctgccaacccaggcagtctccaggatcatttccccatgatccttctagaagtgggcttcagcaggggttcctggggtggcagctcagggcagcgcccactcccacgttggcatttgggcttcacagtgagatcaagagcccttgtgagcctagcagactggttcactcatctcccaccactgagagcgtcgcaggcatctcatctttgaaaccatcttcagtgacagaagcctgttcatcagactctcaagagcaactgatcctcttgtgtcacttcagagtgcggtttctcgtttttttcccacttcttaatcatctcccaattctcctctccaaatcccggctatcaggggagagatgctctagggttccatgtcaaagggtttcctccagttcctgggctaagcattttacccaccagccactgcagccccatgggtgaccttgggccaggctccctttatcactctccagctgtcatagccgagtggcagtgcccgccgaagctttcccagaaagatctacaccaaaggcacaggctggcagtgcagattccgggcagcacgagggcatggcagcagcctgcaagaggtggaaggagttggccctggtagcctgcgtcagagaagcttcctaagaggttagaagcggcagctgtcattctgaaatgcctactgtgtgcccaagggacaagagcgtttccctaatttaatcttctcccaagctctccatggtagctgggaatcttcatcttcctcttgcatatggagacatcagactgtgggaggtgagggaggttccccagggcacacatcgttcagggctgagtagggtgtcgaaggcagaggtggctgtgagtcccagagactgttctccaggaatccctggtgcaggatgtggtgggctcctgtagggccagacaggtaccacatgagcagagagctgcagtggccctgagggcacatgctgtctaggaggggacagtggtgcccgggtttgagggatggttggcgtttcccaggtgaaggagatggagaagctttgttcaccaaggccctgggggaaaagtacaagttacaagaggtcaggacaaaagttttttgccaatcctggcacttccccgcatggccctgcatggtatgccacactctttcctctcaggaactgcaaggaataggttgtctttcaatggcactgactgttctgtcctctgtagtcagtcactgctataaattcaatccaggtacatgcaaaacacaagccacgagtgttagcttcagaggatggtgggacagggaccagccagttcgtagtagcaaggggacagtttgcaaagctgtttgcacttcctctcgtagaaacaacacccatttttcctttgggacacaccttgcctctctgcgtcttggttctttcatttttccatctttttaatttatcccagaaactcattttccctattgaaattaagcagaatcctcacggacaggccaccctgtcaggcccagagaggctcacctactatgttagttctctattgctctaacacattaccaagaacttagtagttgaaaacaaaacgaatgtattacctgacagttctggaggtcagaagtctgaaaccagtgttgctaggttgcctcttgcaggagattctagggaagagcatttccttgcttttctggcttacacagaccacctgtgttccttggttcatagcccctttccccatcttcagagactgcagtgtaacatcttcaaatctctttcactttgaccccctgcctgtttttatttttgattgattgttaaggtcttgccctatggccaggctggaatgcagtggtgtgatcacggctcactgcagcctcaaactcccaggctcaagcgatcctcccaatgcagcctcccaagtaagtagctgggactacaggtgtgctccaccacacctggctaatttttttttttttactttactttttgtagagatagggtctccctgtatggcccaggctggtcgtgaacgcctggcctcaagcaatcctcccgccttggcctcctgaagtgctgggattacagatgtgtacccctgcagctggtccctcctgctgctttcttataaggacccttttgatgacactgagcccacgggatcatccaggattctcttcccagctcaaggttcttaactaagtcatgcctgcagagtccccactgccatggaaaataacagtcacaggtttcagggatcagatgtggccatctttgggagctgtgattctgtctaccacacttacttgcccagttgaggccccgtggctcgtaactggcagagccaggaatggaacaccagactttggagcttgttgtgactgcaccgccactgccatagccacatccctgtgaaaacggccacttatggccgcttagtaaaacgccagctctcatctgcccacacagctggaggagttaaaggatcgtgcggcggacagcagcgtcatccagccctgccgatgactcactgaggaagtgggccatgcatttagctctgtcttagttgctttcttcaaaaaggattaaaacctttgttccagaggtgtttggggatttagtgttgatagaaaataccctgttattttgcaggggaaacagccctaaagaaggaaggtaatcatataattatcttgatttaatcactcttgactgtaactccatgtctgtcctacttttcaataagcattcgctgactgcttccagtaggtttgccatggtgctgggcttaccgaaacaccctgcaaggaagacaaacgacatctctagcttacagataaagaaactgaggcacggagagggaggcaaacattgctgatcatttgcccagagtcatcagctaataaacgtcaaaagcaggatttgagcagcaagttcagggccactggctcccacctggccctttgtagtgacttgttctgcagccccaggatgttcagacacacacagtgggatctgaatataaaaaggcagagactgaaacagtggaacattccagttcgctccgaaaaaggagaagagccctgcagcttttgcaaccccttctgaaatcgcttgcctggatccccatcgtcagggccaagctgaacacccacctcagcccttcccgcattcaacacttgactcgaagcagggccttgtcaattcctctcaattcctactgctcctctccctctgctgacctcttatcattgccaagactctttccttacactcgggtattgctaggtttccatgggcatgaacagtggagtcatctttctgtcaacttttagaatccttacagtttggaggccaggtgcgtggctcacgcctgtaatcccagcctttccaaggtgggtggatcgtttgaggtcaggagtttgagaccagcatgtccaacgtggcgaaaccccctctctactaaaaatacaaaaattaggcaggcatggtggtacacacttgtaattccagctacttgggagactgaggcacgagaatcacttgaactcgggaggcagaagctgcagtgaactgagatactgccactgcactccagcctgggtgacagagcaagactccatctgaaaaaataataataataatccttaaagtttgaaactatctttgaataaaaatgtacatacgtatttttttgctctgtgcggataaggggtttgggaaacagaggaaagatctctgaggctggaaggaagctgtgtgtgtagctgaagctacctaggccgtaggtgcctgtgtgaagacacagagtcagacccttgcttcctgccaggtgaggggagcttggagacctgatgcctccagggtttattactctgcagtgctaagcccttgagcattgagtcagtggccctgagtagatcaacatctgaggacaagggcaggtgctgttagaggagtacgcatgtttcggagcttggaggatgaggaatagaatggagggatctactttgagcatttcctctgcctatctgttgtgtctgggagagatgccgaggaggaggaacacgggttgagtccacatggctaatgcagggtggtccttaacttcgacacctgcagagccccttttgtcatgtaaggtaacatactcccaggtttcaggacttgaacacaggtatctttggaaattgggggcagcaacagagacaaggttggacccgctgaactttactccctatctaaaccagtggtctcccacctgggacacaggacccaggacccccaggtgcccatggcctcgtcttcagggggacccgtgacccttttaaaagtgtaggttgggggagcccctataggttgaaaaatgcgctttcatggagcagatttttttttttctgagacagagtctcactctgttgccaggctggagtgcagtggtgtgatcttagctcactgcaccctctgcctcccaggttcaagtaattctgctgcctcagcctcctgagtagctgggactacaggcatgcaccactatgcgcagctaattttttcttttttttagtagagatggggtttcaccatgttggccaggatggtctccatctcttgacctcgtgatctgcctgccttaccctcccgaagttcagattctcttaaggagttgtttcttcttctgtggcttcagaggaggcacagccgggctggtcaggacagggctactgtctccattacacaagcaaaaaggcctccaaactaattcctagagatgtggaaagccaatttgcaggctcttatgttctctgtctaggacatatggaaacttcttgatgcaaaagaatggcctccccttttcctggagtgcaatcccagcacctggctggatgtgcacgctccggctcgtaggtctgtctctggccagctctgaaccctgtgttctacactccgtgagagtgaccgccgatggaacctgcttgtaccgcctccaaggcaacacttggaagactggaatagttagaatacagtatggcctttcaaaaccatagtgtccagctttcctggatcacaaaatcaactgggcagttccatctgccagcccttcccctctgcctgtcagccatggtggagatgtcatcaagaacactagtattggacgccaggcacagtggctcatccctgtaatcccactttgggaggccaaggcaggaggattgcttggggccaggagtgtaacaccagcctgggcaacctagtgagaccccatgtctattaaaataatttttttgttggggcatggtggctcacgcctgaatctcagcactttgggaggccaaggtgggtggatcactggaagtcaagagttcaagaccagcctggccaacatggtgaaaccccattgctactaaaaatatgaaattagctgggcatggtggtgcatgcctgtaagcccagttactcaggaggctgaggcaggagaattgcttgaacctgggaggcagaggttgcagtgagccaagatcacaccactgcactccagcctgggcaacacaataggactccatctcaaaaaaaaaaaaatatatatatatatgatatataatagataatatagtatattttatatgatatatatgatatattatctatatgtatcatatattatctatgatacatataatatacagataatatatgatatagataatatatgatatatatcatatatatcatattatctatcatatatatcatataatagatattatatatgatatatatattttttttaattagctaggcatggtggcatatatctgtagtccagctactcaggaggctgagccatgagatcgcttgagcccaggagtttgaggctgcagtgagctatgatcatacactgccctccagcctggggagcagagtgacagagtgagacactcaggaaaaaaaaaaaaatgccggacgccagtatatgctaaacagcccaagatgccagcatccagagagtgtgcatattccttgtgtggatgctggagctgggccacctggtacagggacgtcaggctctgtgccaaccctcattcacagcaactgcgggctgtggagccgggtatgcccttgctgcagaggacctgagacacccaccaggctctcttggagacacagttatatcaataaaaggagttaagtttgagctgtatttattttagggtggcttttaatttggtttaatcagaattactcataaattatcgattaattaccttctgctgttcagttaaatcctctcagccacggagccagcttcgctgcgcaatgaatgccatccaccgtaattatagggcactttgtcagcatttaatcagcggtacttattaatgtggcattgatgtgtggtggccagccccacgctatccatcatgggtgagcagccagcacagatttggacaccattgctctctgtcccattagccagcccctgggctttcgggccaagcatcatgctcgcttttcactaaatggacactctgtctcttccattcaatcccatttttatcactgtcgacttaaacactcataagcttttgaacttcagtccagaacggctgagcagggcctgaccacttctcccagtgagtgtgaaatcccaagagactggtccgtgatcggacatcatggcatggcgtgcatgtgtaagagaattttatattcaacacagcgtagcacccagagaacacagaagtgatcttttggttttctttggcttactgaatatttttggagattcttctattcctgaaagctcttccagtgaaagctatcttgtgttggcaaaatagatctgatagtgtcctttctctgtctttgcagcctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaag

SEQ ID NO: 13782 - DNA, 6376 bp, Human
ggggagggactaatcctggcctaagaaagatggctccaccccagaaggctggaaaaccccatgtccagtgcttgcggcctcgtctggagtggctgtcaagtgacccagaactgcatagcccctgctgtgtaccaggctgtgtggtctcctgtgaaggtcaagactgagcccagtcacacagtcctcaggactgtcaggtggatgctggcagggccatgtctcttccagccttaaagcggcctggtcagtctcctggctgcacgtagggtcttggtagccgcatctcatcccagagacccgtgagaccatcttggggaccccacagcctgtgtgtccaagcactcttctcacctctatcccgcacccaactctccttctgctcctccagagaagcagatttgttcaggagtgacggacaggctgggcctgtgggccaattttgggctgaccccagaacccctcaccctgcccccagggtccagtcctgcccctcagcccctggccctagctgtgggctgtgctgcttcctgagtccccaccgggcagctcctcctccatccccctgccgaccctaggggagggcctcctgcagcagcccctcctctcccctgtgagcaacagcgggcacaggacaccccttccaccctctcctgtctccttctcacgatgtcaaccctgcctcagcccctgcagggtctaggaaacaccccacctcccagtaccgacagcaagcctctcccgcccactgggacccccgccttcacctccttgctgcctccccacccacggcctcgcgtgtgctcgacagtgctcactcagccagggactctctcctggaaaacctcttccccaccatcccccacccgcggcctcggggtcccacccgttaggggcccgattccgcgaagcccctctccacagcacgtaccgcaggacacccccagtcgggctgactctttccagctcaggcccccacagcccctcccagcctccatttcttgctccttccccacctctcccgcacagggttctggtcagggtacggtccagtctcccattattcgtccactccgcagcatgtgacccagcccatccccgctccttcttcctcgacccgggaccctccagcttggccctccccacttcctgggccggccggccctcaccctcggcaaggatcccggggctcctctcctcgacgcccgacctctccaagggcctacagtggataaggtccccgcgtccagaagcgcccgttcatcagggagacggacatttgccacctgcaaaccatgacgttccacgagtgggtccacgcgtctcccctgcccatctcctgctctgcaccagcgagaaccccctcggcctacacggaagcccctcaccaggcaagccgggagccccagaccccgtggcccggagtgggtcgctctgtgacaccctggacaggtcactcaaccacttggcgcctcctcggccactcagaaaacacctgccctcccggagaccccggtgaaagccgagcactcctgcaccctccttccgagcccacgcacaccaggacaccttcagccgcgtctcctggtgcgcctgcgcgggggccctggaggaggagaagtaggcggggccggcggccgctggtgactacaagccccggcgtgcaccgcgctaggctggccgtggcgcgcccggaaggtgtcgcggccctgggccccgccccggaagataaggccgctcgctgacgccgtgtttcctctttcggccgcgctggtgaacaggtaggtcatccttgcggccttgcggcatgggcagtatccgccgccatcctcttccgtgaggcgcgctgagacccggaccggccctcctgagaggatgccggtgcgggcgcccgcggagagggtagggagtggtgggcgcggcggcctcgggggcggggtcccggaaagccgggctggcgggggtacccgggccgcccggccgcgctaatcgtgagtcgcccccaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggtgcggaacgctggccggggcgggaggggaagggacgcccggccggaacgccgcactcacgccgcctctgcccacaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaagggttagcatcgcggcggggaaggaaggtcggggtggggaggggtctgggtgttgcctgaggagttaacgtcctaagccgatatgggaacctcgcaggcagaagcttcaggtggggacatccgcgtggccagaccagtggccaccggtgggtgccgagagagttgtaccgggaggctggatgttgaatgctgtgctcgcaacttcgcgggttgcctagagcgagggggttcgcattgtttcttactgtgctgacggcctgatgctgcttccccttgcagcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgagtatcaggcagcagttgaatgctgagggctgtgggtgaacatgctgtgagtgccggtggacagccagtggctagacttggtccctggaattcgattacctgttgttctaaaacttgggttctgtaagtttgagctcatcctgtagtctcagttgtcatcactgtacaacaggcacaacagtacctgctttactgctgttgaggcgttaaatgagattgggacgaagtcaccagggtcttggattctaccgtgggcttcctgattgctgcacttgcatgcagttggttaacagcctttttagagaaggcagggagagattgtggctttctcaaagacgcctactgagtgagtgaaaaaggatttgagtctaggttaactcactgtgctgtttgggaacatcttggaatccttgtgatgaactcagcctcgcacaggggaggctctgaggttgtgttcctggaataagtaaagctgagatggggcaggctgaatcaagtgtcttacgtcaggttgagtggccggcctgacgtctcacacatggtgaggggggtgcttccctgcgcttggagctcagccagcattctaggtgatggaggtgagggccttggcttgcctgcccattgtggattgaagaaactggatgtcagctcacagggtgcaaggggctccctagggtggaggcgagtgggctttttgctgggtagttggatgcagtattgggaaggtgcatgacaggagattgaggggaggtgggggtgctctgaccgactgggggttccctgaggtatctgatcccctacaggtgtggtggctggaggtggccgaattgacaaacccatcttgaaggctggccgggcgtaccacaaatataaggcaaagaggaactgctggccacgagtacggggtgtggccatgaatgtaagtaacccagaaatgcagggttgggtattgaagttacagtggccacactgttgggtaggcaagtcccatccacaggtgtccctgcaggagggggatctacggtgggaggagcagcaggtggtggtttgtagtcacgggactgttgatcctgctccagcactcctgaaggaggtgggctcaccctccttcaccgtttctccgcaagaaacggaggctgggaggggcagtgggggcctgagctggaaagagtcagcctgactggggttgtctagcggcacatgctgtggagaggggcttcgcggaattgggcccctgacgggtgggaccccgaggccgggggcgggggtggtggggaagaggtttctaaagccatctttctctgcctgcagcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccacctggctgtgcccacccccatggtttcaaagggaggggtccctgctgggaggatttctgtgggatccccctggttggtactgggagggagttagactactgaagtagaccaccagtgagtggtagaagcttgaagggaaagtccacaactagaaacggggtgcaggtaccctgggcaagacccttgcttccccacagaggggaccaagaatgtggcatccaggacctgacacttaggtgggtgactcagtcccatggcctgcagtgcttggatgtgaacactcatttcacgtatcaggaaacagaataggacacaatcgttgagcctggtgttctggaccataccctcactctgtcagctccctgctaactttctcagcacctgaggcagtcctttgcccagggtcttttagcaacaccctttccctccatactggctacagccctgctgatgtcagtgtgtttaagtcactgccagggatacctggcttgcaggtgtctgccttgcactgggaacttgggatgggccctgaaggaatgtgggacaggcaccctgtctacagccaggaagccattcctagcctggcttttaccattctgttctgcatgcattcccaccccgccatggtggggagtggtcactgactggagggttctgggtgctttttcctgtgggtggtgggtggggcctcatgcctttcctcattttctagcctgatagtgacaggtgaggttgagggtggtgattgagtgtggggtcccaggtcactgctgggattgctgaacaaagggatgaatgcatgcagtgtgtgtatggggaatcccagaccacccaagtcccttcacccacccacccagagccctacactggactggagctggcaccagcagtaggttggtctgctccttgagtcctgtaactccacagcttcgcagggcatgtagccccctcttccctggggcagagaaactaaccaggaacagcccccaaagctgcattgattaccttaaagcacatggcctttccctgctggcaggggctgatactttggttctctctagctttggtagtgatgaggctgacagtgatgattgagtggaatcaggttggaagtgttggggaaccccccctgcaatgggagggcaagtaagctggtttccgtcacaaggcagagtggaggggcttcctgtttggccatagcccatggcatcttgtcccttaaccatgatccaatgaggagatcccaggacagcatcctatcagcactttcacacgaggaagttccaccagcgaatgcagcagctgcagatcactgcccctaacaacactcctgtggaactgcagcaggcaggatgaggcacggtctctccctatagacttggttggagggtgcctggcaggtgagaatagtcaccttaggcttccgtggtcactccgggatgacaagtcctaactggctgcgcggtggttcctggctgtcatggtccacgctgtctctagagaaccttaccccccatttcgtgatcttgctttcctgatcctgctggtatggccccacctgtctttgggcgcccaccacacctaggcagtgacccagcagggcctgtttattttagacaggctctcgctattgccaggctggtctcaagcccctggcctcatgtggtcctcccactccagccccgcctccccgccagtaactacgggacctggttttgatctcgtcattcgcagggccggtcccagggtcccagctgacttgtcgagaaagaatccaggagggcggtgtttcctcctgaaggatggaggggcatctggaaagagggttttgggaaagcactagatgcttagcttggccataagcggtcactgtttttctgctcccttctgggcaaagtggacggcagggcttggccgatggaccggccatgagggaaagtttgttccagaagcagctcaggcacccgaaaaaccctttctccagagtggacactgggcccc

SEQ ID NO: 13783 - DNA, 6222 bp, Human
cgccagcctcctctctcccttcggtctcctcctcctcccgcccttcccggcctcctccctctcctctgcctcatccttccccggcccggcctcctctctcggtgtcgacccagtgcccctccttcccgggcccgccactgctgtccctggccggggcccctctccctcgctccgctcccgccgcaggacccgggagtccgcgcctcacctcgcgccccgcgccgaccgccgcacaagtgggtccgctggcttccgcgggtcagtgggccccgcgctccctgaggcgctgcgggggcgggccccgcgcccggccctcgccatggcaacgctacacttccggcccgcggtacccatagccggaagccgcggtgccccgtgggagccgggggcggagcctgggaggaggaaatgtcgggggcggggcctggggagggacggtcgggggtgggggccaacgcggacagctgcgggcggccgggcgagtcctccgcggctgggacctccttggggcgtgggtgggacgggaatggctcaaagtgctccaaggctcccgggacggtggtcattgatttatgctggacaaaaccgagtcatcgcgggcaacgggacgggcgccagcggaatgagtggcagctttgggggtggtttcgggcccaggacagtgcggtcggagaagagcggtcagaacttggggagcctccagcgccccaccaaggaagcgccagtggagaggggggtgccttaaaacttacgggagaccgggcgcggtgtctcacgcctgtaatcccagcactttgggaggccgaggcgggcagatcacgaggtcaggaaatcgagaccatcctagctaacctgatgaaaccccgtctccactaaaaatacaaaaaaattagccgggcgtggtggtgggcgcctgtagtcccagctactcgggaggctgaggcagaagaatggcatgaacccgggaagcggagcttgcagtgagccgagatcacgccactgcactccagcctgggcgacagagtgagactccgtctcaaaaaaaaaaaaaaaattatgggaaaggcccggcccggtggctcacgtctgtgatcccagcactttgggaggaggccgaggccagtgggtcacttgagcccgggagaccaacctgagcaacataggcaggcccggtccctaccaaaaattaagaaattagctgggctctgtggcgcacgcctgtagtcccgggacgctgagtcgggaggatcgccctagcgggggaggtggaggctgcacggggcccagatcgcaccactgcactccagcctgggcaacagagtgagaccttgtctcaaaacaacaacaacaacaaacacttgtaggaaagaacgacgccttgctgaccgaatggggtgaagtggccacaagtattagcctcatgaggcacaggattgtgcagccataacctagggaacacagcagagaggtggtggcaggagtcctgagggaaaccacgtggcgtctgaggggagagtcagagatagaaggaaaaggggcaccacccgaccgggggtgtggggggcaggagcagtgtggtaccccacatacaaggccccttgcggcccaggcctcctcctcctggacacttgctgcctgtccctcccctccacacctcagggtgtgctggaccccaccgtatgctgcagattttcagccctttgaggttatcgtggtggaggctgcacaagaaaagctgaattctcagagtgaagggcaaaagcatatccctgggcccccgtgtgtctgggggcccttggcctggtgccagcaccaaccaccgctgctaattcccagagctgctatcctcttgggcaaacttgccccttgtgagggaggagaacctgggctttggggcaggatacacaataccagccttgcttgggtggaggagcagagatggctagggaggaggaggtgagcggtccacctgggctcctgaagcaactcccaggaaatcagttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccaggtgagcgggccccggcccccactctctctttccccagactcgttccccacccacttccaggttcaagccctgacccccaccccttcctagcccacccaggtatgccagtgggaccagtcctgagagctgagggcctcaaggcacgacccttctccgggagccccttgccctctctgccgcgcttccgcgcagaaatgtccttcttcggggacagcaggggccggcaccgcgcgcccctgagcccggtagtgggggaggggtagggcgctaccccctccccgtctgggctcacggcgccggccggccgcctggcggtttcagatcatccgtcaggtccaggccgtgttccccttcttcagggaagactacgagggctggaaagactccattcgccacaacctttcctccaaccgatgcttccgcaaggtggggcaggccagggtcggagcccgggggcggagcgcgcgcggaagtcctgagcatccaaggttgggcagccccacccatgtctgacccccacacccaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccgctcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctgggggcggggggtgatcacttcagcaggcacaacacacttcactggctgcggaggtggaggggtgactctgggagctcaggggcaatggatccaaagaggctagggagcttgtgccctgggagacggggtacagggactttactaccgcctctgccagcagagacctggcctgagaccccatgggcagggccgcgacccaggactagaggggcaggccctctgcgggcgcgagagccgagcccgagccgttgtcgggactggggcatggaggactgccaggggacggcgtaggggtgcagggggtcccggtgagcggagtgtcggtgctgagggaagaaggcgtcccggaggagcgcgggaccctgcggcgccgggctggccccagctccacttgacccactcggtcggcgaacttgagggagcagactgtctccccgagatcctccggccgcgtggagatctgcgggcaagaggcgcgggtgggcgggcccgggtgggcggcgaccggcacgcacacacctgccccgccccggcgcccacctgcagcagcagcaccgcggtggtgcctgggcccagcgccggctgcagcagtcgcgtgagctgcgagtcgcggaagggcacgtgcggccggtgggcccgcagtgcggccatcacgcctcctagcgccagcagcgagcggtttatggtctgggcctcccgcaggcgccgggcgccgtctgggtctccccgcggcgggccggccgcccctgccttccgtgcgcgttcggatcccgccaggtccaccaggtgcagcgtgcctagaggggcgagcgagcccgacatgggggaaggccgggcctcgggtgctctggagactccgcagggctcaggcaccggccgtggtacctgcggtgcctggagcgcgcggtggagacgccgcgcgcagcgtcagcgtgaccagggcatgcgagcgggagctgcgctggttcatggcggtggcggcggtggcccggttgctcctccccagtttcagcatctggaaggcggggcgaagggctggtcaggtgcagggtccccgcccccaagtggaagcacggggcggggtctcggagagcggtgcagccctacctggtgcaatgtctccaggttgggcacgtcccagtgggtgaggccagccacctggatcccgccctggccttctgggccctgcctcacggccaggcgctcgggaggccctggagcaaggaggtccctggtgagaaaggggaaggtcttggttccagaattctctggaaatccggaagggccctgggccaggggtggggagaaggcctccctggtggagtagcccacctgacagcctcattgtagatctccaccatgctgagtgtcacccggtgctgccggccggcccccatctcccggaacagcgactgcagcgccctaggaactatgccggggtcctcaggagggccctgaggatggggtggggtgcacac

SEQ ID NO: 13784 - DNA, 20099 bp, Human
  misc_feature (1)...(20099): n = A,T,C or G
attctcctgcctcagtctcctgagtagctgggattacaggcatgcgccaccaccctggctaatttttgaagggagccagcccctccacacctgtgagtatttctcatcaggtgggacgagagactgagaaaagaagacacacagacgaagtatagggaaagaacagtgggcccagaggacccagcatacggaggacctgcatcagcaccggcctctgagttcccacagtattgatcattatttttaccatcttagcgaggggagtgtagcagggcaacaagtggggagaaggtcagcgcggaaacatgtgagcaaaggaatctgtatcatgaataagttcaaggaaaggtactgtgcccggatgtgcacgtaggctaaatttatgtttctctttacccaaacatgtcattgtagcaaagagtaacagagcagcagcgctagatttatgtttctctttacccaaacatctcagtgtaggaaagagtaacagagcagtattgctgccagcattcttgcttccaggcagttttctcctatctcagaatagaacaaaagggaatggttggctttacaatgagacattccattcccaaagacgagcaggagacagaaggcttcctcttatctcaactgcaaagaggcctccctctttacgactcctcagcacagaccctttataggtgttgggctgggggacggtaaggtctttcctttcccatgaggccatatctcaggctgtctcagtggggggaaaccttggacaattcccaggctttcttgggcagaggtccctgcggcttcccgcagtgcattgtgtccctggttaatcgagaatgaagaatggcgataacttttaccaagcatactgcctacaaacatattaacaaggcacatcctgcatagccctaaatccattaaactttgattcattacagcacatgtttctgtgagcacagggttggggctaaagttacaggttaacagcatctcaaagcaaaaacaatttttcttagtacagatcaaaatggagtttcttatgtcttccttttctacatagacacagtaacaatctgatctctctctctttcccccacagtttttgtatttttagtagagactgggtttcaccatgttggccaggctggtctcgaactcctgacctcaggtgatccgcccacctcggccttccaaagtgggattacaggcgtgagccaccgcctcctattgacttttaaaaggcggttgagtgtggctcaggggtcacacgcctgagcatccaagtggcccttcccccactgcccaatgagcaagtagatttggatgcaacaaaaacacatatttccacgccattttcttgggcgtaacgatactttcttgttttatttctcatgattccgtttctaggtcctaggcccgtgcctgatccaggatccaagctcccggaagctggcactgggcccgccctgggtaggcagcagtgagcaaggcgggcggacagcgctgggctcgcggggtcctgcgtcctccgcgggagtgttggcggcgggggtcgctctgcgcggggacactgggcagagggggcgtgcggcctctctaggaagctttctcggagccccagacactggcgaggcgccgcgccccctcttctggattccggcgcgccccctgaacccgggagctacgagcggagtcgcttctccctgcagccgtcctgggtctggcgcggacgcaccccccggccgaccccgagccgctgcagccggcgcccctgcggcttccaacccgcgctgctccgcccgcagcggaggccccgcacttcgcgcgctaggggtttgggttccggacgcccagcccggagccgagccgccagccgcccgcatcccgggccactagggcccgctgtcgcccctgcagccacgctcacgcggcggcgctgcgcaggcgcagaagcccggaaccttcccgcccagcttctgggcccggccggactgagttcgctgctgtcccggttcctctcgagtcggctccaactgccaggtgggcggccgggcgggcggccgaggcggcagcgcgaggccggggaggggcgcggtgcggggccgggctcctgcgtgggcgaccccgctcacccttcctctcccggccttgcgcagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggtaggtcgggccctgggagccctccccgctgtccgcgacgtgggtgctctcaccgcccccggttgcagatggaagagccaagccccagacaagttgagtgatttgcttaacgttcctcagcctgaggagccaggacatgaccctgaatctcttgtgctcagatcctttctcacagctgctaccctgttctgcctcccttcctaccccaccgggaagggcgcgctgccctagccgtcttgtttgctcttccgttttttcagcaagttgttcggaaggagcgaacgcccactgtgcgctgggtagcagagataccatgtgaaccacacctgcagacacttggggaaggggaacatctaaataaacacacctgcccctgcagcaagtgctgctgcgggaataaaggagtgaaggaaggagactgtgtatttccagtcgcatgatcagaagagcctgtctgaggcagagcgggagtttgtcgggggaaggacattggtagcacaaggaacaaggccaggtctaggatggggacagactgttgacaggagtcttggtacagtggggcacacgcctcaagggtttgggaaatacagtggtgttttggttgccggagggttgaaagctggtccaggaaagcaacttgcaagaggcagtttctccattgctcttgaagggaggagtacctcttacccaggcccagggatggtgagaggagggtgttccaggcagaagaaacagcctgtgcacaggcccaaagcagttgagggtggagagacatgcacagtgtggccgtggtatagactggatgtggtggtggggatggagggaggtaggccgtggtcaggactattctccacaaagcagggaggagccacaagagggttgtgaataggggctgacccagcaggcagatgggtcagaagctcaggccaaaggaggccaaccctcctgggcacctaccccggcatacatatgtatttgctggccagggctcctgtcctctgaaggcttgacgagggctggagtttctgctcctaacacactattggcaggaggccgcagttcctcaccacatgggcccctccctggggcagctcacaacatggcagcctccctcacaatgagacacccaccaagactgaagccacggcgagtcctgtaaccgaatctcaggctgggtgcactggctcacacctatagtcccacactttgggaggctgaagtgggatgactgcttgaggccaggagttcaggactggcctgagcaacatagcaagaccccatctctacaaataatttttttttttgtttttcctggtgagacggagtcttgctgtgtcactcaggctggaatgaagtggtgtgatctcagctaactttaacctccgcctcgtgggttcaggcaattcttgtgcctcagctccctaaaccctccaccaagtagctgggattacaggtgtgtgacaccacgcccggctaattttttttttgtatttttaatagagacagggtttcgccgcattggccaggctggtctcaaactcctgagctcaggcagtccactcaccttggccttccaaagtgctgggattacaggagtgcaccactgtgcttggcccaaatataaaatataaaagttagctgggcatagtggcctgtgtgtagtcctagctacatgggaggccagggtgggaggatcgctcaagcccaggaggtcaaggctgcagtgagctataattgcaccattacactccagcctggacaacagagtgagaccctatctcaaaaaaaaaaaaaaaaggccaggcacgttggctcacacctatcatcttagcgctttgggaggccgaggcaggtagtaaatcacctgaggtcatgggttcgagaccagtctggccaacgtggcaaaaccctgtgtctactaaaaatacaaaaattagctgggtgtggtggcaggcatctgtaatcccagctactcaggaggctgaggcaggagaattgcttgaacccgtaggcggaggttgcagtgagccgagattgcactccactccagcctgggtgacagagcaaaactccatctaaaaaaaaaaagtagtagtaatacactgttaaccttctgtcatattctgctggtcatatctaccaaccctggtgggggttgcggagggtgcaacacctcccagcattcactgcagaggacattgtgctgccttggatgctggccaccgtagattggctgaggtgctcattccacatcaggtagcagtgcagagcaggaagcgttgtgctgccttggacgctggccaccgtaggttggccgaggtgctcattccacatcaggcagcagtgcagagcaggagggtgtgtgcaagagtctagaattgaggattgaggtctggtatggaggtcaagtcagagtcttcagcctggggttggtgtctgcccttggaaactggttgagatcacccagaatatagacaaagacagggtcttggggcaccccaacattgagagattggggagatgagaggccatgaaagagctggaggtggcatggcctggaaggcagggggaaagctggacagggccctggaggcccagggaaggcagctgggagggactcgacactgggtcccacgctgttgagcctcaggtgatgcctggtgactgacagggcagtctggtgggcacgaggggttgtggtctgaatggagcaggggtaagagcccagcaggggaggagagtcagtaacagtgaacacagacaactctggaggagatgtgcgtaaactgaagcaagaaatggagccataaatagcaggaaaagaggttttcttcttctgttgttttttgtttttaagaaacggggtcttgctatgttgtccaggctggcctcgaactcctgtgctcaagccatcctcctggggtcagtctagtcgtggctctgtaactaactgccctggaatatgcaaacgaggtcttttatcataatcgcagacctggaagccaggttttcagggattcatcagagtgtggggagcccttggctctcctccaccagggcaagccttgacagggatgacttgaagagctggggacaggctagatgtgtcttcccctacccccacaccgtccctccactctcccctgtccccagcatggctagcttggttttcctggcagcatggtggtgttggtgtagttgagcttctggcaggaactcagagccctaggaggctaaggcagaagctgccagtcactttaagggctagaccaggagggcaccgtccctgccaccacagtctgccctaaaggcagcctccagcccagattcacctggagagggagggagacagccacctttcatacagctgtcttttttttttcttttttgagagagagtctccctctgtcacccaggatcgagtgcaacagtgcgatctcagctcactgcaacctctgcctcccgggttcaagcagttctcctgcctcaacctcccgagtagctgggattacaggcgcctgccaccacacccagctaattttttgtatttttggtagagatggggtttcaccatgttggccaggctggtctcgaactcctgacctcaagtgatccaccctccttggccttccaaagtgctgggattacaggtgtgagccacggagcccggccaagacattcccaggtgtttagatgagacatttgtatttttgacaggaacaccacagaagaggcaaacagcagccccatcagctttcaggaggcggcggaggcctttgcctcatgactggatgctgatgctttgatgcttggttgggtagtgttggcctggattcccccactgtaaggttatttcttccttttgtaactaaaagtatcttgtagggacttattttgaaaccctgtaaacgtcctcttattcagattttcaaggttttttttctttctttctttctctttttttttttagacggagtctcgctctatcacccaggctggagtgcagtggcacaatctcggctcactgcaagctccacctcctgggttcaagcgattcccctgcctcagcctcctgagtagctgggactacaggcgcccgactaatgtttttgtatttttagtagagacggggtttcaccgtgttagccaggatggtctcgatcgcctgaccccgtgatccgcttgcctcagcctcccaaagtgctgggattacaggcgtgagccaccacgcccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaggagaccccctgctggtgtgaaaggtgtgagcacccatgagacaaggctaagctgggggcatcacctcgtggggcctcagtccccaagggtggtgaccacacagtgcaggtcacgcaggtgctggccgatgagacaaaggctcctgaggctgaggcaggcagggtgctcagggcgacgcaccaggctcagctctgctcctcaccgagggtccctaggctacagtttcctttttctaagaactgtgctgcagcctagctggccctccacagtacaggctatatccgacatcctcctcggctgatagggcctgtctttctttcctttctcttctcttccttcctgcttttctttctttctttttcctacccgcccccccacccccactttgacggagtcttgcccgggcacaatggctcatgtctataatccttgcactttgggaggccaaggtgggtggatcacctgaggtcaggggttcgagaccatcctggccaacatggcaaaaccctatctattaaaaatacaaaaatagccgggcatggtagcacatgcctgtaatcccagctacttgggaggctgaggcaggagaattgcttgaacccaggaggcagaggttgcagggagctgagatcacactactgccctccagcctgggtgacagagtgagactctgtctcaaaatttaaaaaaataaataaattagtcaggtgtggtgactcacatgtggtcccagctactcaggaggctgaggtgggaggatcacctaagcccaggaggtcgaggctgcagtgaaacatgattgctcctctgcactccaacctgggagacagtgaggccctatgtcaaaaaacaaaggcctggcgtggtggctcatgcctgtaatcccagcgctttgagaggccgaggtgagtgtatcgcttgaggtcaggggttgaagaccagcctggccatggcaaaaccctgtctgtactaaaaatacaaaaattagctggacgtggtggtgggcgcctataatcccagctactgaggaggctgagacaggagaatcgcttgaacctggaaggcagaggttgcagtgagccaaaatcacaccattgcactccagcctgggcaacaaagtgagactccatctcaaaaaaaaaaaaaattttcctcctatttttgctttactaggagtttttatcacgaatgcctttatcagatgctttttttgtatccactaaaatgacatgatttttctccttaattttgacagcatggtaagtttagcgatggctgttcttgcggaaatctagttttgcgttcctggaataactcaacccagttgtgttacaatacccctgcttgtcactgggctcatctgcaggcgttttgaggaggttggtgtcacttcctgtcccacctgtctgtgggctgttggggtggcctgagccacctgcggtgccgtcagccccacatgagtgggtgtgtgttttttttttaagtgtgtcattacttctgaaacctttggtagaatttgcgggtgaagccctggagttgcccttgtcgctgtgagatgggtattggtttgtggatgcttcttctgtatctcttaaccagcttccaagatgccctccccatagcacaagtccatcgtgaaaaatgaccttgaggtggctcacgcctgtaatcccagcactttgggaggctaaggtgggcggatcacctgaggtcaggagttcgagaccagcctggccaacatggtgaaaccctgtctctactaaaaatacaaaaattagccggacatggtggcacgcacctgtaatcccagctacttgggaggctgaggcagaatcacttgaacccgggaggcagaggttgcagtgagccaagatcacgccactgcacttcagcctgggtgacagagtgagactccgtctcaaaaacaaaaaacaaaaaacaaaaaaaaacaaaacaaaaaccacttttcccttgccttgaggcaatggcatataaatctgctagctagttaaactagctacctagtagcaaagaacacacagcctcttatcattctgggagggcagtgaaaagggaggagataagagaggcagcctgggggagcccgaggcgtcaggatagcgcagggcttcctcttctctaacaggcacgcagatcagtagctacagataccccttggctctggcttcctgccctgtgacatttggacccaggggccggggctgggctgctgtaggtgtgcaaccaggcaggtttgggggtgtgcagacacagagtgcactctaaccctgagtgcttgccgcacagggcctggctgctagggagccgtgaggtaggggcttcctggggaggggcctgtgccagggctgggccgtgggcatgagagcgtgaatgggggtcgctgtggggggctgtgcacagctgtctccagaagcccttctccctgctgcagagagggtttgggcagagctcccaggaggcaggggccaggcttggtggtcttttctcgttccccggatgaggtgagctgccagatgtggcccctcactgccctgtctttctctcccctccaggctctgaccaagaatgacaggagcacaggtgagtgtggtggggcggcctggggctgtgcgggtgccaggcatggctgggccctgaccctgagccctggtgtctcccctagaggggaaggcccaccgggagaagctcgagcttgctgcctccttctccttctttggcaacgtcatgtccatggccagcgtgcagctggcaggagccaagcgggatgccctgctcctaagcttcaaggatgccaaggtgagtggtaggcttggtggggtaggcctggccaaggcgtgggagtgggtgccagggcctgggtacagccgttggttgccgggggcgacactgtcaggaccggcagtcggcagccacggctgtgccctctgaccgcagctgtctgtggtggagtacgacccgggcacccatgacctgaagaccctgtcactgcactactttgaggagcctgagcttcgggtagggccgcgctcccgcccccgcccaggccccgcccagccaccctccctccccctgcagctgggttctgtggccccaagtgtttccctcggggtctcctatgctgggcctggctgatgccccctctgcccccaggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggtgagtgccagctgaggcaggctgtggtgctggggtgggaggcgccagagcccgagctcccctccccgcctcccctcctctcctgctgaagcccctggccccccaggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggtgagccccctaaggaggcccctctgcactgtgggccccctagctgcctctgcctggggtggggcccatggggtttagggcggggcctatggggtgtggtggggcttgctcgggaggagctgggcctgggtctctgcggggaggcaaggcccttggctgacccactggcgtccccaggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtgtgtgtcctgggagtggataggggagtgtgtggagagagcactgagcctgcccaccagcctgtgtccacctccaggtggggtggtggtgtttgccgtcaactcgctgttgtacctgaaccagagcgtccccccgtatggcgtggctctcaacagcctcaccacaggaaccacggctttcccgcttcgtgagtgtggggtggctggggggggggggggggggccggggacggcttgggcctgcctagtcggcctgaccacccaccccacaggcacccaggagggtgtgcggatcaccctggactgcgcccaggccaccttcatctcctacgacaagatggtcatctccctcaagggcggcgagatgtgagcccctcccccgcccatgaactctgcccacaccgccccccacaagtcctgtagggtcccctggcccccttcactcccccagggtccccatccccaactcagaattctccctgcccccagctacgtgctgaccctcatcaccgacggcatgcgcagtgtccgagcgttccactttgacaaggcggccgccagcgtcctcaccaccagcgtgagttgggactaggggttgggtctgggtccagacccggcccagccatcacacacctgccctccctcagatggtcaccatggagcccgggtacctgttcctgggttctcgcctgggcaattccctcctcctcaagtacacggagaagctgcaggagcccccggccagtgctgtccgtgaggctgccgacaaggtgggtttcctgggcccattgggccaccacccttcatgtgggcactgctgtggcatgccactcagtgcccctcctgcctcacaggaagagcctccctcaaagaagaagcgagtggatgcgacggccggctggtcaggtgagggccggtccagggctggtcaggagcggggccaggtgacccagggctgcgctcaagtgggctctctgtgtgcagctgcgggtaagtcggtgccgcaggatgaggtggacgagattgaagtgtacggcagcgaggcccagtcgggaacacagctggccacctactcctttgaggtgagattgaggcagcagggcccccgtcccagccagcgcccccagcgggcccctgactcttgctgtgccgcaggtgtgtgacagcatcctgaacattggaccctgtgccaatgccgccgtgggcaaacctgccttcctctctaaagaggtgcccagggttggggtcggggctgggggcatgggctggagtgtgagggggggtggggggcatactcctcacccccgagtcctgtgcagtttcagaacagccccgagccggacctggagattgtggtttgctccggccacgggaagaacggggctttgtcggtgctgcaggtgtgtgggcaagtagggggcgggcgcctcctggtgggacctgggtgggctcacacccccatcacacccccaccccatcatcattctaaaaagagcatccggccccaggtggtgacaacctttgagcttcccggctgctatgacatgtggacagtcatcgccccggtgcgtaaggaggaggtaggtgcgagcctgctgcagggaggccctgggatgggaccggcgctgccttctcataggccgggggtgcccaggtcgcacctgcgtgcctgccttcactggactgtggcttccagcctgcccccctttggccctgacaggaggacaatcccaagggggagggcacagagcaggaacccagcaccacccctgaagcagacgacgatggccgcagacacggattcctgattctgagccgggaagactccaccatggtgaggggcagggcctgggacctgggacctgggacctggggctggggtcccctgcggggggcgcctccctcacagctgtcgcccgcagatcctgcagacggggcaggagatcatggagctggacaccagtggcttcgccactcagggccccacggtctttgctgggaacatcggggacaaccgctacattgtccaagtgtcaccactgggcatccgcctgctggaaggaggttggtgggggggtggttgggccctgggcatccgcctgctggaaggaggtaggtgggtggggacggtgggggggaggcgcatgctgactgccccatgcctacagtgaatcagctgcaatttatccccgtggacttgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatgtaggccccctcattcccggcgccctcctgtccctgccccttgcccgccgctgagcccacccctctccccacagcagtccaaggtgattacgctgtgcctgtaccgagacctcagcggcatgttcaccactgagagccgcctgggtggggcccgtgacgagctcgggggccgcagtggcccggaggccgagggcctgggctcagagactaggtgcgtgggggctgggggcgcaggtaggggcttgagtccctggggctggcaggccgcccatgaccttctgctggcccccagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggaggtaggtggtgccctgcactgtggcccagcgggttccacccacctgcctccactgactgctgcccaccctgcagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgagtgcgcctggcctggcctccccttcccatcttccccctggccctgcccgttcccccacagccccgccccttcccgtggctccaccccatctcccccacggccccgccccttcccgtggctccaccccatctccctcacagccccgccccttcccatacatggctccaccccatctcagccccgccccttacccacagcccacctcttcccatggcccatcccatgttctccatggccctgcccgttcccccatggctcccctcatcctgccaggtgcatgtggaccaagagctgcttatctacgaggccttcccccacgactctcagctcggccagggcaatctcaaagtccgctttaagaaggtgccagtggctggactgctggggcgtggggtgggtgtggtacaaggtgtgggtttcagaccggcagcccctggaggacctgcatggttcccccccaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtaggccagcgcctttgcaggggtctgtggtagaagggagacgcggcctcatccgcagcatcctcatccacagcatcctcacggtgcctgcccccaggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacaggtggggcccggccggttcccagcagcactggctgatgctgccccagctgggggctgagggggaggggacaggagaagggaccattggctccaccctgaggaccaggaaggagtgtccagagggcgatggggttgaggtcgaggaggtggaacctgtgacttggttgctccaaaggtctggaaaggggtggttgggagctggggctgcagcccctggggtccccaccactgctctgccggctcgccgggcaagccctcgcagggcctggcctccacacttctcaggagagctgacgtgagtgctagctctgccccttggctgctctgtgactttgggagggcacacaggctttctcatcctggttccctatttaagccaccacaccaccaggtcacttgagaccctgcctgggatgcggtgagtgcttcctgggtgcctgaggactcaggactgtccatgaaagagggcagccctggctccctctgcctggttttcagtccccagcatggcagtctgtgggctgccctttgcagcctccagtgccctcctggcctagctttcccatcccctgtggccagcacccctagccccagctgagcgtgggaaaatggacaggaggagccccagaggctgagtggcagccccttccaggacctcgccaggacacagctgcccctcacccacccctgctcccacagagctgagggcaacatcccagggctcttggcggcctgggcctgcctgcccctgcccttggctagccctggatcccctgacccctgtgcccccaccccagggcgagctgaggatcagtgtcctgcctgcctacctgtcctatgatgccccatggcctgtcaggaagatcccgctgcgctgcacggcccactatgtggcttaccacgtggagtctaaggtctgcccccacccccaccccaccagggaccttctgggcctggccgggccactggtgtgtgaccctcactaacccacaggtgtatgctgtggccaccagcaccaacacgccgtgtgcccgcatcccacgcatgactggcgaggagaaggagtttgagaccatcgagagaggtggtgacgcccacaccatactcccatcctcagccgcatcttggggaagccctactctgactgtcacccttggtccccacagatgagcggtacatccacccccagcaggaggccttctccatccagctcatctccccggtcagctgggaggctattcccaatgccaggtgaggctgggccggcgggggtggggtctgcccaaggcctccaggcagcatcctgaggcccctggcccccacaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcgggtaaggggccagtgagcgggggcgggaactggcagcccctctgccatccccacagccatcccacagccatacccatgccctccagatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaaggtgtgccagtcccacccggcgtgtgtcccccggctcaccctcacccggctccccgtccgcgcccgctcaccctcgccctcgcccccagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggtacacctgtggcggcggtgctcgtgtctgggtgggtacccgcccaaggcacctctgacgcccccttcccgcccccaggatgccaagcccctggaggtgtacagcgtggacttcatggtggacaatgcccagctgggttttctgggtatgtgggcagggccctggggagctgaggctctgggggtggccggggctgaccctgggcctctgctccccagtgtctgaccgcgaccgcaacctcatggtgtacatgtacctgcccgaaggtgagtgcttcctccaccccctctgcctgggccggggctgggctagcagtgacccctaggcctttctggtctagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttggtgagtgtgggggagcaggtgtgtctgggtggggggccctagggttggcctggctcacaccaaaaccctcaccctacccctgccagccaccctggacggcggcatcgggctgctgctgcccatgcaggagaagacctaccggcggctgctgatgctgcagaacgcgctgaccaccatgctgccacaccacgccggcctcaacccccgcgccttccggtgagccccggccccgcccgcgtgcagcaccccctccaccccagcctgccctgacacctgtgcctgtacgccccaggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacatagtgagtgcgcgccccgccccccgcgcgccccgcccctccgtgtgcatccccacccacccacccacccacccttccatcccctgcagatcctggacgacttgctggagacggaccgcgtcaccgcccacttctagccccgtggatgccgtcaccaccagcacacggaactacctcccaccccctttttgtacaaaacacaaggaaaaacattttttgcttgagaggagtgtgtggtcattacacggcctcctggcccagctgctgtcacagccccccagtgcgagtgcccacggggctcggggtgtctacacctctagccccgccacctccgtcagcccaaggtgaaaagggccctgctggccctgggcggctgcaccctaggtctccaggtactggtagagctcctccgctgggggcacgaggctcaggtggaccagagcacgagccaggagggcggtcagccgcatggccaaggtctccagcctgcgtgggtcaggtcacaggtcacaggtgggtggggagcaggcccccgccacccacctgccccgcggccactcacctgagcgccacttcaaacttgagcatctcccagacgaccttggcgtggcgcaggaggctggtgccgtagacaccccgatacgtggcgcccgccaggcggctccagccccggacagccctgcacacacccgcgttagcgccgcgtcagccccacaccagccccaccacggcccgggcgcctcctcgggccaccgaccttttagccataaggaagtagcggtccacgggggcgccgagggccacgttgatagcgcgcacggtgttgatgttgcgcagcaccagcagcatgggccgcggcagctccctgagcaccgccatgacggcctcgaagcgctcgcgggccatgtccaccatgtaggccgcctcttcgcggctcagtaggtgcgagccccacagctgccccaggcgcacggggcgctgcatgagcatctcggcgaacaggaggtagtctggggagggagggagggagggagggagggggctctgagtgggttccgcgccgcccgactcccttctgtggtgccccagccatccccgcacgccctcaccttgcaccccctcaccttgcacccccagtgcggctgcgtgcgccctcatggcggcgtcgtcccgcaggatgatggcccgccacagctggcagagggctgcgcggtccctgggtgtggatgggcccgcagccatgagctccctgcggcaggagaggcttgccctgccccacgcccacccacccgcgctcacttctcctccaggaactggtagagcccgtggtccagcagcaccagctccgctttcccgtccgggcctttccgcaccagaactagggatacagcctcttaggtcgcgctgcgcccaccccgagacccccacccctggggtaaattcctaccgttgccaggatgtgggtccgagtggatgaagccggtgtaaaatatctgctcagcaaaggccttgatgagcttttctgctatctggggagaggagaggcattgcagtggacacagcaccagcccgccctgacccgcccccgcccccccgcactcacgtcatgcactgccagcccctggctcctgatggcctccacatcgttgaccttgcagccggcgcagaagtcggcagtgagcacgcgctggggagagcaagaggctgggctcagcaggcccagcgctgtgcccaccccaagggcctggcccagcccaccttgctggacttgtcccagtgcacgcggggcaccacgacgtaggggaagtgcgccagctcccgcgcacagcgctctgcgttgcggccctcattctcgaagtccagctcctgggccagggtccccttcaggtcctgggggccagatggcggttgaagaccagctctgcctaccagctgctcctaccagctctgcctacgtgtttgctcctgctggccggggaaggggtggggctgtacctggaggacccagctgaagccaaagctggggtgcatgacctcaacgagccgcagcaggagctccagggtgtggatgtccccatcaaagcggtcccgcaggtcgatgtactgcacctgcactgggcgagggtgtggtgagaacttggggccccactgtgccccgccccagcccactgctgaacaaggcagcccccatataccttcacagccacgctggtgccatcgt

SEQ ID NO: 13785 - DNA, 10259 bp, Human
cttttccgggggctgtgtgtgtgtgtgtgtgtgttggggacgccttcagcacttggccaggcagtggacaacccaactgtatgcctgacttcctgcttacacagagcctcaaggtcagccagaagtgagagctcggggctggctcaggtctttcctgagcacgggcacggctcacacgtgtacacggctgcgagatgtcctggaatatctcagagcttttcagagcccctagtggcacctccttctccccagctgccaggcactgcctcaggcagccacagcgttcaaaaatcacctgtaaaggtttcaacaggcacacctcggcaaacagcttttttattcaggagagcttcaagtcaaatcagagacagccttgggagtggactcttaggtcagatgctgacagtcctctgggaatggggccctggaggagctcaagccctggcccaccccgcagcggctgccaggacgctgttcccacggggactgcagctgttggtttttaaggctgcagatggagtgggaatagggcatgtaaaatgccacaaagcctggctgggcacagaggctcacgcctgtaatcccagcactgcaggaggccaaggtgggcggattgattgaggtcaggaattcgagaccagtctgggcaacatggtgaaaccccatctctcctaaaaatacagaaatgagccgggcgtggtggcgcctatagtcagctactcgggaggctgaggcaggagaatcgcttgaactcgggaggctgaggcacgagaatcgcttgaactgggaggctgaggcacgagaatcgcttgaactgggatgcagaggctgcagtgagccatgttggtgctggtgcactccagcctgagcaagaccttgtctcagaaaaaaaaaaagttcacaaagcccactgttcttactaagattcagctgtttttcttgaataaatgctccccgtgctactgtaattctttggttaactttcagagttctggaaagttggcttggcgcttttcgccgtctctctcctgctgccttggggtcctttccgtgaccgtttccctccctgacacgtgtacatccctgtgtatttcacatctctctatgctggaaagaggttctccacttctagtgccacaccacgggggtctttctggctttttccctgtttgcatctgcagctcccttccctggcagggagaaacctgccccactgcccttcaccagtttcttcactgagtcagccgccccttcctatgcagacacccctcacccctctctggccctgcttcaggccccccttccccgccgtgtgggcttctcgctgtcccctaagccttcgatgtcccctctgagccaccgcggccacggccaacagggatgcctccctcaccagcgcctcctgatagctctgggcctgagctcggtagagaaatggaagaggaaggtatatgcagtgtttgactgtctctgtttcttgtctcacgtcacaaaacaagactgaatttggatttctgaacgcgactgtgttttcctcgggagtaatgaaattagggctccatttccttcgctgttcccaagggaaaggtcctgcttaaacaggtgctttgtgagtggaaacgtggccagagtgcggcgggtgctttgtgagtggaaatgtggccagagtgcggcggatgctttgtgagtggaaacgtggccttctctggaagccctggggaggggctttccgactgagaggaaggcctcgcatctgcccaccgcccagtcctgggcctcacagtgaggatgcaggtcacgctgcacagatgaggcccgtgtggcaggtggtcccaggaacgaactcgcctcccgccagccccctgggcctcccatggccccagccccatcaggtggaacgtgcactgcctgcgtttcagaaggggcggcctggggaaggggcggcttgggcacgctgcccctcaccaccacgcgtgacccacccatgtgtctccctttcagagcgggaacagcttccacgtgttcgaccagggccagtttgccaaggaggtgctgcccaagtacttcaagcacaacaacatggccagcttcgtgcggcagctcaacatgtgtgagtgctgcctccaggcagcgcaggggtgcgggaggcagacctgcagatggcgggaccccagcaggaggaccctgtgatgaaggacggggcgtcctgtgctggccaagggcatggcgtgggaccctgcaagcctgggggccggggagcagccgcctcttccatgggggagggtccttgtgggtatgaacctggggtccccatggaagaaccgtgaagccggagctgtactccacgtgtgtcgggcgcagggagccctgtggggacacagggtctcccttagaccaaggccactcggccacccaggcatgggctctgagggggcagggcagggtctgaccatggccaagccccgcagcagcctcctggagcagtggccgctcttcaggggttctggtcccgccctgaggcagagctgcccccttccctgttatgtgcagatggcttccggaaagtggtccacatcgagcagggcggcctggtcaagccagagagagacgacacggagttccagcacccatgcttcctgcgtggccaggagcagctccttgagaacatcaagaggaaagtgaccagtgtgagtgccggccctgcacccttgcccggtctcacctgccacagctctccccgcccgcccctccctgagggctcccaccccagcctgccccttcctgagggacctggctgcagtggacgagcctgagcctgccaagctcctaggctgctccagtgactcctgtccctctcgggaatccaggtgtccaccctgaagagtgaagacataaagatccgccaggacagcgtcaccaagctgctgacggacgtgcagctgatgaaggggaagcaggagtgcatggactccaagctcctggccatgaagcagtaggtcccacaccagcattatgggccacagcgggtcctggcgcccaccaagaggccccgggtgctgtgggggcagggccctgaccggggccaggtgctcagctccaccctcccgctccacgcacatctaccctgggcctctgccccagccccgccgcccgtggctgctgcaacagctctggggccagccgttttccatgtgcagaagggggttgggagggtcccctgctctgcacatccccagcgccctctgggccattggcttctgcctggctccgagcttggcgggacccaccagcctacttttgaggacaagccttgcacagcagacccgtcccacccgcctcgggcctggggtcagacccacctcaggcccttcctggaaccgctgtcccacactcgcctgggcccatggagctagcccccagcccctcctcaccgggaccctgcggctctggggaaaccttagcaggagcctaacacacggtggcacctgagaaactgaggcaagcccacctcggaaggccagctcaggtctcacgtccactttggggctccaggcatgcgggaaccccaatgccagtacggcttcctcggctccgtgcagcaggcgctcttgacccccacgtcatggaggaggccttggcctcagactctcctgcatggggtctagcaggagccaccggctttgtgattcctggagtccggccacgtggacctggcctaccaagaagactcacaggcttgacagggcccagcctcccagagcagcaggagcgcggtcatggccctgctcacctggctggggacagctcttccccacccctgagccacctccaggcctggcgagggccctgagcacctacaggacatgggacagccagtgtcgcagcctgaagaaccgtcctcccttaacctggctgctcaggccttggaagggcggcccaagggtctgctcctggcctgtgtccaaggcagccctccaggtgtttgccaggatggatgccaggatccgggtgcacctggctcgcatggatccatccccaacaccctacgtgacaccaggtgtccccggcagggaggggcagtgggaccagcaagccctggccctggcccccagtccctccacacacaagttctcatcctggggtgggccaggccagacatggtcacacttacccctgctcctgcatgggggacagggagggtctgtggggctccctcagccctggggctcatgggattgggccccactgacccagcctggtctgttgcagtgagaatgaggctctgtggcgggaggtggccagccttcggcagaagcatgcccagcaacagaaagtcgtcaacaaggtgggggcagggccagagggccggcgggggccccacaagggccggggtaactgtgtcctctctctccacagctcattcagttcctgatctcactggtgcagtcaaaccggatcctgggggtgaagagaaagatgtgaggttttggggatgcctgcatccaccacccggggcccagggctgtcccccttctctgtcagctgtgccccgggtaccccgaggtggggggtggtggctgacctgcacccttccccacagccccctgatgctgaacgacagtggctcagcacattccatgcccaagtatagccggcagttctccctggagcacgtccacggctcgggcccctactcggtgagtgccggagacagggcacccgcccaggcatgcaggcggcagtggggtgggttgcccctgccggcactgcatggacctcctgcctttgattgcaggccccctccccagcctacagcagctccagcctctacgcccctgatgctgtggccagctctggacccatcatctccgacatcaccgagctggctcctgccagccccatggcctcccccggcgggagcatagacgagaggtgggggccgcatcaccccagccatcctgtcccccaatgaggcgagcccctgtgggcccagggcagagttggggatgaggtggggctggccgagacgccagctcacctggcccccctcgtgtgcaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagtgagtgccgcccacccctggccccacccacagcgcctggacgcacagccctgggcttcagccccgactgtcccagtggactgagcagggcagctggcgaggcaggaccctacccccaacctcggggctcggggctggggagggagacaggtgccagccagatcaccccacagtcccaaacgccacagaagccacgggcatgtccggacaggctgccgggccctgctctcagccacccctcctgctgccgccaccctcgccacaggccacgggccctggcaggtcgtgctgcccagacacatggcaggagatggtgagcagggccggcctccacacccccagcccctgcctgcaatgggggctcttgtttttgtatcttgcagtttggctcgcactccacagatgtctagggtcgcccgcctcttcccctgcccctcttcctctccgcatggccaagtccagccagggttagcgctgaccccactggggagggaggagggctctgccagcgctcgggccctcccacacagccgtggaccagacccagcctggccgggcatgagcgtcgggcctgggcggcagcagccgagacccctctgtggcgggggctcagtgtcgtcatggctcccctggccacgggcctgtggtcattgcctgtgacagggatgacagggacaggcctccctgctctggcacggcctctggtgttggcaggatccagactgcggtgctgactgcacttcctgtcaggcagggtctccagggcacctctgggacccagcctggctgtccgtcccatagcccaggtgtgccctgtggcctagggctttcttggtcacagccaccagaccgtgggtctcatccccacagcagcaccagggcagggactgagccacccacacactgagcagagccccacctgttttcccagtgcaacgggaaacctcaccaaccctgaacactgaaatccctgatccttgtgctggagctgaatacgccccttgtctcctgggtccactgccaccaaggcccccaggccctcatggcaaagggatgcccagcataggcccagccgcacccctgcagggcacagagcctccactgccttccaggccgtcctcgaatgcgctgccccctccagcctgtgcaggcgtacacgggggtgcagcctggggggtacagtcaaggggagcccttctcccacaggagggcattggggtgtggggcctggggcactggttcaggtaccgccttatcccgggccaggaatgagctcagtgaccacttggatgctatggactccaacctggataacctgcagaccatgctgagcagccacggcttcagcgtggacaccagtgccctgctggacgtgagtggagccccgccgccccgcctccccgccccgcctccccgcgcctccccgcctccccgcctcgcctcgccgcctccccgcttccccgcgccgcctccccgcctccccgcgccgcctccccgcctccccgcgccgcctccccgcctccccgcttccccgccccgcccccgggtgctgttctgacttccctccctcctccgcagctgttcagcccctcggtgaccgtgcccgacatgagcctgcctgaccttgacagcagcctggccagtgtgcgtaggcgggcggggggtgagggggaacgagaccagcgggagtgctcacaataccgtctccaccccacagatccaagagctcctgtctccccaggagccccccaggcctcccgaggcagagaacagcagcccggattcaggtgagccaagtcccaccggccccacctttgcccccaaccccccaccgccttgacacccccacccccgcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatgctatggcctccatgtgtttcctctgtcccagggtggtgcggtgggtggtgctgcaatgaggaggggcccagggcacagaagggccgggctgcagtggcctcctgggggaagacggatgcttgcagctagctccgtgcctgcccgactccccaggaccagcatgtgcttgcagttctttattgagggaccaggggtgggcgcctcaccttggccctgggggtctctggttgtcacaggaccaccaggaacccccttcccaaggtgttcgcactcggacaggtgatgcggggcgggcacactgtctttctgccagagccagcaccctgtgtaggcacggggaacgggagcctgtcccgtagctttagggttctccactcagcctggtggaggaagggaagggggcctgcgctgggcagtggagcaggctttgctgctttatctggcagcaacagtttgttctcgagctccactggccaactgatagggagaggcacaggagcccatgtgggatggaggagtcggccccacacccatccccccaccaggagctcacccactactgccatcctcagcagggcccaaggagatgcctccatctcagggcccaccagcccccactggggtagagggaggataccaccaagggagcccaccctcccctcacaccaccagttcagcaggttgctgatgaggcccctggtgcagtcctgggaccctgtgcagggcctcctcaaacacctgccttgttgggccatagctgcaggtctggggacaccagggcctggtccagtcttggggtctttaatcaagcagtcaccccagcaaggtaaggcagcagcagggccctggggttacccctgacctcccgctaccatcaaggggggccccatctatccagcttggtggattgcagggcctgggaacaaggtgtcctgaaggctgcagggctgcgctgtctgcactgcccagcctggtgccagaagagcagagggcaaggcaggcctggggatcaggggtgccccaacctcgtggagggcagctgagagccaccagcccacctggctgcccaggttccaagtgaaggaaagaggctgccaaaccgagccctgccccaaggcgaatagccatggacatagccattgtgtaccgtagcccctcggctcaccagacccacaccagaaaggccctgtggactgcccatccctgggccatcctggctggagcccacttcccgcaaacccagggccgacctcttcccaagctgaagctgagcacggtgggtgcaagttgaccatcctgcactgagggccagagtgccgattcccgcacacccagcaggagtagcaccaggagaggacgcctgagctgagcttttctaggtaggggagtgtggggaatgggggcgtctgcctggccttgcactccccctaccggccatgcccgccctgctgcagtggagctgctgctccccggcaggtcctgggacagctgtccacacagctctggcactcgcccttgtgggtgtggccataccccccaccaggccccaggcccctggcaggctgaagaggtcactggacagcactttattgacaccctcggacccggggcagggtcagcaagactcccagctggcatcagactgtgtctggcctgctgtcgccatccctgaggggtgcaggacagagccccataggggcagagaggcctccctgggaccagaggaggatgctgtgcagccaggcccatccccagcactcgaggcctaggaggagaggtgggctctggcagcgggtgtgaggtggcagtgagaagccaggccctcaggtgcagctcaggcctctgccgctggggcctcatagttgagcacgtagtagtcgtggacgtacatgaggacggctattggctgtccgatgatgagcgacagccacacagctgcgttgccatagttgccctggaaaaagcggcccacgaaccaggccagtgggatctagggagtgaggggccaagtcagtcggccatggtgaccacagggctgggggcttcagggtccctgggcatggggagggtcagccgaggggttcaggtgcggggtaactgggcgagtgaggaggccacgtgggggtcactcacctgagccatcatgcccgtgaacgcccagaggcggaacattcgcagagggacgctcaccaggtactgagatgggagggagagaggatgccagggagtggggtgtcagccgtccctgctgtgggcatacccctgcccagggatgaggcaagatgccccccagagcactgacctcgtggaagaaggccgaggccaggaacacccctgtcctggccatccacttgctgctgccccgtcgaagcatgggcttgtagaagtgtctgcagaggagggggcatggaaagcggttcaggttcacagccatgttccacatcacacacacacacaccccacctac

SEQ ID NO: 13786 - DNA, 7107 bp, Human
tgtatcctgcggtccccatttgtttccttcgtcttgagaatggggttcccatcaggcggccagcacccacttccaccccacccatctcagctgtgctgacgtgcccagcacctgcaacaggacctctccccccgaggggctccccagatgaaaactggcagccaggtgcctcggaggctctcggcctcaaggggccgggacagccaagtgacctactagggaacatcccagatgtcccagaaggcccccgccacccagactgctgtccccacatcttcttaccttaagccaggagcatcactccgttcggatccacgcccagggccagagtacgctgctgagggaaacataccccagctgacttgggaagaccccaaagccccgagaagttccaagtcccagccgaagtcacacacacctcaggctcatagctctccgtcctcagccaagcctcggcgtggcaggcagagcccactccggctagcaccggcccttatcctttggtgggtgacacagaggggttgctgggctggacagactgcacctctggaccactgctgggggctcatccacctcccccggctgccagagtagaagggaggccctgcaccagggcctcaacttggcagggccctgaatgagccagttctcctgggtacccagagtaagagacaccacagccacagtggccttgcaaagcctcatggacccctgctctgtgcccagtgccattctaagtactcgatgtgaattaactgaatcctgatgaactgttatcgtctcatgttttatatggggaaactgatgcgcagagaggttaagtgacttgcccaaggacacaaagctagtaagtgtccaaaccaggataactgtccggctccagaagccacacagtaagccttgatcctgtgctgcctcaaagacgggacagctccctctcaagtacgtgttggggctcaggaccagaggccctaggattgtgtgccaggtccaatgtgctgtgtgaccctgagggaagtgcctcaccctgtctgggcctcagtttccccatcaagggtgttagactcaatccctgagcccctttgaatgctgaggttttgggggtctgtgatgacaaaagttggggacagaggatggaacacccttgccttggagcccattgagaagccacattcctgggggagcaggggcagagtctgggctggacactgtgaccaggttggggtctgggtccccaagtttgtctgactgctgtctcactttgctgccaaggcaggttagggtggcatccagtcactgtgtggccacgagtcggctccagagacacaggcccagggtgaggtggaggccagagctcctgtgaactcagtgcccacaacccaggtgtgagcgcacagaacctccgcgtgctgcacctgggcaggagaggcacgtgtgtccccagcagaggccttgtgatgagaaccagtcctttctctgccacagagactcagtcttgctctctctctgcctccattttcttgtcttcaaaagcgggttccaactcccagtctcacacggtcattggagccctttacacatccacggccttcccagctgttaacatgggccggtggggagaggaacctgcctgggcagggctgctgggaggcctgagctgactctgccctcagccccaccaccgcatcctaggcctctcctctgcgaggctgggaaggaggatttaaaaagaagaatagaccccctcctctgttctgttgctgctgtgggggggctcccatggcccctcttggcccggggcacgctccaaccagcttcccggcaggtctgtgttcggagtcctggcgggggaggccccgggcagcctagggcaggaagaggagagccaggtctagaactaggggtcccccagatgggccttgggaaccagagcccaaggtcattcttcaggaagccctcctggggttgtctcgagctggaactgacctcttccctgctgtcctccaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgtggaaggagtccagtgcccggtttctagggctatgcatggaggtggggtggggtgggggagaggatggagacctcctgctgttgcccaggaggaacaggaacagagacacccagcaccttcatctccttgcttccaacttcttcaggaatggccgcagagaccaccctggccacaggacagccggtgaggcctgctcctgtatggctgggaccccaggagagcatcaaataggtcttcaaagtgccacaacccttccaccaatcatgagcgggctgtgagtcttcccagccgtgttgggaggaattcctatgcctgttcctcagattcacatttcgggagggggcagaggcagagggagagtccaagtgccttggtgagaacccccctctgaggctcgtgtttcaagatctgtggcaagctagcagcagtggggattgggagtaagcggcaacttcagtgcccccattttgcagatgagacaactgcggtgcaaagaaggagtgtcatcaaggtccatgtctccctggggttgtccatggctgaactgggaccacagcccaacaatggtagcatgggtgtgatggtgtggggacctggcttgacagcccccctcccaccttgccagcaaggaggcctggtccacttgggatttgtaccaacacacagcccagagcctggccagttgggatttgtgaagggaaatttttacaaaacagaccttatttttgagtgatgcccaccgacttcaaaaaccactcccaaagctttgccctgctcagtttggttggtctgcctgaaactcagctcccaacaagaagcttccatttccctagcccggcatccccttttacccaaaagacagcaggtccatctctggacaggacctcagccgtggctacagaacttctctgttggtctgctctgggcagcctctgccagggttggtcctgaaacggcatctacatggccaaaactgtttctatttatttggggtcactttgtaggggatggtagcactcctcaccaggcacactttggtgccacagcagatcggagaggagctgtgccctccagagttcctgactcaaatctccatcacctgcaccctagcaggcacgaaccagcacacccagcttgccaaggggaaactcaaggtcccgagaagtctcagcttgcctgaggtcccagggctgcgggaggaagtgctgcagtagccacagcagcctgcaggtggcaatagggggcggcatccctgggcagcaggtggagagagtggacatcatcccctttggacaagggtgaggagaggctgccttggttacagcaagaattcaggtaaggtattaagaagaacttcccaacctcaggtgactcattcccgaaagggccagctaaaggtcttgatgtggggaaggttttcccttcccgagccgtgtggcagtgggaggtccctgtccctctctgagtctccctttttggtcatacgctgaatgagcaccggccgtgtgccaggtgtggagtaggaccccacaccccataatcgtctgctttgggacagggtgtacctggcttgaaggcagggttgactttcatagttttacaaccctggcctcctggaccctgggcccagccccacccatgtcccctgagccaccagcaagagcttaggtcatgtagaagccagttcagattgaggaagccatttagttccacagcctgggagcccctggactccagaattccgctttggaggctctaggagtcctgttgatctgggctggactttgagtccctccagtttcttcagcccccacagcttgaggttggcccagatgggcccaatgatggacccagagagccggctgtggcctgggggctcccagaagtggcctcctgtggggtgaagtggcccagatggacccgccttgccggcccctaggagcagccctgc

SEQ ID NO: 13787 - DNA, 34779 bp, Human
aaaatatgaaaaaatcaagacattttcaaaatacaactggaaaatttctacctagccgcacacccaacactgcttttactgtttttctatacattatgattaaatctgtagtcccatacgtgcactgatttttcaaatgcaaattccaccaaaatttatagggatggccatgaacactgaaaaagatcatcagagctataaatggatactactgccttaaaagctgattaaagggaaatgatggctcacctgtatctacattcatattaactgctattttggtgcttaagcaaatgaacacattacttttaggttttcagaaagaatgcagcatatatatatttctcacaattactcttaagagctgctgaaaaagtatttttttagacctaaccaagtaagacaaaatgccacaaagtcgagaaagttcattttacctcattgtttgttatttaaacaaataattttggaaaaaaaaagtcactgtgatatactcaataataaagagtaagacttctaaagtatcctcacgattcctggagcttactactattaacacagtaaattacatgccacgatatgttggagaaggtctgaagaaatgtctggcattacttggtaactgaagtacataacataaaataccaatttacacacacacacacacacacacacacacacacatatatatatatatatatacctagtcctgtgatgacaattcagaatatgatcttacatttgagtacccacaggatggggtgggagaaactacgcctaagaagctacaaaatctattttggtcaagaaacaatgctgttcttaacttaagagaccttaacaggccgggcgcagtgcctcgcgcctataatcctagcattctgggaggccgaggcgggtggatcacgaggtcacgagatcgagaccatcctggctaacacggtgaaaccccgtctctactacaaacgcaaaaaattagcccagacgtggtggcaggcgcctgttgtcccagctactcgggaggctgaggcaggagaatcgcttgaacccaggaggcggaggatgcagtgagccgagaccgcgccactgcactccagcctgggtaacagagcgagactctcaaaacaaacaaacaaacaaaaaaaaacccttaataaaaatggccatggacacatacatatactaggttattaaatctggctaacactgaactttaagaacaatcacgtttttggataaagaaaagggcagtcatacttttagagcctcatccacattattttaaacaaaaaacttaaaatatggtcgagaactaacaggcttccagcctgaattcaacacccaccctcgtgataaaactaaaaaatcggacagtctgtaagtaaaatacagggacactttactaccctgaaaatcatgctgggttcccgctacgccgggcagacgttttcaggagcatcaccgcgcggcgtctcggacgcacttctcctggcgccctccgggcggcagcgctctcgagacactgttgcttcgccgtcacgcccgtcgttgtcacgcccttccccgcggacaccgagaatgacccatagcggaaaattctaccgcactacctccctgaggcagcgaccggtaagaaacaaccttttcttcaggcttcccaccacccaaacacagtcgcagtcaactggccactatcacccaccaccctgcaggaacaattacccagcctcaccccaagaacgcgcggagaggaggtgccaaaagaaattctgttctcgcgaagtcttaaacttaatcctcgcgacgtctctgttcctgtcgttctttctcagccctaacccacaccagcgcgttgcctcggaaacatcgcgagattttgttccttcagtctccgcccctttacggcacgatggtcgcgcaagaatgtaatagagcttcgacggcccggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcaggtaagtgtggaccgcgcggcggaatcccgaaagctcacggtaattggccgctgactgagtaggccgctacccttaagcgcatgaggaagaggaaagaggtgttcttccgggctgaaatgtgaagagacacgtttccccatgttggtaataacgattagagaccagaacccagttttgtgttcttggtgcctaatccacttagaaccccgacgcgtgctacgcaaagaaggcctgaagtctttctcccgcttctgcggcactcgcgtgtctccagtgagctagtttagataaagatcctcttccaggggataaagcgcagttagtttcacacaatttaatggaaggttctggtaatgagtttgggaaagaactagggtctgtcctggagccatagcaagggaagggatttatcattaaagtagcctttacagctcatttccgttctctctcgcaattaaaaccgctttcagtaccattcaccgtcacacctctacaaggaagggacttgaaagcagcctttttctgggcgggatttacgtgtcagtctgttccaccagtccgccccccttatttctcaaaatggcctcaggcccattataccagaggtttcaatttgaatctgcctctcagttcagagtcgtaaactgaccagacctctttgtattacgtagtgcgtgcatttgccctgaaggcaccactttcccagacgaaagctgttaaaatagtgcgtgtattccaggaaaataaaagataccttaatttgaactttacattcttagatagtcccctaatatatttaacatttcaaaatgtatggtgttggtatagatttgcatgtaagcaaaagaatcctattctctgtgacactatgcatattgtactaggtgctgggcattttttactagttttaagctaatgataattagaaaccagtgttgtgctgtgttttcgttgcattaggagttcacttagttaactttttaccgggacagttgaaggaacattgagtcaaaattagaattcataaaatccgttgtaacacatctaatgtgaacgcattataaacatgtacctgtacttttttataaccagaaatactaggagtagtcaacaaaaggtcatcattaatattagttctgcggttttttccacgtaatttaagaaattctgaacatgtttagcaacaagcatataactatgacaaacactcttagcgtgttttattagattgatttgtaaaacttaagggaactattttatttactggaaccaactattttattttaccagaaccagcacattggattaattggtatcgcacactgtaggtagatactggagttttgttttgttttgtttgagacggagtctccctctgtcgcccagactggagtgcagtggtgcgatctcgtcccactgcaacctctgcctcccggcttcaagcaattctcctgcctcagcctcccgagtagctgggattacaggcgcccgccaccatgcccggctaattttttgtgttttttttgtttgtttgtttgttttcagtagagacagggtttcaccatgctggccaggctggtctcgaactcctgacctcgtgatccgcccgtcttggcctcccaaagctgggattacaggcgtgagccgctgcgcccggccttgttttttttcgtttgtttgttttaatgcatgaattgtttcctactaagaagctatgatatagttccttgaccaaatgcagatgaacaggattatctgattaatactttaacgagagcagacaaaatatggatatttaattcatccacttgctttataagtgtttatagagtttgttaggaggggatgcccaatttcctaagtaaaggtgatatatgagcaagacattataaaatgaaagagagtttggccagtgaagaaaagaagcagcatgcgcagaggtgtggggacttgagggaatggcaaggacccagaagtgaagtcgctagaagatgggggtgggaggacgtgaaacgaggcaaggaaaggtacaagcggatccagatactggaagaccttgtgttgcaatgctttaattaaaaattggatttcaggccgggtacggtggctcacgcctgtagtcccagcactttgggaggctgaggcaggcagatcacttgaagtcggagtttaagaccagcctggccaacatggtgaaaccccatctttacaaaaaatacaaaaagtagccgggcttggtggcctgtgcctgtagtcctagctacttgggaggctgaggcccaagaaccgcttcaacctgggaagtggaggttgcagtgagtggagatcacgctgctgcactccagcctggtcatagagcgagaccctgtctcaaaaaaaaaaaaattggattttattattaggctaagccataatttctttatacttcttaaaatatagaaattgttggcaaattgtgaaatttattgttgtataatgctaatagatcagttgtcctgatgtctttgctgtaatgatttctttataaaaatgatcttaaatctgagctccctaactttagtttttgcctggaattacccattacatttgatgatatctctaaatgtcagttgtagctgttactctgatgatataagtggaatatacagaagcgtacttagacaaaagttaggttaatatctgaactacttcctccttgtgtatttaagagaatattgacttaagtttctagaatcctcaactaatcctaagtttattttctttgtctagaatactatgctgtttttgtttttggaaggaagagatataggcatagtttcctgctctcaaggagcttcaaaggctgtaccagtggggatgccattggtatttttagctggatagttgttattcagaaaagcaggacaagtaattatgattcctggtccgtacctggtaatgccagtaatgttaactctagctggttgttgacatctggtcatttagttgccaatcttctttttttttttctggcttttatgtgaaatttttagatttttataatatcctgagctaaattcaacacagggacaccagattgctgctttagttcagggtttccagcctgtgcacttaagaaatttatttttgtgtatatcaagctgtaactccagagattgggattgtttgattgggtctttagcagtggtactaatagcaacttctgtctctagaacattggaaaattaaaatgtgtttatctaccgtttttttcctcgaggttatatgaaggtagaaatgaatcagactagatgattagctaagcgagactattaaccctcatcccttcccctctagacaactatgaaattagtcattatgtattcgatccttcttgcagtctcttctctgacagttataaaagtgatttaggctgcataatgttgtttgaatgaaatgaaaatatagactagagctgtttttttttttatttccatcagtctcttcagtgaaaactaacatttgagcatgattctttttttaaatcattttgtgacagtttagcaaggcttgtgataagcaagttatggtatggtaatatttctagtgtccacgtttcttcacatgtctggtgtatgggaactactaactccatcaggaccttgcctatagtaggtactcaacatttactgaattaaatcaataaacatttttaatgaattacagtacaagtcagacctctgtatctgtgggctctgcatctgcaaattcagccaaccatggatcagaaatattagaaaaatggaagaacagtccagcaatacaagtaatatgaataaaaacaatacaacaactatgtacattgtatcaggtattataagtaatttagagatgctttaagtatactgaaggatttgcgtaggttatatgcagatactgtaccattttatataaggaacttgagcatctgtggattttggtatttgcatggttcctggaaccaatcccccagggatactgagggactatagttgatcataccacctgattttagagattttctgagtctcagaagttaattaagtaaactacaatagtctgttcttaacctcggaggatacattccaagaacctcagtgaatatctgaaaccacagatagtattgaatccaatatatacacggtaatattttttcctatacatatgtatctataaagtttaaattctaaatcagacacagtattaacgataataataaattagtgcaagactgggcatagtggttcacacctataatcttaacactttaactatgacgttgtctttgaaaagaaatcagctagccaaggtggctcatggctgtaatcctagtgttttgagaagctaagtcaggaagattgcttgagcccaggagtctgagaccaccctaggcaacatggtgaaaccctgtttctataaaaaataccaaaaaataggctgggcgcggtggctcacgcctgtaatctcagcactttgggaggctgaggcgggtggatcacgaggtcaggagattgagaccgtcctggctaacacggtgaaaccccgtctctactaaaaatacaaaaaattagccgggagtagtgggcgcctgtagtcccagctactcaggagactgaggcaggagaatggcgtgaacccgggaggtggagcttgcagtgaaccgagatcgcgccactgcatgccagcctgggcaacagagcgagactccatctcaaaaaaaaaaaaaaaaaaaccaaaaaattagccagacgtggtggtgcttgcctgtagtaccagctatccagaaggctgaggtgggaggattgcttgaacttgggaggtcaagtctagaatgttgacaatgttgggtcctttatgtagttgcataagtgagccatgatcgtgccactgcactacatccttgggcaacagcctgaccctgtctcaaaattttaatttaattaaaaaaataaaatagaacaattacaacaatacactgtattactggacaagaagggcaaatttaaaaaaaattaaaccaatatgctataataagttatatgaatgaggggaccctcccctaccccagaatatctgattgtactatatcataggtaactgaaaccgtgaagagcaaaaactgaagataaagagactactgtgtcttttaagtttcttttcaactcccaaattcttggatttctcacctcttggcttcctcaatagaggtgagaaatgttaaagtagtgaaaacaggaaaaataacttactcattcaagaagtagataatggtccagatggaaagcttgaattatttttgtaaaactaaaattaaataaagtagccaggcatggtggcttacgcctgtaatcccagcactttgggaggctgaggcgggtggatcacttgcggtcaggagttcaagaccagcctggccaacaaggtgaaaccctgtctatactaaaaatacaaaaattagctgagcatggtggcgggcgcctgtaatcccagctactcgagaggctgaggcaggagaatcgcttgaacttggggggcggacattgcagtgagcccagatcacgccactgcactctagtctgggtaacatcttgagactccatctcaaataataataataattaaataaagtaaaaagtttcccacacctcataaatgtctaataaaaattgaatatgttgagttcaagtactctgaaaaaggagttgaatatagttggaggttggtttttaggaattactatttttcttaaattaactatccttgtagtcacctaggaattgtgtattttctatagatcttagaaaattatcaaatctacagttcattttgttttttcagttttttttttttttttaagagatggagtcttgctgtattagcgttgaactcctggcctcagccagttctcccatctcagcttctgaagtagctggggctgcaggtgccactgagcctggcttctttattggtatttttattaaacacttttctctaatgtctttgtaacagttctcagtttttgaaatgctgttactgtttctttagtgtgaactgtcaactttcattttttcttttcttttcttttcttttctttttttcttttttgagacagagtctcgctctgtcacccagactggagtgcagtggtgcgatcttggctcactgcgacctctgcctcccgggttcaagtgattctcctgcctgagcctcccgagtagctggaattacaggtgcgcaccactgtgcctggctaattttttttttttttttttgtatttttagtagaggtggtgtttcaccatgtcagtcaggctggtcttgaactcctgaactcatgatcccccccgccctgcctcggcctcccaaagtgctgggattacaggcatgagccaccacgcctggcctcagctttcattttcatttggttagtttttgaactattcagtgggtaaagttgtataaataagtgtcttttctctgtatagaagtgtcttggagttcaaggagtgctgctttgcaaactcatagagtatttataaaagctaactgcagaaggtattcataggctaaaccgtttcctattcttggtagcaccattttctctggcctgaaatactttccttctactattagtgcctgtcgatacccagcagtgtatttactttcctgaggaacaattcaaatgctaagtgctttaagacctaagggtggaaaagcagtgttttcaggcattattaggaaaataagatttaaattagacacccagaaacaaaaacaggtttgtaattggtaaagtgaaagatggttaaagaaggttagattgaccaaagcgagaatttaccttttttttttttttttttttgagacagagtctcatgccgttgcccaggctggagtgcagtggcgtgatcttggctcaccgtaacctccacttcctgggttcaagcagttctcccacctgagcctcccgagtagctgggtgacatgcgccaccacgctcagctaatttctttgtatttttagtagagactgggtttctccatgttggtcaggctggtctcgaactcctgacctcagtgatctgcccgccttggcctcccaaaatgctgggattacaggcatgagccactgtgtccggctgagagtgtacctttttttttttttatcaagcaatctagtacttgatcctaataatctttgtggtaggtgtttgcatttttagatgaggaaaagggaaatctatgagtcctaggaaatacagttggtatatgggaactgatatgtaattagacttaagtgatccatgttgaatttatgacttaagcacttaactataatcttaacctctccagttgtctgatgaagttagtatatgggaactgatacatagacttaagtgatccatgttgaatttatgacttcagcacttaactataattttaccctctccagttgtctgatgataataaaaacttgaagcagttatccatatggggatctctttggggaatcccagtcaccaaaagttaggttttctttaatattttttcatggaagatttcaaatatactcaaaattgaaagaattatataataaattctcatgagcccatcacacatcaataatgaatgtacagcattgcagtgtggagcttggcctattgctgaccactcagcaatgtggcagaaccactccatgattccccatggaaatgggaactacttcggttgtccttttatagaaaaattcagtaagtatctgctgattgtgccctacttgtgacttgaagccaggtttttttttttgttttttattttttttgttttgttttgtttgtaacagtcttgctctgtcatccaagaggggcatgatattggtgcactgcaacctccacctcctgggttcaagtgattctcgtgcctcagcctcccgagtagctgggactatgggcgtgcaccaccacacctggctaatttttgtatttagtagagatggagtttcatcatgttgcccaggctgctctcgaactcctgagctcaagcaatctacccacctccacctcccaaagtgctaagattacaggcatgagccaccatgacagcaaagctgggtatttcttaaattggttcagtcaggtgcaataaattatttgccctactctaaaatttaaaaatcttctaagaattatggttttgcagctgaggtttttttaagactcgagctccctggactcctacatatatccttagaacaacattgtccaatagaagtacaatgtgagccacatgttttgtttaacccagcatatccaaaatattaccccctttgcatgtgcttaatataaaaatttaagatgatttatattccaggttttcaatattcagtgagtaattttacacttagagcaagtatcatttcagactagtcacattttgagtactcaataaccacatatggctagtggctaccttactagatagcatagcctttgagtcccacaaagtgttcacattctatgtgtttacacacatcttttgaagtgtcatgacagagccagataggatccagattttctttaaatctggtctctcttccggattcctagttgattacttctttgttgcttcttatagggatgtatcagaagtttaataatcttatgattattatgttaactgcctgaagtattaatggtagcaataaattgaactataattttaatttttcaagtaaattttcttatgtgatactaaatatttcacatatacatgtatcaggaagtaaatgggggtaatttagtaatgaatagtatataatagtttatgatggtatttttcttttttttttttagattgcagcaaaaattggaggtgatgcagggacatcactgaattcaaatgactatggttatgggggacaaaaaagacctttagaagatggaggtaagttatactctaagtattttaaattgtttttcagagtgtttagttgaagtgattctcggtatttttctgttattttattgagatattaacttttattataaggttgttaaaattgtaagctgtatattggcctaaaaggggggaaagaaaactagacaaggtaagtaaaatttgaaagaaattttttaaaaaattttttaaaaaaggaagttttgtcttaatagaaaacaatttattttccctcttttaggattgtgccagattgaaagtttgcacagacgtcttgttaataatattaaaaaacatataaattgcttagaagacacttcactggttttactcatacgtgaatggattttaatatgctgtattttcgtcatttttctatttccaattgcaccttaaaggttgaaattcctatagtttgctactctagtgtgttgcaggttataccattttttttttaatgttctttactttcagtacttttgtgtttcacgtttagctttaaacctgtggattaaaacagtggatttacagtgctatgtatttttaaaaatcgtaatcgttgaagcttctgaacttagaagtctgcatgtattttttgttttaggtttgatatatgagttttgatacattttctttttacccttttttttaaagggaggattctcactgaggctatagaatgtatttgtagcttttgaccaggagaacttggtttccttttatttaagtgtctttcatatttatagtgaggtttttaatgtagaaaaaaaatgagctaatgatgcttcagatgttgtatgtaatgtattctttttattttatgtgtagatggctcttggacaagtccgagcagtacaacacactgggagggaatgccctctccttttaaaggcaggaatttttatttattacctgtgttcagtatgtaaacgtgaaataaaccagtggattcttaaatggacacaaatatttcttggattatgtgtctgcgcatattttatttttgctgcacaacattctgatgtttaatcatttaagtttgaaggggggaggagaatgtagtactttgagctataggttgtctgttccaaggtatgcattgtattcatctgtgtaatggatttaggtgaaggtagtcatgtagttgctttgagattttatttttttgctaaagttttatgcagtgaaatgtttgtttataaataatagaacagtttaggttgagattgccttgtaatgttgtggggggtttttttgtttttttttttttgggcatagctttgtggtcactgtcagatacactttaatatgtcagatttttgtagtttgataggcttttctccccccagtcttcagttcctgaggtggaagcatcattagcctttagcatgtgatattttgctagtaatggacctaaagtacgttgtcttgtgtcattctaatgtgcttaacatacattaaggtcagtgatttcttaagaatcagataactattttaatgtctgtgcatcttttgaacgtgaagagaatgaagtatcgtttcttttttagattactgagttggggttgaattttggcagttttggttcaaatgataaaccataccttcagatatttcaataaatgtttatattgttatttattcttgtttgggaggggagaagctttgtacttaattggcaaaaaattaaaagacacttaattttgcagatcaaccagatgctaagaaagttgctcctcaaaatgactgtaagtattccttttaaactgggtcaaaagctaaagtaacaatttcaatgttaagattttgttcatattattgggtatctttgaagttagttggtttatgagtattttggatcagctagcctgaatttctttgtaaatatatacctttttctcctattttacaatctgtcccattaattgtggccgggtatatgtaaagattggttgctgaattattttacatatttaacaactccaattcttgatctatacttgtacaacttgaaaaaggaaattattttgttctgtgccattgctaatataatgtcttccctttcattggctctcttgcccctgtcaatgccaatataaatattgtgtaaaaaatttgactctcttcaaggtgttgtctgtgcattagggagagatttttgaatgtttgatgtgattgtgttgttaaatatataagtaaatttaaattttgaatttttgttttatttttatttaattttttgatagcttttggaacacagttaccaccgatgcatcagcagcaaaggtatagtcacaagattttcaaaaagtactctgcaagttttggttgagctgtatgtaaaaacacaaccacattggtgtatattgaatatgtgtctgtgtattttttggtgtacctagttcatatcactccccttgggaaggtaccataaagtgatgatttttcttttgagtgagaaaaatttgtgatttggagagataggtggaattaaccacattttagaagaacaggggtgaattagagtaactgttaagatgacattctctaaactccacttcaacttctttacagttaatgccttcagactgttccattcatcatcccttcttcacttgatgtgtcatcttaaatttcttaatttaactactcaagtaataagatcatattttttgacatgagtctgagcctagaaccttagtttaagccattgggagacattagacttccatttttattaatagattatcttttatttgtaaacaaagtatctttcattgaaggaaaatggtgctttctgttatttcttagcagatctgtaatgacagaagaatacaaagttccagatggaatggttggattcagtaagtaacttgatttttaaagttttgaaaacatgatcaaaacatactttagaatctttcaaccaaaaaaaaaatttttttttttctaactagtaattggcagaggaggtgaacagatctcacgcatacaacaggaatctggatgcaaaatacagatagctcctggtaatgttacattctcatggtattttcagtgtgactagaaaactagcttttttttttttttaagccttctagtaacaataatgctacttttaatcttttgacctgaagttatctgtttgttttaaattgtagacagtggtggccttccagaaaggtcctgtatgttaactggaacacctgaatctgtccagtaagtttgaaaaatcttaaaaatctacttaagtaacaacagcagaactctttgaattttgtctcttctctttgttactgctttattttacactgtggtttcgctgccaccttccctcaaagtcctccaactcctttgaagtttatgcctcatgcctttctcaggtggggttcatcatctgaatcattaaacacagaaaatggttaaaacaactccatatctactccagtctctacttgtaaagccacgtgtagcctggagaagaatgcacagtcaggtcgactggtgacacttaaaactcagacattaagctcaagtggactgttgtgttgcctgcatttccctagttccattcacttttccactcctctcccaggctctttaatactgtatttccccacctccaaatcttcagcatctaaccccacgctctcccacttaagcttatttactgagaaaatggaagcaaatgataagaagcttttctttttccctaccactaaacctaccagccttcatttttcctctgttcacatagtactcaggtaattgctttccttttgtgttcgagtgcctaaagccagccctttcttcctactgaaggttcagcttgcagttgtactttcttctgcattgttagttctccctcattactaggttttttcttttcttttttttgagacgaagtctcgctctgttgccaggctggagtgcaggggcacgatctcggctcactgcaacctccgcctcccgagtagctgggactaccggtgcatgccaccacacccagctaatttttgtatttttttagtagagacagggtttcaccatgttggccgggatggtctcaatctcttgacctcgtgatccacccacctcggcctcccaaagtcctgggattacaggcgtgagccacttcccccagcctgattttctttatggcactttccaaataatgtgttattcatttgacatgttatttttacttatttaatgaaatgaagccactctagcaggaaccctgtttctttgagtgctattaccccattacctagaatagcacctgcacatagttgatatttaaatatttgttgaatgaataattgtagcatatgagtaagcaaaatggtagtttaaaaatgtaaataaatcatttagttcttggaagaatcagtttaattctgagataactttagcattagagttctttcttggaaattttggactattcttaaaaataaaaattgtatatctagaaaatttttttgcataatctctcaatctttgacccttgatggcattttctttcagttaaaagtaaaagcattgttaaagttagcatcaaggcacctaatcctgaactgggataggaggagtacttggttatattgttttatatttctctatttgaataagcttgggtatgctacagcttactatttaaatattaatttgttaacaggtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggtattgttatttttgtgaaatggctacttttgatctgttttgatgcccatttttgtccacttccttttgttaatatatattatttctatgattgtaacaggaacgggctggagttaaaatggttatgattcaagacgggccgcagaacactggtgctgacaaacctcttaggattacaggagacccatataaagttcaagtaaacttaactttatactttataaagaaagagtgggttgaatggggttgggcaaaatatgcatgaataattaaaatgttttgagacatgctttctaaattagctaactttttctgctttagcaagccaaggaaatggtgttagagttaattcgtgatcaaggcggtttcagagaagttcggaatgagtatgggtcaagaataggaggaaatgaagggatagatgtaagtaaaaatacccattcagaaatggttgtatgctaattcataaatataatagtgttttctgttttgtgttaagtagctctaacattgttatccttttatttcacctttatactttagaatacagaattctatatatcttgttaccctatttactataaatatagaattatatgtacttttatgatttgaggcagattttcaggaaatggcgcttttttaaaatacttttttttactttaaaccctgagaagctagctttcttaatacttagtcttttttacataaggtccccattccaagatttgctgttggcattgtaataggaagaaatggagagatgatcaaaaaaatacaaaatgatgctggtgttcgcattcagtttaagccaggtgagtacatataataatcttgtaagtgttggcagcagtgagttttgacatacatttattgtttaattaattttgtttctttgttttgaagatgatgggacaacacccgaaaggatagcacaaataacaggacctccagaccgatgtcaacatgctgcagaaattattacagaccttcttcgaagtgttcaggtttgatagaaagttaacattttcattttttgtttttatggaaaagtattttccttcatgaaatctgaagttacctctatatcagagtctgcttgatgatgctttattaatggagaaagtttaaattgctttaaggtaaagatcttggagcaggaagaactactaccttaagtgctaccttatttactcttgtattttaaaaaatgttattacttattagggccagttcatctctacatttctgattcaggtatatgagagctgggaaaaataaacttaataattttatcatgaaacaaaagtatttctgtgctgactcttcgttcttgtctttccctctctataggctggtaatcctggtggacctggacctggtggtcgaggaagaggtagaggtcaaggcaactggaacatgggaccacctggtggactacaggaatttaattttattgtgccaactgggaaaactggattaataataggaaaaggcaatgtattttaaactcttaatgttttaacacattattcatttttctggacactttctgttgctgtcgtaaacaagtggcaatgctttttctctgaccgtattttagtagaaaagaattcttatgttaatatgtaacaagtaaaacataaatgagggatctcatgtatatttagagaaagagcaggattttaatcttactagcttctagagaaagcgaactaagagataattattagcataagaaatgtcttttgacccaaaaagtggtttgagtgtttttgtttgtgcattttggtttttcccgactcatattttaaaaatttgaatgtttataagtgtattagtttatatttacactgcttttaaaagcagttaattcaaatattttattataatcacattaagtttatgtttaaacatactaagtaaatgtaaatgtattttaagagaagcatgaaatgcttcctaaaatttgattttcagtgtagaatattaaatgaaaaatcttaatacaatattgtcaattaggatactgaccaaaccatatttttaatggcccatttaattgtgaccattttcttctaaatagctcctagtacacccttgaaacctttagagaaattactgtcttttgattttaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtgtgagtatactttaaacttttaatttttagtgtagacccttagactgtagttaaattaagacgtttattcaaatacatcaaaggaaaatgtatcattactagtcagcatttatagatttcatgatatgtataatagatacaacgtgaagattttccagcaatgaaaataacctaattaaatgtgtagttacaggttttgagaacaaccttacatttgggtgtggctagataagaggagggtagtgttacctgtaggcatgatattagtgttggtgtaggattgtggaacatacttgaaggacatagttaacgggaattcattatttattaagattttactctactgaaccccagcgaggcaaacaagataaatcagatacatctgccactctacagtagaaattcataaatcctaggttttggactggctcacagatcatctgggggtattaaaatgtagactatttgggtgcttcccactcctacacataatatacagagacagacctgactcaaaatgtctgggatagggcccagcatctaattttacatagatgtttgggtgattctggtgcacagacaaatttggaaatttttcctccaggaaagttttctgttagaacaaaaaagtatgaaacgctttgactgcttttttgtaagtgaggcagacagtgtcttactggagtttttaacacaaagtgtgcagggggcatcttaaattattagaattgcctaggaaaaattatttttggtgtttgccatgctgtgaatggggtgcgtgcaaaacaaggttgacactgtttctgtcacacttgggaagaacacaaatagatgtacaaaagacgcttaaggaacgtcttactaaatgtacacaaacattgtgagttctgttgtatggatagtttaatggttcaaaaaatgaagaggatgtttgtagagtaatgatagaggttgatgccatggcaaaaaaatgaatagcactcatcttggttttttattttacagtattagcctaacatgcatgcgtcaggatttctgttggattcatggaaaaacaagatagattgttttggagaagcaatttggtgtggtgattaagagcatggactctgtagtcgggttgcctcagttcagaattctgtgaatcatttactggttctgtgaccttggagaagttactcaggcttttctgtgccttggtttcctcctgtaaaatgaagataatggtatctacttcatagagttgtagggattaaatgaatgttcatgtgtgtgtcacttaaaagaatgcctgccacataaccctaaaaaatgttgctactttttcagtattatttttactacttggaaagaataggtcatggatagtaagtgagagatgacagcaattggagatttaaagagacaagttaataaaaagaactttaaaggtcatgaagtttagtttccctattttgcagtgagaaatttacaacaaaatgtagtgttagcattttgtccaacatgtcgcctggttgtgttaactactcagaaggagcattttaggacagttaagtgtaatgtctttgttggcttaaccaaacagaaatcagttaagcgttattaatgatgtggcatgcatgcatgataaggatataaaatatcctgatttattgaaggaattaaaaagggaatttttgtgctattaaacatcatgatacatgaaaggccaaaaaggatataaattattgatctgaatgggattttagtgacagaaataggttgtgaggtggattttagtttcatagtgaaacaactagctattaacgttatcagtgaaatgttcagaagacgatgatacaggacccaagcggtttgggaatatattgtcaagacggttgtctcatgttaggcaagtagatatagagagaagagctgaagataaggacctgatttctgtgagtaagatggaaaaagatagtaaaagtaagaatgataaaaggaaagggaactactgctgtccgcaaacaagctaaaggaaatttaattgctaatttaaatttaatttaatttaaattgcatttaattgctactgctattgattttagtgaattttacatgtctcattattatggcagatgaaatagtttttgcaaaatgaatgaggaaaggaaggaaaacctaaaatttgttatttgtgactataagagggtagaaatggatgattatttggccgtagagttgtttaaccattactgtgtttttctgatttttctatgtcatccttttttttgtagggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcagtaagtattgggtttagttctgggctttccccaaagattctagttttgggactgttttttatgctgatttttcttttcagtggtcctccagccccatatgctccccagggatggggaaatgcatatccacactggcagcagcaggctcctcctgatccaggtagaagatgcttattatttgtgtgttatctgtattattttccactcctgttacattattaaattttctagtgttgattctacatttgtatgcatcaccttcactcactttactctttcaacagtgttaggcactgcctctaccccagtgtataggactgacatgaatatgagctctgcttttatggaatttctttctacttgcctttggcttatgagttgatacagtagaatgataaaagctaaaagctgcaggaaagagcacagtgtcataggttttggataccagtgctgtcaaatgtgtagtatgttcattgtgacattatctgtggaaaaatagtttttacttatttagaaaagtatgtgataggggctgggcactgaggctcacgtctgtaatcccacctattcagaagtctgaggctgaggcttgagaccagcctgggcaatatggcaagacccatctctaaaaaaatttgttttaaattagccgggcagggtggtatgtgcctgtacttgaggctgaggtgggaggattgcttgagcctagaagttctagattgtattgagctgtgggcacaccattgcactcccctgggcaacagaatgggatcccatctcttaaaaaattatgtatatatgtaacagtctatataaatatatatatataacagtccaacagagtgttaagtattggggcattaaacttccaaattgtcaaataagatatctgttctagtactcctcatatgacaacttcatgtgagtaaaaatcaggcctgtatttaataactgcatgctaaagcccaaatacgtttaattattttctatattcagatttatttttatcctattatattctggcatctttccataccctgtagtttgctttccatcttggtcaaagagtcattctttgaaaccaattaacatttatttatgatccttttttctcacctgctacctaccttttaggcctctttcactcgtgtagtttcaaggaaaatatactcaattatggaatactttctacacataatacatttatcccaaaaaaacttgaagtaatttatgtaaatgaaattgcttgattaacttcataggaagtgtgctgtttggaatatgatgacacagcatgacagttaccaagcatgacttgagttgtgctaggatataggtgtgcaaagttggggttgtgttctatagcaaaagaatgcactcccagcgtaagcaacactgatggaaggggctcacagggtacaggatataatactcttaacaactaatttttggagaatgaaagggcttttctttccctcttgttggctgattgggatggtataattaatgggattgaagagtttgagtaggttaaaaggcagattcatattgggtaacttggatctgccaggattgtatttttgagcactactgggtggttagcatgattgaggaaaaatgatgggaataagaagtggaagtggtctttgtatcacaagttgaatttctcacttggagtagtagtgaagtcactactgtaagagctggtcagtgaatgtggttgcagcatggcctttgggcaagaagtaacccatttaactaaaaccagctggttggccccactcagatttatcaaagggttactgggtccctgggggtggatattgcttatattagacttagaatagcatactgttttaatattatatgaactaaaatgtttctttaaaaaaagagtggtctgttaatggatttatgtagtggtcaagaatttagacttcagagtcaaataaacctatatcagtcctagtcctacagtttactaattgtgagatgtcaagcaagtttttgaactcctctaagcctctgttttcttatctataaattaataaatgaatgaatcgggttgagtgaatatttagtaaattcttagtacatactagttatttgtaactgtgagactggttttttggtatggttttcacatttgggagtagaaataccacttcctaaagtctgttttatctcaaattctctatccaggcatagtgtaaagtgaaatacctagatttcttgattaatatacagataatggccagacgccatggctaaaacctgtgacgctagcacttcggaaggctgaggcgggcggatcacttgaggtcaggagttggagaccagcctggcaaacatggcgaaaccctgtctctactaaaaatacaaaaattagctggatgtggtggcaggtgtctgtaatcccagctacttaggaggctgagacaggagaactccttgagaattgctccactgccctccagcctgggcaacagagtgagacacttcatctcaaaaaaaaaaaaaaaatacagataatgacactattgagatatgtaaacatccaacataaaaaagcagtacattgggcaattgagaaaagtttggcaggtgtcctaataacaccttacaattatattaccttgcaattttctttttctagaaattcttgctcatttttctcaaacttgactaacctttattaagcagctgagaattgctactgttcagaatgaaggtataatagaaaatttaaaagttttaattgtatggtattcctagtataaaagacaatcaagttttttctggtttctagaagattgaaaggtctcaaactgttcgcacttcagttgatgtgggagatgagtgagggtcagtcaagtgtagaggagacaacatagctaaaagccgagacacgggcatagtgatttctgaaaagtacaagcactgtgttgtggctggagcttgggtgttgaagagatacaaccaaagggagagatgaggctgaaatggaaaggataagccaggggcttcaggctgttaaagatgttgaatgataggctgtacttaagctttgaacatcctgaagattgcagagaatgaagaatttcaagtaggatgacatcaagtttataacattcaatgtgaaataggatgaaatgtggctaatcttttttaagatttttatattttctcttcattgaaaataaggacaaagttcattgttctaaaataattttctttcttatacaggttagtccctagaaatgtttttctttagtcatcttctagatagagctgtttgtgcttgaggcgaaaccaatttagaaaaaaacaagggcacaggatggtttgagacagagcattggatttggagccaaaagacctttattcatatcccagttatgccactcagtagtttttaacctaggaaagtcacttagtctctgagacttggttttctttaataaaagctgatggtgacaacaaaaataatagaaaatttaagttttcatatactttttttaatgttctagttaattttgggggctgtatatttgccagagagctgggcgggggggtggtgtgtgtgtgtgtgagagagaattacagacttcacatgcaaaccttgaactttcatttattttagctaaggcaggaacggatccaaattcagcagcttgggctgcttattacgctcactattatcaacagcaagcacagccaccaccagcagcccctgcaggtgcaccaactacaactcaaactaatggacaaggtaactacagaacttattgtatgtgaaagccaaaagttgtgcttggaattatatatgaagtacatcactgtataatacctaaaatttctgacattatttaattataatttaagcagacttttccttttttaaattgttactttgaaatagtttcaaactttcataaaagttgtaagaagaatacccggagcacccagatagcccagctgttaatgttttattcccttgtttactctgttaccatctatatcatacatgtgtatctgtatttattttaaatatccattataattagttctgaaggaagctaattatatccagcataattagttctgaaagaaatcactgaagactaaactgtagacatgatgtcctgttgggtacttcttcaaaaatacataaccatcatacagccctccaaatcagtaagtcaacattgatatattaagttctttatatcattatggatttctgatttttgcagtaggttatatttttaaagtatttttataattttgataatcagattatcctggatttggccagtcagggagtatattcagggtggtgcctatatccttttgaaatacctgtcattcttttaagcacttccatactgtctggcacagtaagattgttattttgtgctttctgggctccagccctcgagtcagctatttcttcaaggagctcttattccttttagtagagtatggtagttagaaacgagacttgagtatgcttgttgctactgaggtgtaattgcttctagcttctttcaacaggcagaactaggaaatatatttacatacatgcatacctacatacacacaccaaaaaacacataaacatcgatatatgtatatatttttaaaaactatgttcatatcaccacatccgtttcagcattttggggttttcaagccttttccttttttgtacttgtttacaaacgtgagaaacctggtgtcctcagtgtatttccttatttgacatgcatttacttatatgttcaacataaccagtcttcaaacaggttggttttcttttctgtccaccacctctgtacccccagtaccttctatctttggcactgttagggatgccaccaccacatagtacttccctcctaccctcactgtcacattgcaggcccctgccagctcctgcacccaaggaaacggccaaaattgccttttaaaaactttaattctgttttttgttttgttttgcttgaacaaggagatcagcagaatccagccccagctggacaggttgattataccaaggcttgggaagagtactacaagaaaatgggtatgttttatacatttcttgaaaatacatacttaattaaattgaaacaaattattctcttcaggaagagaataattgaataaaatcactggacttgtaaacatatcaagacagttgtaaattatagtttttaaatttgtggttatatggcaaggaaatttttttttctaattgcatttgtcaaccagttattaattgaaactagaaatgtccttactggtacatacaatattaacattactatacttttgacaatgacagttatatatattatcagtctaaatgacataaggttaaattttaatgtgtcaggcgaaaattgtgtgtgataccattatttttgctgcaagataagcaggtaagaagtaatctgcagtgacggaaagtaaccaagtgatggaaccagaatctggcttccaagagggtctgagtcccaagcttgtctcccaaatttgtctctttaggaaccatttggaacctgatactatacttctggacaaatcactatatttcagctgcttttgctcttagtcatttaaaattattacataccacagctagatgtcacaaatgaaagctaaattggtaagcttggttatccttcactagcagaaaaagaacctataggtggtagagttttgtcataagagaacggtctacttgggattttcaatgttttctttgccaaagaatgtttctcattctccacagaaagaaaaatttccagaaaggtgatgattttaatcttctagatgtaaaattacatatacctgatgataaagttgttttgcacaactggtttctttttaaagaaaaattgtttttcctcttagaatggcttcctaggagagtcatgttccgtctctttctgaggctttaacagattatgtttttgtgacctagcttaggcagatctacagtagctacaattcggcaaaaagaaacttttaacttaaaaacagcatactctgattaaggttggttacataatttattttctgaactgggatcctttttagaatgaatagggatgctattaataatcatgccctgacagcattgtggtcaggacctgtaatcaacttaactttaattaaatagcatcaccattttaaaagacttgagcatgagccacgtgcggtggcacacacttgtagtcccagctgcttgggaggctaaggtggaaggattccttgaacacaggagattgaggccagccttggcatcatagtgagacctggtcacgtgtttgggttaaaaatcactaacttcaacttctattttctcaatgggtaatgtcccctagatagggtccctagttattattaagtaggtaaaaataaaggcttgttaatggatttaggtaattatggaggaatgagtttggcttctgtgctttattttaccatattgattatttgtaatatggccattaatacatttactgtttagtcttttttgttttactttttatgttttactcaaaatgagtgggtgggtggaattctaatttttattgttaagggaagacattttaccttgtctttaattttttatttttttttaccatttccctgccagttagagatactatactatactgtcttgaatcctctgtaggaaaacatggcatagaaataattaaataataattagatgttaaataataatgctgtatgactaaagaacctccttaccccaccttttctgttgttgttctgtagtaccacaataatcacttgttaattttatttatttatttatttgagagggagtctcactctcgcccaggctggagtgcggtggcgcaatctcagctcactgcaacctccgcctcccaggttcaagcgattctccggcctcatactcccaagtagctgggattacaggcgcctgctaccacatccggctgattttttgtatatttagtagatacgggctttcatcatgttggccaagctggtctcaaactcctgacctcaggtgatccacctgcctcagccttccaaagtgttgggattatgggtgtgagccactgcacccagcctcacctgttaattttatgagcaaaacagattagttgggcaagtccttcacatgcatatctcgttgttgttgttttttttaagacggagtcttggtcttactccccaagcaatggtgcgatttcgtctcagtgcaacctctgcttcctgggttcaagctattctcctgcctcaacttcccaagtagctgggattacaggcgcccaaccacacccagctaatttttgtatttttagtagagacagagtttcaccatgttggccaggctggtctcgaactcctgacctcaggtgatccacccgcctcagcctcgcaaagtgttgggattacaggtgtgagccactgcgcctggccacatgtgtatatcttaaaggaaataatgctaggtaatttagtcaggtgcttgatgagcatttgtcatcatcatacggagtcaatttgtctttttctataaaagttctttttgtaaatgattagttgcttaactgctttaatttcttctaggtaccttacctgtcatcaggatctttttaccacaaataagaaaccttaaagcataaaacttggttcagtcttcacatttcttaaatggaaggagaaagggaataatagggagatatctttatctcaaagccaactgttgttgacttttccagtggcaggggtatgatgctaggacttcagatttcctgattccccatcctagtgccccttttgccaaactaggcaggctttcacagcttttggagcctaatttaagtttttcttgttaagaacagaaaactccattcatagattttaatttgtcattatttgcttatttactgaaaaaaaaaaaaaactattgaaaacaggtgtgggttaagtttcccaaaattaggtttatatttcaaaacaattctaagttcccaaggataacaccaaactaagaggataaatttttattttatttttttttattttatttttttgagatggagcctttccctgtcgcccaggctgaagtgcagtggcatgatctcggctcacttgcagcatccacctcccaggttgaagcaattcttctgcctcagcctcccaagtagagaaaatcttgataagatttcagaggcttataaggaacagcagtaaagatgggtgtttttaaagctagaatacagggatttttttaagacccttaagagaacaaacagggtttcaaaatagaaaggagtaattcttgtttggagaagtgaagacatttgggaaaagtttgacttgaggaaggccattatgataaggactgatgtggtagactctgaaccctgaagaatctggtaccttaagcctaaaggagggtagagtgaggacttgtgggaaaggtacagttatatgggaagacaactgagtgtgaaaatctattcatgcaaggctggctcttaggctctaatagaatcttgcaagctaactctagagcaagtcttttatctttgggatgaaagaaatttaaggctaaactttatacattataattataaaactataataaatattagataatgttctactgaagtataaactcaactatctggcatcaaacagtaactaagccatgatcacaccactgccactgtgttctggcctaggtgacagagcaagaccctgtctcaaaacaaaatccagtaactaaagagaggaataaggggagcgcaaggtaaggcagtacatgtctgaaggggcagggaaagagttctttctctacttccaactgggcaaaataaatcacatttgccctttagattggaagagtgaaataagcttttcttgaacatcttttaagattggagtgtcaaatattaccaacttatttaccaagaatttggtttttcttaaagtctaaagtgtttactattagctttccacagggatataggagtttgcagaggttgtagttttttaagggaacatcaatgaattttcttgatgcatatgcctgtttctaccattttacattgttaatttgcctctaaaatgagtaactcttacaatggggtttaaaacctgaagactattgattgctaccttgatcaggtttggtttcaagtgtgcaccctgtaagagacaatgtgtggttttattgctattgtcacaccagttttttagatattgaaacctgtttcagatttgcttgaattgtgtcttgtaagaggaaaatgttaaacttacttcctctttgagaacagttatttatagaagacaggaaaatatgagaatttttaatagtatatgagagttctctgttacccaagaaaagagggtttttttcaggcatttttaaagaatcataaatcttaaattctttcactcagttgctttgagtctgtgacctgttttacaatggtgatagactgctttctgaaactatgaaattggtcttgttggcagcatcctacaaacataaaaagagcttcctgtgtgtccatgctccagtatttttgtctatggtagttatttcacaaagccaagcgagttacaaacgaaataaaatagtgcttaagtaaagaaactgaataggagaacatatactctctcttctcaattttttatttagaaaattatataccttcagaaattggggaaataaggcatcagacactcagcttcatcattttttaaaagtttgctgtatgcgctttatatgtatgttttttgtgtatgaaccatttcaaagtaagttgcagacaagacagtttgctctaaataaactcaatgtctgggcacagtggttgacgcctgtaatcccaggactttgggaggccaaggcaggtggatcacttgagtccaggagttcaggaccagcctggacaacatggcaaaaccccatctctacaaaaaaagagaaaaatgtcagctaggcatggtgggcctgtagtcccagctactctagaggctgaggtgggaggatcacctgagccctgggaggttgaggctgcagtgagccatgattgcaccgctgcactccagcctgggtggcagagtgagaccctgtctgaaaataaataccctcaatattatcacaaacatacagactatatttaaatttccatagttgtcaggaatatgtcttttgtcgtctgtgtgttttgtttaattcagagtacattcaagattcatgcgttgcatttcattgctatatttctttaatctcttaattcagcaaagtcaccttatttggaaaaagacctgattgtgaaagctgagttttatgtgttttcattgatcttgttctttattccttgtcaggttacttttaataacattgtgttgtaattggaataaattattaatacttttaacatcttattatgtgtgtgtgtacatacactttataggttactaatcaggaaaaagtcttggctaggtcttaatacagtctttaaatcattgcctttaagtgggcttaaagtttttcaaaaatgttctttttgtaattctggaatcgaattaagattatgcctaaatctttaccttccttagctaaagcagtgtggatttggggttgattctgtttttttactaataatgacgctctagaactaaaagttaacgattaattataaggcaaaaagaaaagagcgttctttttttttttctaattgcagagtagtttcctgacactactaaatgaatattttaaataaaacaggagtaattctgaccctctgtgcttttgtcttataacctgtacttacagtggatgtaattttatattaaagtttaggggtttttttttttggtcaacaagggcaaacacaagattattcaaaggcttgggagaaatattacaagaagcaaggtattgtttttattagaaatgagatgttgggcttataattgtggttacagcaacaaagttcttttttttcaaaggtcaggcagttcctgctccgactggggctcctccaggtggtcagccagattatagtgcagcctgggctgagtattatagacaacaagcagcctattatgcccagacaagtccccagggaatgccacagcatcctccagcacctcaggtataatgtaattgctaatttgttgatttctactccagtctgttttctgcatgtttactgtttgtctgtttgggagtgtttgccttttaaatttttatctggcaaagtataataactatttaaatgaagtactacggtgtattgtttgggtttttttgttttttataatgctttccagcatctgagtggtgaatatttctgcaatgcctttgattttaaaaataaattttcttcccccagggatttgcaaatcatgcaagaagccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcactgtaagtacatcagaatgacaaattgatgaactgcaacagtatctttttgtcaatgttccacataatgcaaatgccatacgttgtgtgaatattatgttggaatacagtgctgatatcttggaaaaccataactgcctcttaatttaacatagaataatacatagttctgtattttttttaaagtgagcttaatgggtaagtattttttatatgctttagctatagctaaagaaaactgatacttaacaaagttgaatagtattattcactggtgctcctaaaatattgtttttcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagttcattgtagatattttgaaatgtttttgattgttttatataacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaaattggaggctgttgattttgattcatttaaggtttaaaatctttattaattgcaaacagtgcaattatttatacttcacagtgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatcttt

SEQ ID NO: 13788 - DNA, 38702 bp, Human
  misc_feature (1)...(38702): n = A,T,C or G
tttgttagtattgtcactgataatgttagaaaagttcttcatatattggggaacctgacgtgtgcccatggtggtagttgtaagttttccataattcttttttttttttgagatggagtcttgctctgacaccaggctggagtgcagtggcgcgatctcggctcactgcagcctccaactccctggttcaagcgattctcctgcctcagcctcccgagtagctgggattacaggcatgcgccaccatgcccagctaagttttgtatttttagtagagatggggtttcaccatgttggccaggatggtctcaatctcctgaccttgtgatccacccgcctcggcctctcaaagtgcttggattacaggtgtgagcagctgtgcccggccaagttttcggtaattctaattttcatttaaaatttgacttattggcagcacgtgtcagttattttcctttaggttttctttgagaaaatgtcaaatacctaaatctgaataatcatagtttgttggtcagttctttcaaataaaaatgattattcataaaaaaaagcggctagttcagcttacagatcagtggcacaggttttccctgagctgaagtgctgtctgtattcttcccattttttcacacacaatgtttaaaagatgactattgaagggtatatgtttattaaataactttattaattctttttgctactcagtcttgctctgtcacccaggctggagtgcagtggcgtggtctcagctcacagcagcctctgcctcctgggttcaagcagttctgcctcagcctcctgagttgctggaattacaggcatgcaccaccatgccctgctaatttttgtgtatttagtagagacagggtttcaccgtattgcccaggctggtctgaaattcctgggttcaagcattacacccacctcggcctcccgaagtgctgggattgcaggtgtgagccaccatgcctggccaataaagttactttttaatgcttttatcaaggacatccttttttttgttcttgagatggagtttagctcttgttgcccaggctggagtgcagtggtgtgatcttggttcaccacaacctctgcctcccaggttcaagcaattcacctgccttggcctcttgaatagctaggattacaggcatgtgccaccatgcccggctaattttgtatttttactagagatgtggtttctccatgttggtgaggctggtcttgctcttctgacctcaggtgatccacctcccctggcttcccaaagtgctggggattacaggcgtgagccactgtgcccaccctatcaaggacatccttaaatgaatgcctggcgatgaagactgtaatgatgactagtatagtttagagccctgtcttaatttgttttatccaccattgattttacatcatcagtggaagtgtcaacactgaaaaggtgactaggctgggcacgatggcttacgcctgtaatcccagcactttgggaggctgaggcgggaggatcacctgaggtcaggagttcaagaccagcctggccaacatggtgaaaccctgtctctgctaaaaatacaaaaaattagccgggtgtggtggcgggcacctgtaatcccacttactcaagaggctgaggcaggagaactgcttgaatccttggaggtagaggttgcaatgagctgagattgcgccattgcactcctgcctgggcaagaagagtgaaactctatctcaaaaaataaataaaaaaaaaaaattaaaaggtgactaatgtcttagtgttattatgaaacagttttaatcttgggatgcataggagcccacagaccacacctggacccctggtttcttaagggctttcttcataaattatgtcatgttgcatgaatataagtgtaattactaagagaatgtgtaatggcaggcttgaaaaaaatgatctgttttaaatatgctgtagaactttcttttcaaggtactatgctttttctataggaatgtatcctgtcaggtataatgtcagtgaatggcaagaaagttcttcatatggatcgaaacccttactacggaggagagagtgcatctataacaccattggaagatgtaagtgttagtcaaatttcatacgcctctcacactttgtgagtatttcacttgtgaatctctaccttattccttagagatggtcttaattttgttttgttaaatggaatatctggagcactgtttttcaggagcttctggtttgaagctcatagaaatttacattttgacttttgttgctatgtggagcagttatctcttagcgttaacagagaatagtctaggaagggagggtagaggatcgtctgatgtgccagcgcaagtccagtgctttcctcatggctttatttattttctcagtccctcaaagattttttttttaatctccatttaacatagtctctgtggggttaaaatctgagatgggttgtaaacccaagttacatgactacaaagcttagttccttttgctatactgccttgtttcctactttttttgaacgtggacacatagcatttccacagtgtgttttaatatattgattgtttttctgcgtgaggtttgttgaacacctacgtatatggatatgatgtgtactgtgtcttatgggagatagatatcatcaatgactttaatcagtgacttattagacaatacttaccaaaaaggatttttttctatattcagtaatactgaaaagtttaaagaataatacgatgtataaaaaaatcttccatcagagttcagcagttaaagtttgctgtatttttttcatgtctctttttttgttactggttttgatccattgaaagtgataagacatcatgaggcttgagcaaaatatttcagcattcatctgctaagaataacattctcctgcataagcataataccattatatcatatccagaaccatattcaaatttcccagtggtcccagtaatctcttacgtagctgtttgtatttggtataattttctctttattctcttatttatttttctggagacagaatcttgctctgccgcccaggctggagtgcagtggcacagtctcgcctccctatggcttccaccttctgggttcaggtgattcttctgcctcagcctcccaagtagctgggattaaaggcgtgcaccaccatgcctggctaatttttgtatttttagtagagacggggttccaccatgatggccaggctggtctggaacccctgacctcatgtgatctgtctgccttggcctcccaaactgctgggattacaggcatgagccaccacgcccgagcgctttattctttgttgttgttgtttgtttttaagagacagggccttgccctgttgcccaggctgaagtgcagcagtgcgatcgtagcttgctgtagccttgaactcctgggctcaaacgatcctcctgtatcagcctcctaagtagcggggctaaagatgcataccacctgcctggcttattttattttttgtagagatggggtctctctgtgttgcccaggctggtctcaaactcctggcctcaagtgatcctcctaccttggtttcccaaagtgttgggattataggtgagagccaccatgcctgggcacctctttattttcttaatctacaaatctcctcacaatttttttcttttcttaattttgttttattttatttttatttttatttttttgagacagtcttgctctgttgtccaagctgatgtgtagtggtgcagtctcggctcactgcaacctccatctcttgggttcaagtgattttcatgctcagccttctgagtagctgggattacaggtgtggaccaccatgcctggctaattttttgtatttttagtagagatggggatttcttcttgttggccatgctggtctcgaactcctcaaatgatctgcctgccttggccttccaaagtgctgcggttacaggtgtgagcctctgtgcctggcctagtatatttcttagctgatcttcaatacaatgagtaagatttcttttcttttttttctccccagatgtattgagggagtcatgaattttttcttttttttttttttgagatggagtctttctctgtcacccaggctgcagtgcagtggcacgatcttagctcagtgcaacctccacctcctaggctcaaacgattctcgtgcctcagcctcccgagtagctggaattacaggcgtacatcatcacgtctggctaattttttgtatttctggtagaggtggggtttcaccatgttgatcaggctggtctcgatctcctggtctcaggtgatctgcctgccttggcctcacaaagtgctggaattacaggcatgagccaccgcacccagccagaatttttattgaataaatacttactaattttgcttattcttttccaccttagcagtaggattcatgagctcaagtgactgttctctaactttataagctttttgaaatctgagcttcatttcaattcatgtgaattataaattaatttgagtattcttaccacaaaacatcataaaagaacaaaaggacaattttggaggtgatggatatgattggtaccttatggtgatgttatgggtgtaccttgtgtctagactcaccaaaatgtatgcaggaagtaggcagttctttatgtatcagttatacctcagtaaagctcaaaaattataaatgaactagaactaattttaattatcttttctgattaggaagaatctaaggtttattttgaattccttacataatacaaaagcaaaattaagcctttgatagctttttatttgggagagaatgaatttagatgattgctatttgtcagtgacaccctagttctgcatatacagtccgtatagagaactatacagtgtcattgacaaataatcttgttttatttatttatttcttgagatggagtcttgctttgtcactcaggctggagtacagtggtgccatcccagctcactgcaacctccacctcccagattcatgtgattctcctgcctcagcctctcgagtagctgggcttacaggcacacaccacaccccgctaatttttttttttttttttttttttttgagatggagtctcactctgtcactaggctggagtgcagtcacgctatctcggctcactgcaacctctgcctcgcatgttgaaacgattctcctgcctcagcctcccgagtagctgggattacaggcatctgccaccatacctggctaatttttgtattttcagtagagatggggtttcaccatcttggcctggcttttcttgtactcctgacctcctgatccacccgcctcggcctcccaaagtgtttgggattacaggcatgagccaccatgcttggccaatttttgtatttttagtagagacggggtttcactatgttggtcaggctggtctcaaactcctgacctcaagggatccacccgcctcatggattacaaagtgctgggattacaggcatgagccattgcgtctggccttgttttatattctttcttttctgctagtgaaaaaccttacttctgccatatttgttaattttaacatttatgagtttagtaattaatttacatatatattggaccttgctaaaaattttatctgataaaagatgaaatgcccttatactttactagcatggtggtgtttagttatactaaaagcacttaataaaaaatatgtacatattgtaataaaaaattaaattttgttaacattatggctatgtttttccttgcttttagttatacaaaagatttaaaataccaggatcaccacccgagtcaatggggagaggaagagactggaatgttgacttgattcccaagttccttatggctaatggtaaagaatttctaacttaaatttatgacagtactttgattacaattttaatatcaaaactaacttttgacagagtactattctgggtatgaggaactggattttgttgaatgaaacagcatggtgagtaacatggtccattagatgtctggagtcaataagttaggaaaggaaggaaggggttgtgacttactagtaattggttctggagaaacaaatgatgctgtggcataatacataacaagattgtaagcctttggcacagacttacctgttgatgcttatgacagtcttaaataactgggccttttgaaacagcattattttaatgtttttctagtttgtagggttttaaaattttcacatttttttaattttagaggatctaagttttctttttctttttttttttttgagacggagtctcgctctgtcacccaggctggagtgcagtggcatgatcttggctcactacaacctccgccttctggttcaagcaattctcctgcctcagcctcccaagtagctgggattacaggtgcgtgccaccacgcccagctaatttttgtatttttagtacagacagggttttaccatgttggccaggctggtcttgaactcctgacatcaagtgacctgctcgcctcagcctcccaagtactgtgattacaggctaagtatttttttaaattgctgtaatattagtacttttttctgagatgacattgaaaaactaaatttttggttataggtctgtttgtgcacatgaaataaagcatctgctatcctttttccttgtttgagtttatattctattgtttgtttttattaattttttttagagacaggggtttcactctgtcacccaggctggagtgtagtaatgcaatcatagcttactgaagccttgacttctaggttcaagtgatcctctcacttcagtgtcccaccacacctggtgttccaccacacctggctaatttttttgtgttatggtagagatgaggtctcactgtgttgtgtgggttggtcttggactcttgggctcaaacaatcctccctccttggcctcccaaagtgctgggattacaggtgtgagccacctgtgcctggccaataatactataattccaaacctcatatctctaataaatttttcattgcttttgcaaaagcaagttgatagaattattaacctttaagttgtaacattaaaaaaacctatgtattcaaccttgaataggaaaaaaagataaaaaataacaaaaacgtgtaatatgcagtgcaataagtttgcattctggttgtcctatttaaaatacagctttggaggttattttgggccaggcgcggtgcctcgtgcctataatcccagcacttgggaggccaaggtgggtggattgtttgagcttaggagtttgagaccagcctgggcaacgtggcaaaaccctgtctctacaaaacaatacaaaaaaaaattagccaggcatagtagtgccaggtactcaggagcgtcaggctggaagcttgcatgagcccaggaggctgaggttgcagtgagctcgtgattgtgccactgcactgtagcctgggcaacagagggagactgtgtctcaaaaaaaaattattttgttggagttattgaacatcgttagaaaaaattttagaagctgttagtattagtaagtgttctttataatttatagacttaagttatagtttgaattatgtgacttttctaggtcagctggttaagatgctgctttatacagaggtaactcgctatctggattttaaagtgactgaagggagctttgtctataagggtggaaaaatctacaaggttccttccactgaagcagaagccctggcatctagtaagtagttttattttctctagtaactagttttattttctcagaataatgagattttatactggaaaagagtcttagagaggacccagtcaacaaatatttattgaatgtctatcatgtgccagacactgttctaggcagttgggaacacatcagtgaacaaaatgttcaaaaattcctacccgtttgaagcttagagtttaaatgatcatctatagatcatgtaccttgtggctggtggatctgagcttatctagggttaatagtgttcttttcacagtaattcataatagctatgctttctgttgagtatttcctgtgtctaaaggctctgtactgaacactccatattgttttcttatttgacttctgaaacatctctatgacatagggtctccattttataggtgatgaaactcaggcctaaaattgcatacgtaataagtagctgggataagtagctgggttggaagtgaaatgctggtagtgtggctccagagccctggtgcttaatcatgttactaagcttaccctacgctatattacccaacgtgccaacaggagaagtactcattctgatgatgctcatcttctaattggtcttgttagtaattcccaatatctttgattttaggaactcctggtgagttttatnnnnnnnnnnnnnnnnnnnntttttttttttttttcttttaaagacagagtctcgctctgtcacccaggctggagtgtgatggcgcgatctcagaggctcactgcaacctctacctcccaggttcaagcgattctcctgcctcagcctcctgagtagctgggactataggcatgtaccaacacgcccggctaatttttgtatttttagtagagatggtgtttcaccatgttggccaggctggtcttgaactcctgacctcaggtgtttcacctgccttggcctcccaaagtgctgagattacaggcatgagccaccgcgcccagccttggagtgatcttattctctgcccaacattatttcctctgttgcctcaccaaagagttctggttaacatttcctatttcagcgtctctcttaaatagcaaacagtccagaaaagacctttttgttcttcaagatgttttagtccttgtatggagcagtttggagaaggataaatttgtataactaagggtaggtgagggctctaggagcttagaagagggaaagtgctcataagttctctcataattattttggcatcagcgctgaaaagttttctcatctgtaaacctaatttgaattattttggcagtttcctctattaacttctgattaggggagaaaatattgggtataaaatattaaagacatagccagaaagtaaaaaatactgcaaagaatcagggctaggttaggactgataattggggaagggaaggaacagtttctcattcagttgcgggtagttagtagtgtaatcatgggttcgaaattattttaaatcttttaaatgactatgaaaatttaatccaaataaagtatcttcatagaagtaggagtttgagtttgaatagaatcctttttaacagtggtgtggtgtggtggctcacgcttgtgatcccattgctttgggaagccgtggtaggaggattgatttaggccaggagttgaagaccagcctgggcaacatagcaggaccctgtctcttcaaaaaataagaaaattagccagatgtggtggtacattactgtagtcccaggtattgtggaggctgaggcaggaggatcgcttgagtccaggaaatcaaagctgcagtgagctgtgattgcatcactgcgctccaacctgggtgacagagggggaccctgtctcaaaattttttttagataaaaataagaaatagaattttttttttttttttttttggacaaaggtcgtgggttctttcttttacattttctttcttggagctcttacttatattaaagcttcagttacctccttcatctaatagaaattatcgtttggcagttttattttctctgattttttcagatatataaaacatttacagagcttgaaagttaaaaggtatatttcgagtcttggtctcattcttacttttctacttccattctttctgacctgttaggtaatcattttctggcttatccttcttctgttttttttttttttgaataagcgcatatgcttctgtatatatttttaaggctaggtttattgaggtataatttatgtacagtagaaatcacttgttttagtaaacacttttatgcattttgaccaaatcactaccttatcagcatctccttatattaatggaaaggattttgaaatcttgagttgcaggcaagaaaattctaggcagaatgaaggaatggggtaaggaaaggtggagaggtggcaaagttcaagagatgggtggataagtaccagttgttttataattttaataagaactcagttttttgagcacttacatgctaggcatatatgtattaagtacttcatgtgtattatctaactttacatagttcttcactgcaatcgtgtgagatgcaggtgctattactattttttattttacagatgggaaagctgaggtataaaaggaaagcacaaagtagtatagctagtaactggtttggagccaggtctgtctgactttagaatcccacactcttaaccacaagaaatactatattcttacggtatataaagctattaatatattgctttttagatattttaacaatgattacataccttctaattcttttttttccaaagtaaatacttgagtctccttagttgtttctcatataatatgctatctagatctcttggccactccttggaaattctctaattagtcaagatcctatatataatatggcagccagaccagagacagtatcccagatgttttctgctcattcagtgtaaacaggactgtttttttctttgtcccccaggctagagtgcggtggcacaattttggctcactgcaacctctgtctcctgagttgaagcaattctcctgcctcagcctcctgaatagctgggattacaggcgcacgccaccacacctggcttatttttttttttttttctttttttttgagacggagtttcgctcttgttgcccaggctggagtgcaatggtgcgctcactgcaacctccgcctcctgggttcaagcaattctcctgtctcagcctcccgagtagttgggattacaggcatgcaccaccacgcctggctaattttgtatttttagtagagacggggtttctccatgttggtcaggctggtctcaaactcccgacctcagatgatccgtccgccttggcctcccaaagacctggggttacaggcgtgaaccactgtgcctggccataatttttgtatgttttagtagagaccgggtttcgccatgttggccaggctggtcttaaactcctagcctcaagtgatctgcccaccttggcctcccaaagtgctggggttacaggtgtgagccactgtgcccggccccagaacatttattattttatgtatttatttttttgaaacagggtctcactcttgctctggctggagtgcagtggcatgatcacggctcaatgtagccttgacctcctgggctcaagtgatcctcctgccttagcctcctgagtagctgggactatagggatacacatgcctataatggtgcaatttaaaaaattttttgtagaagtgaggtcttgctatgctgcccaggttggtcttgaactcccggactcaagcagttacctctcctcagcctcccaaaagaggcatatcccaccatgcatgcctatagtggtataattttttaaattttttgtataaatggggtcttgctataattgtctaggctggtcttgaattcctgggctcaagcagtcatctctcctcagtgtcccaaagtcttagcactacaggcgtgagccactgcacccagccaagaacatttataattcatgggaggaggtcaaaataccaacattaaaaagagtttggaagaagtgagttttaaccctcttagatcactttcagagattaagacttcaagacttttgacacttctgaaactactaatagcctgttgttgaatggaggccatacggataacataaatagctaagtagttgattaacatttattttgtatgtgatttttttttgttttttgagactgagctttgctcttgttgcccaggctggagttcaatggtgtaatcttggctcactgcaacttccacctcccaagttcaagcgattctcctgcctcagcctccccaagtatctgggataacaggcatgcaccaccacacctggctaattttttgtatttttaatagagatagggttttaccgtgttggtcaggctggtcttgaacttctgatttcaggtgatccacctgcctcgttctcccaacgtgctgggattacaggtgtgagccaccgcacctggccttgtgataatgtattatatactgtgttcttacaatcaagtaagctatagaaaagacagtgcccttaagaagatgataaggaagagaaagtacatttacagtaccatactggacttattggtaccaaaagtttaggttgtatgtgtatgagatgaattgtctgtctgaaatggcgggcaactgcagccgcagacctgaagtcagttggtacgtttcaaggaattcaactttttcttgtaatgtcatgactttgcttcttgggagcacttccagcatcagtggcattccctgtgggtcctacgttttactcagtgtttatggtgttgcactaaacacgatgaaaaatatgtgagaacaaggagagatcactttttactgtgacagataatttactggagaggtgaactgctcatgcagagatgattattgtcacatagagttttaagatattcaaacacttgagctcaccacattagcaacaaaaggtggctccagagttattacagtagtacagtatgtactgcagttaatcttacgcagttaagacttaatactacatctttctttgtttacagtggcaccgtgtatggtctgtgtttgtgtgcctaagttttgtgattaaattttaactttgaaatagaattgcatatatttatgatagtaaataatatctacatatattttagcattcatgacatacataacttttttctaatttttttggtatttctaggctatgcggttcatctgcaagttttttcaaattgtcacaaatctgctgggcatgttgctgtgcacctgtaatcctagccacttggtaggccaaggcaggaggattgcttgaacccaggcatttgaggctgtactgtgctatgttcacacctgggaatagtcactgcacctctagcctggacgatatatccttatatagcaagaccctatctcttaaaaaaaaaatcatttggccggctactgtggctcatggctgtaatcctagcactttgggaggttgaggtgggtggatcacttgagcccgagagttcgagatcagcctgggcaacatagtaagacccctgtatctacaagaaatagaagaaaaattagctgaataccctgtagtcccagctactcaggaggctgatgcaggaagattgcttgagcccaggaagttggtggctgcagtgagctgtggttgcgccactgcactctagtctgggtgacagagatctcatctcaaaaaggaaaaaaaaaaaatcaagtaaaataaaacgtagaactgaaagaaaaaacaaacctggctgggcatagtggctcatgcctgtcatcccagcactttgggaggctgaggcaggcggatcacttgaggtcaggagtttgacaccagcctgtccaacatggtgaaaccccatctctactaaaaatacaaaaaaaaattagccaggtctgatggtgcatgcctttaatcctagctactcgggatgcttaggtgggagtattgcttgaacctcaggggcagaggttgcagtgagccgaaatcgcgccactgcgcactctagcctgggcgacagagtgagactccttttaaaaaaaaaaaaacatgcaaacctccaaaaattttttcagtacatttattgacaagaaaaaatctacatcaagcttgtcctgtctgtggcctatgggctgcatgtggtccagggtagctttgaatgcagcccaacagaaatttgttaactttcttaaaacatgagattttttttcacaatttttttaaagctcattagctatcgttagtgtattttatgtgtggcccaaggcaattctttttcttccaacgtggcccagggaagccaaaaaattggacacctctgatctacataaaaagtggcagttcagatgtgttattcaagggacaactgtaaatacagaaaggcatatcccatggtgatccattgctgtgggggaaagaggaaggagggagtgtgagaaggacgctttaaataaagtgatctgggaaggcatcagcatagataaatagtagttgtaaaaaattatctacctagtagggactaggtgcagtggctcacacctgtgattccacactttaggagcctgggagtttgagaccagcctgggcaacatggcgagaccttgtttctatggaaaaaaaaaaaacacagtaggaaacacgttattgatttgaactttttcaattaggagtttttcagaatgagcactgggtgtttgaagtatttgtaatacaattatatctggttctcatgctgttaacagctagtcattgagatcactatttggcgccatgcatagcaacatggaattaagggatggaaaaacagccaggacgtctctactgtgctgtgtaaaacaggagtggcactgatttctatccctctctgggtaaggatcaggtaatggaggaaaataaaggagaggaaagagaaggaaacatgatagatttttattttgattaaaacaaaagttggtaacagcaactcaggtttctattaaataaacaaaagttgggagatactccaaaataactgttagtaatagctttaagttctgacaggctgtgccgaccggaatatgatacctaagttttaagtgcattgaaatagtgattcatgtttccttttgcctgtcttatacccagctcttacaactacacttgtgtcttaagtatagtgctgatgtggtaataggatatttctattcagccttatgcctttactgtgtgtacattctgtccatttaaaaggctgaattgtaaatcttaattttaaaaaattaaatgtagtcagttgtcattaatagcctcatgtttcttttttttttttgagacggagtctcactcttgttgcccaggctggagtacaatggtgcaatctcggctcagtgcaatctctgactcctgggtttatcaagcgattctcctgctccagccttccaagtagttgggattacaggcgtgcgccaccacacccagctaattttgtatttttagtagagatggggtttcaccatgttggtcaggctggtcttgaactcctgacctcaagcgatccaccctcctcagccttccaaagtgctgggattataggcgtgagccactacgacctgaccagcctcatggttttaattttcagttttgttggctggaaaatgatcttggatgtaatattaaatctatcaaaacattaagctgtcaatagaaacatttgagagtttgtttttaaaactgtagttgtattttaaaaatagctgtacagcttaggaatggggggagaagggagataaaatcagaaaattttcttttttgttggctatttgtctatcatctatgattagttgaaatacagcctagtaataaaagctgaggatttataaagtggtaatttgtagcttcttcatctgttttttagtgtaaaatgcagcgaattggttgcttatgtaggacttcagtaaaataagtgactagcagcagtagcagcagcatcgaaattttatcgaggtcaatttgttcttgttatcttaagctgttatcattaagtgcccggttgtatcttagcatacagaggcggaaaagcaagagcattcagaatttaggcaattggctgagtgtagatcagagttgtcaaagggagactcttcagatgggtggcttcatggatacttgttcagagtcacatttaccttgtacctagtaagaaacataatttgacatttttcattcagttaagtagtagttttaattacttgtaattgtatggtagaattgaagactttataagtaacctgttataatcgtgtcagtttaaggtgttgtgaaactggaagccatgctgtccaaactcccatatcttaaattgcatcctgcattttaggcgcggtggctcatgcctgtaatctcagcactttgggaggccgtggtgggcggatcacctgaggtcaggagtttgagaccagcctaacatggtgaaaccttgtttctaccaaaagtacaaaaattagctgggcgtaatggcggttgcctataatcccagctactcgggaggctgagacaggagaatcgcttgaacacgggaggcagaggttgcagtgagctgagattgcgtcattgcactccagtctaggcgacagagcaagactctgtctcaaaaaaaaaaaaaaaaaaaaaaattgcatcctgcattccgcagttgataacaaggcatgtttaaactttgctctcatacttcgttctcctcaatgtctgattgtgagtgtgctttttgaaaaattcttttttatttaggcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgagtaagtattttggtttttagatttgtatttttcttgaaattctcactaaatttcccaagtcttccaagtggaaattctaacaaaacaaatacttagccatattgcactatgaatgaagaggttctagttgaaattagtgttgggaccttttaagtgatttaaatataaaggtagtgggccaggtgtggtggctcacgcctgtgatcccagcactttgggaggccaagttgggtggatcatttgaggtcaggagttcaagaccagcctggccaacatggtgaaaccccctctctactaaaaatgcaaaaattagttgggcggtagtggtgcgtccctgtaattccagccacttgggaggctgaggcagaagaatcacttgagcctgggaggtggaagttgtggggagccgagattgcaccactgcactccagtctgggcgacagagtgagaccctgtctcaaaaaacaaaaaaacaaaaaagaagatagcggattgaaatcgcttcaaaaaaaattataaattgaacaccatgaatgaaaactaaagccctttcctaatactcatttcctttcttccagttacttagatcaaccgtgttatgaaaccattaatagaattaaactttacagtgaatctttggcaagatatggcaaaagcccatacctttatccactctatggccttggagaactgccccaaggatttgcaaggtaagagcctgtgtttaaaacctcagtgattcaaaacctcatcttcaacataatgtgtatatgagatatagtttaaataatgagatgagatcagtctatgagtaataagatgctttttatttttattgaaataaaattaacatataatgatatgcacggatcttcagttaaaaaaaatccagttttatacaactgtagctgatgtgctcttgtaagtgccaactcctggctggaggccagccaatacaaaaccagcgcacttaacaaaaatacaaccaaggaccttcacagaatctacttcacacccctgttacctccaccagagtaagtgctggtatccacgcctgagagacctggagacagatcacatcacaggactctttgcagacactctccagtaccagcttagagcctgattatctccactgggcggctagatcaagaagagaaataacaatcactgcagtttggctctcaggaagccccatccctaggggaaaggggagagcaccacatcaagggagcatccctgtgggacaaaagaatctgaacagcagcccttgagttccagatcttccctctgacatagtctatccagatgagaaggaactggaaaaacaactggggtaatatgacaaaacagggttctttgacactctgaaaaggtcacactagcttaccagcaatggatctaaaccaagacaaaaatctctgaattgccagaaaaagaattcacaaggtcattattacgccaatcaaggaggcacgagagaaaggtgaagtccaacttagcaaaacaaaaaaagtgatacaggatatgaatggaaaaatttccaggaaaatagcataaataaataatcacaacttctgaaaatcaagggacacacttagagacatgcaaaatgcactggaaagtctcagcaatagaattgaataagtagaagaaagaaatttcagagttcgaagacaaggcttttgaattagcccaatctgacaaagacaaaaaagaatttaaaaaaatgaacgcagcctccaataagtttgttaaacaaccaagcctaagaataattggtgttcccaaggaagaagaagaatctaaaagtttggaaaacaaatttgagggattaattgaggaaaacttccccggccttgctagagatctagacatccaaatacaagaagcttaaagaacacctgggaaattcatcacaaaaagatcatcacctaggcacatagtcatcaggttaactaaagtcaagatgaaggaaagaatcttaagagctgtgagtcaaaagcctcaggtaacctataaaggaaaacctatcagattaacagatttctcagcagaaactctaaaagctagaagggattgggatcctatcttgagcctccttaagttatcagccagtaattttgtatccagtgaaacagagcttcataaatgaaggaaagtagtctttttcacacaaacaagtgctgagagaatttgccactaccaagccagcactacaagaactgctaaaaggagctccaaatcttgaaacaaattctcaaaataccaaaattgtatctccttaaagcataaatcacacaggacctataaaacaataacacaatgaagaaaaaaaacaaggtgttcaggcaaacaaatagcacgatgaatagaatagtacctcaaatctcaatactaatgttgaatgtaaatggcctacatgctccactttaaagatacagaatagcagaatggataagaactcatcaaccaagtatctgctgtcttcaagagattcaccagacacaaaaggactcaaggtaaaggggtggaaaaatatatttcatgtaaatggacaccagaagcgagcagaagtagctattcttatattttttattttataactatatatattttaaaaaaaatcagtttgataaatttatagacctatccctgtcctgggtttaactaaaacctgagtgaaggtatagaacattttcctcaccccataaagttcccttgtgtcacctcataatgaatactgccccccatccccagcaaccacctctgtgatttctgtcactatagattacttttgcttgttttcaaagttcatgtaaaaggaataatacaatatgttctcatttgtgtctttttcattttttgagattcatccatattgatgcatgtgtcagtaattcttttttttggagatggagttccactcttgttgcccaggctggagtgctgtggtgcagtctcagctcactgcaacctccaccccctgggttccagtgattctcctgcctcagcctcccaaggagctgggattacaggcatgcaccaccatatccggctaattttttatatttagtagtgatggggtttcaccatgttggtcagtctggtcttgaactcctgacctcaagtgatccacccaccttggcctcccaatgtgctgggattacaggtgtgagccattgtgcctggccaattctttttttttaattgttgagtagaattcctttgtatgaattatatgagcatataattctccttttggtggacatctagttagttttcagtttttggctattatgaatgaaggcactgtgaaatttttatgtaaaacactttctgtggggatataggttttcatttccttttgggtaaatactgggagtgaaattgctgactaatgtggcagatagaagtctgaattcataagaaactgtaaaacagtgttctggagtggttgtgtcattgtgtatacactcagcagtgtatgagagttctcgttgctccacatccttgtcaacatttagtattgtaagtttttaattttaattgcccaagtgggtgtgaaatgctatctcattatggttttaatttgtatttcttgactcatgttgctcaccttttcatgagcttattgaccatttgtataattttgtgctgtgattgttcaagtcttttgcacatttctaaagattggattgtctttctgtttttgacttgtaggagatcttggtgtatgatggtggcaagtcttttgtcatatatgtattaagaatattttctcccagtttatggctggtcttttgataagcataagtgttaactttttttttgagatagagtcttgctctgttgcccaggctagactgcactggcatgatcttggctcactacaacctctgcctcccaggttcaagcaattctcatgcctcagcctcccgagtagctgggactacaggcatgtgccaccacgcctggctaatttttgtattttgggtagacggggttttgccgttattgaacaggctggtctctaactcctgacctcaagtgatccacctgccttggcttcccaaagtgctgggattacaggcaggagccacagtgcctggcctagaagtgttacattttgatgaagtccagtatatcaaagaaaaaatttttttaatgtttatagctttttgggtcctattttagaagtcttttttttttttttttttggagacagagtctgggtgttttgcccaggccggattgcagtggcactgtctcggctcactgcaagctctgcctcctgggttcacgccattctcctgcctcagcctcctgagtagctgggactacaggcgcctgccaccgcgcccggctaattttttgtatttttagtagagacggggtttcactgttagccgggatggtgtcgatctgctgacttcatgatccgcctgccttggcctcccaaagtgctgggattacaagcgtgagccactgcgcctggccctattttagaagtcttttacttgcccccaagggcacagaaatactctcctattgtctttttttttttttttttagaagttttataattttatctgtgcatttaaatctgattcatcttgagacagtgttggtgtgtgggatgaggtaagacttgaggttcttttttttttttacatacgaatatttagttgttttagctgcatttgttggaaagacttccttttctaggtagtcgtggtgcctttgtgggagatcagttggctacatatgagtttgttttgggactcagttttgtttcagtgatttgtatttcctatgccagtactacactgtctggataattatagttttatattaagtcttgaagtaggtgataacactttcgccaactttttcttcagaatttgttttgggtgttcgcatttccatatacgtttttaaaatcaggttgtcaatttctagaaaacatgcttgttgggattttgatattgagttaaatttgtagatgagtttggagaaaatgatcatcttaattatgctgagtctgccagtccataaatatgattgttctccatgtggttttcttctcagcagtgttttacagctttcactgtagagatctatcacatttttgttcaatctctttgtactgatgccgctgttaatgtattttgtattgatgctgctgttaatgaaattgtcttaattttatgttgaaattgtttgctgctggtatacagaaatgtaattgtatgttgacgttgtatcctatgatcttgtacttaagttttactagttcacttactagtttttctagttttatatatttcttagaattatccttctacacagtcatgtcatctgtgaataaagagattcttcttttataacttttatgtgtttttcccccacttacctttattgcacttgttaggacttcctgataatgtcgcagggatgagaatggacgtccttgctttgttcccagttttacggggaatctagtaaatattttactattaaatatgttttctatagtgttctctttttttgtagatggttttgtcacatcaagtcnnnnnnnnnnnnnnnnnnnnttttttttttttgtagaggttttgtcacattaagttcacttatatttatagtttggtctgtttttttgtttgtttgtttgtttgtttttttttttggagacacgatcttactctgtcacccatgctagagtgcagtggcatgatcttggctcattgcaacctctgcctcctgggctaaagggatcttcccatctcatcctcttgagtagtaaggactacaggcatgcaccaccccacctggctaacttttgtattttggtagagatggagtctcaccatgttgcccaggctggtgttgaacttctgggcttaagtgagcatggtggctcatgcctgtaattgcagcactttgggagggtgaggtgggtggatcgcttgaagcccaggagttggagaccagcctaggcaacctggtgaaaccctgtctctagaaaaacacaaaaaattagctgggtgtggtgatgcatgcctgtagtcccagctattcgggaggctgagtgggaggatcccttgagcctgagaggttgagactgcagtgagccgtgatcataccactgcatttcagtgtgggtgacagagcaggaccctgtctcttacaaaaaaaaaaaaagcatcaaacttttttttttcccctctctctgtgcttcatatcggagaatgcctgttcatgtggcttcaagtttactgaccttttctgctattttcaataggctgttaatctcattcagtgaattttaatttttttatactgtctagatctagagttctcattttctatagttttattttttcttattttttttttttcgagacggagtcacccatgctagagtgcagtggcatgatctcagctcattgcaacctctgcctcctgggttcaagcgattctcctgcctcagcctcccaagtagctgggattacaggcacatgccaccacactcgggtgatttttgtatttttagtagagatggggtttcaccatgttggccaggatggtctcatctcctgaccttgtgatccgcccgcctcagcctcccaaactgctgctttacaggcatgagtcaccgttcccggcctatagttttcatttttgtgatattctctatttacttgactgttttgagtacatttataacaacatatttatccttgaatatgtatctttgaacaaggatatttgttctggaacatattcttgaacatataatatccttgaacgtatttataatagctgcttttaaactgcgtattttaacatttgggcatctgtttctgttgtttgtttttctgttttctttggatcacagttttctgtttcttcccatgtctagtaatgttggattgtatactggacacatgaattgatagtttgttgagatgccggattcttcctctgaaaagttggttttggtttgagtaggcagttacatttttttattgactgttcatcttgcatttgtggagactggattttacaccttgttaaagtgggtccttttagtttttccttttgttgtttgctgattttttttaaatcacaatttattgatttcttacaatcaaatactgccaactagcattacttccactcatgcatcattaaaagcaaaggatatttcctccttggtatttttaaatggtacattatacaataaacaaagttagaacttaaaatgcacccttattaattatgtaaactggtaatttgtttaaaaaagcataactaataatttggttcctttcttcataaaatggaaatttaaatatttctcctgatagtcttgaggtgatcattagtagtgcaaagtgtggcacacacgtatagtttcatctagaaaggtgtgtctcttacacaacttatttaaacaaaatgcacattaacaaaatgcatatagtcaatgcatgaaagaaagcatgtttcaattacaaggcagcccctcgggccaccatattatttaagttttgcatgatcatttatggcattatagattaattatgcataacatacttttatacttttttttaaattatactttaagttctggggtacatgtgcagaacgtgcaggtttgttacataggtatacatgtgccatggtgttttgctgtgctcatcaacccatcatctacattaggtacttctagtgctatccctccctagcccccatcccctgacaggccccggtgtgtgatgttcctctccctgtgtccatgtgttgtcattgttcaactcccacttatgagtgagaacatgcggtatttggttttctgttcctgtgttagttaactgagaatgatggtttccagcttcatccatgtccctgcaaaggacatgaactcatccttttttatggctgcatagtattccatggtgtatatgtgccacattttctttatcccgtctaccattgatggatatttgggttggttccaagtctttgctattgtgaacagtgctgcagtaaacataagtgtgcatgtgtccttatagtagcatgatttataatcctttgggtatatacccagtaatgggattgctgggtcagatggtatttctggttctagatccttgaggaatcaccacactgtcttccacagtggttgaactaatttacactcccaccaacagcgtaaaagtattcctatttctccacatcctctccagcatctgctgtttcctggctttttaacgatcaccattccagctggcgtgagacggtttctcacatggttttgtggttttgatttgtatttctctaatgaccagtgatgatgagctttttttcatgtttcttggctgcataaatgttttcttttgagaaatgactgtgttgagatggagtctcactctgtcacccaggctggagttggaatggcatgatcttggctcactgcagcctccgcctcctgggttcaagcgattctctcacttcagcctcctgagtagctgggatttcaggcacctgccatcatgcccggctaatttttgtattttttgtggagatagtgtttcaccatgttggccaggctggtcttgaactcctgacctcaggtgatccacccgcctcggcctttcaaagtgctgggattacaggcatgagccaccgtgcctggcataacttttatgcattttaaccctgaagacaagacaagtaattgttgcttgaaaaaattattctatgtagccatttggtttgtatctggagaaactgaacctccatgaatttagtgtgtactaagttggaatcattagctcgagtcagtgaatcagatacatttcacagtgactgtttgccaagtcctggcaatgcctcttctcccacagtctgccagatgaagcatttccgggattacccttctatgtggttttcccttttaatttttttgctggattaactgttttcgcattatttcctcttctcccctcttctctggccttccattttaattattcataaatcctttcagaatatcctcagctccataaggggaagttctggagatggaaaatccaagggaggaagattggggattggaatgtccttggctttcctggtatttgctgcaaacttctgccaggttaaagaggctgtagcagtttctgaatgtggcggcaagctccataactctgacttttctacaaaatcagcatctacatccagctccttttctattggaccatttagaagtctgcccttttcagccttgagttgtttattttctttccttaatctttcattctcagccacaaggaattccacatgcctcttcaaatctgcttctctataattgttttatctttcgggcctttgcttctaatacatggctctgctggctcactcttttgctaaagtaaaaatagtagcgtgtctggatccctgtcaaagatcccttgaatctcaggcaggcatttctctgtgaaagggctgtgcttctgagaaagggggctctggctctctgcatcctcagcagagggtttgtgagatgggcagctacatcctgtgttctgctgggctttcagtcttttcacgctgggcccttttccacctgtcttggatgaggaggcgctgtttcctattcctttgcaattccagtgaaaaatgagcctgctcagactgtcagcttcacggcttctgaaggatatgccgcagcctttttgtgacaagaaatagcttctttgtagttgctgataaatggtctgttcatctgctctgttgatgagccaggttgagggatccattattttcatagactccggggtaagtggcagccttaggaaggggagcagtggcgcaggggaacatggaggggactgcagggaagcgcgatgcagccgcagggactgtggcccctctctgcgttcaagagccagcagcggggcgcagagggagcaacaacctcaccacttcctcctccagcactgctccacgggcctgccacctgcgctgctgctgctgccacgcacggtgccatgacgtcacacgcgcaagtggcctctgcttattcttaaacgttactcctctggagtaagcaagctcctttgaacatggcaattttaaacttcagacacattttttcttctgtccttcctctataatctctgctaacctctttgagcctttcagctgtttatttctggtggattccttcgcttttccctcctgtgtgagcacttctggaggtagttaaggatttgaagatattttatcatagatttgttggctccttcttttgaggctccctcttttgtgaaactttcccctacaattttcatctcctctggccgccccaaattctgtcacatctcaaatcaataggactgcaggcattgtgcttctgttgtagctgtaccatgttgcaaggactagggaagttgctgcctgaggggaaaaccatataaactacataaagctctcacccacttggttcctttcaagagtttcttcagtctctggtttttgctgctttaagtcattctccagtgctgcctttccccccactttattactatctttttttgagacagcattttgctttgttacccgggctggagtgcagtggtgtgatcacgacttactgcagcctcgacctctcaggctcaagtgatgctgccacttcagcattccgggtagctgggactacagatgagtgccaccatgcctggttaatttttctatttgttgtagaaacagggtttcagcatgttgccaaggctggtcttaaactcctgcgttcaagccatctgctggcctcggcttcccaaagtggtggcattaggcgtgaaccactgccttcagttccttctgatagtgttttaagtccatagttttatttatatgccagaggattagactaatatagctattactggtcaacccttcccttggccttgcccttgcccttgcccttccccttcccctgggtgtgaatccagagaaatggcagatttgcctctgatgtggatagtcccgcgactgcacaaggccattttagaacacacacacaaggaaaaacaggagaatagacagtgtggggttttgggaaagagccgattttagttgaagaagcagagtaaaacccagacatcgcatggctttaggctttagcctcaccacactcacgagcctcctgtccaggagggccattagtgtctcaggtctgctcagtgtggaccccgaagagccatccatcagggtgagcgaggagggataagctatggatgcagagccgctgcggccgagaggaactgttccggtgattggttagcaagcgggagagtggaaaggggagaagaaaaccgtgtatgggggttgaacgcctccagccaaagaaaatgaggtgtagaggtctcttactactagggaatgtatccgagtcacacagcaccaaatgtgttgctggtggaaggtagccgagtcacaggcaccaaaatatgttaccgtgctgagatgaatccgtacgggtctgcagcaacctcagttcttttctcctcagaagaaagaatgaccaaggggcataaggtagaaggagagactgaggcaagttttagagcaggagtggacgtttattgaaaagctttagggcaggaatgaaaggaaggaaagaaagtacacttggaggagggccgagtgggcagctcgaaagacaagtgcctggttagtgattttttttgacttcgtatttataactgattatgtttgtgtttttgactctgttttcttgctttaatcacttctaagctgacatctttctagaaggaaattgaacaaatgtatattgtctgtaactcattaagatctaagaaaggggactttaggagttgaaacaactatatattattaattgggattttaaaaattttccaggctaagtgctatttatggaggtacctatatgctgaataaacccattgaagaaatcattgtacagaatggaaaagtaattggtgtaaaatctgaaggagaagtaagtagcttttaaaatgaaaaaaattactatgttcttgtgaagaaagttgtgtattctaaatattgattttggtgtggacactgatgcatatgatttctgtatgggaagttagtatttattgtgactaaggactaattacagttgctgtgctttgttttaaaagcatcttttttgttgtcagttgttgattattttaatattgaaatatgcattatgggtgagctctaaatagtaagtattctgtatttatagagtttgggttgtgcctgtctcccaaattttcattgaaattgaactgtacttgcaggccacctacacgggtggggttttgagcagcatttctcaaatgtgaattatatataaagcatcattaatctggttctagtgcatgttctaatcagtaggtctgagaaggctctgcattttcttgaaacctcttaggtgatgtggatgctactgaaaaaaaaaatcacaaggaaaaaaagatcgtttccctttatcaccatatgaattaattcttctgccatttgacactgttactatctgcaacagttcttgcagtagaggatgcacttcaaagtgcactgctttactgtctcactggaattctaaaaatctaagctttatctttttaacattaagctgtgtgggaatgtagcaacctcctgggtggtggggtggggggcatcttcaattatttaggtctcactggaaagtttgagatcagagtttggtaggtggtgtaaggggacaatgagtaagggagagaaaatacaggactgacttggggcaaaaaacgcctgataataatttgtgaagcacattttcaaactcatttattccttacaaggatcctaagaggcgggtattatgtccaggttatacctggaggcttaaatgaagaaacatctacaagggcacacagtttaatgaatggctgaggtagaattggaattaaggtgttccgcacccacagccctcagtcgttatacacctgaggatgtaaattcctgtgctgggtgatgttagatttgtgtgttttatctactaaaatgttatttatttatttatttatttgagacatcaaatcgttttgctctgtcgccgaggctggagtgcagtggcgtgatctcagctcacttcaccctccaccttccaggttcaagtgattctcctacctcagcctcccgagtagctggaattacagatgcatgccaccatgcctggctaatttatgtatttttagtagagatggggtttcaccatgttggccaggctggtctcgaactcccggccccaagtgatccgcccgcctcagcctcccaaagtgttgggattacaggcatgagccactgtgcctggccttctagactgttacttaattgggtcttttgaacatatattttaggcaacttctttataaccctgtttcatcttgactgtcgtagtgtgattggcttatctgctttaaatgaagttacaaagcacaaaagaagtcatattttgtttgacatgtacattactaggttttgttaatgctaacttaattctcaggtatatcagcacaaatagcactgtttaccatccaggtccaacaaacttcactcagccacctttgtggggttggggtcatcagtatcactgtcttccatctccacatcgtgttccactggaagatcttcatcagggacagtaacactgcttgtactttcagcataatagttgtttaggagatagagataaatggtgtgtttttttttttcttctcagtcaccaggctggagtgcagtggcacgatcttggttactgcaacttctgccttccgggttcaagtgattctcctgcctcagcctcccaagtagctgggactacaggcatgtgccaccatgcccagctaatttttgtatttttagtagagatggggtttcaccatgttggccaggctggtcttggtttcttgacctcgtgatctgcctgcctcggcctcccaaagtgctgggattacaggtgtgagccaccgcgctcggccagggataaatgttttaatctgtcttctgaaagttacttttattctgtatttttcttttgtttcattctttgtgtttctgaaacttcagggctttgatatgaaagggaaggaggctataatacatttatcttgcaattcaagtttttcttaggaagcatagccttaagatgataaggattttagtctatgtagagtacatttactgagcatttattttttgtcaggacacccacctataatgacagacttttttacaccatttcatttagttcactaatgtccaaccttttggcttccctgtgccacattggaagaggaagaattgtcttgggtcacacataaaatatgctaacagtaatgatagctggaaaaagggtctgtgcataatttcgtgatgtctgccaccacaaataagcaaaaatgtccttgcattcaaggggctggacgtggctgaattttagtactaacaacaatcctttgaggttaggtagagccaggatttgaaccctgatctgcccaattctaaaacttatacttctgaatactgtgcaacacagttttcctagtatttgaacaggatttacagttcatatatctgttcaaggagaaaatagtagggataattggcaaagctagtttcagtagttaccgacagtttaataattaccttgacttttatattcattagattatgaagataacagattatattcaagggaaaattacattaatatactgtttaaaacattatagacactgaatattagtctttttccctccattttttttttttgtgataaagtacccataaaatttaccatcttttttttttttttttttttttttgagacagtctcactttgttgcccaggctggagtgcagtggcgtgatcttggctcactgcaacctctgcctcctaggttcaagcaattctcctgcctcaacctcctgagtagctgggattacaggtgcccaccaccacacccagctaatttttgtatttttagtagagatggggtttcaccaggttggccaggctggtctcaaactcctgacctcaggtgatctgcccgcctcggcctcccaaagtgctgggattacaggcgtcagccactgcgcccggccagaatttaccatcttaaccattgttaagtgtacagttcagtggtattaaatatattcacatcattatacaaccaccacaaccaccattcatctccataacacttttcctcttctttttttttgagatggagtctcactctgtcgcccaagctggagtgcagtggcatgatcttggctcactgcaatctctgcctcccgtattcaagtgattctcctgcctcagcctccccaggtagctgggattatagatgcataccaccacgcccggctagtttttgtatttttagtagagacagggtttccccatgttggccaggctggtcttgaactcctaacctcaaatgatccacccaccttggcctcccaaagtgctgggattttataggtgtgagccactgtgcccacactcacttttcctcttctaaaggaaactaccaattaagtaataactcctcgttctctgcttccagccactggcaagcaccattctactttctttctctatgattttaactactatattttatataaacggaataatatagtatttgccttcttgtgactagtttatttcacttagcatgatgtccatggttcatctgtgttgtagcatgtgtcagaatttcctttttaaggctgaataatattccaatgtatggaaagatagaccatagtttgcttatccattcatcaatacctggattgcttccatgtttttgtgaatgtattgtgaataatgctactctgaaaatgggtgtacaaatgtctcatcaagaccatgcgtttagttcttttgggtgtgtacccagaagtggaattgctagatcatatggtaattctgtttttaatgtttgagaaactgccataccattttccatagtggctggaccattttacattcctgtcagtagtggacaagaagttccagtttctccatatccttgacacttaattttgttttgatagtagcaatcttaacggttgtgaggtagtagctcactgaagttatgattagtgatgttgaacatctttgcatgtgcttattggccacttacatatcttctttggaaaaatgtctattcaagtccttcgattttttttttttttttcttttgagacggagttttgctcattgcccagcctggagtgcaatggcgtgatctcggcttaccataacctccatctcccagattcaagcgattctcctgcctcagcctcccgagtagctgggactacaggcatgcgccaccgtgcccagctaattttgtatttttagtagagacgaggtatctccatgttggtcaggctggtctccaactcctgacctctggtgatccgcctgtcttggcctcccgaagtgctgggattacagacgtgagccaccgcgcccagccctttgatcatttttgaatcagggttttttttgttgttgttttaggagttcttgatgtattgtggatattaatcccttatttgcagatattttctctcattctgtgagttgcctcaactcttgattagtgtcttctgatgcaaaaatttctttattgtttttttaaaagagacagtgtcttgctgtgtgttgcccaagctggactcaaagtcttgggctcaagcaattctcctgcctcagcctcccaagtagctggggttacaggcacatgccaccatgcctggctatgcacaagatttttaaaattttcatgaaatcctgttttcatgaattctttcctttgttgcctgtgtcttcggttttagatacaaggaattactgccaactccaatgtcatgaagcttttgcactgttttctcctaagagttttatagttttagataccacatttaggtctttgttccatttttagtttttgtggatggtgtcaggtagggtccaacttcattcttttgcatgtggatagttttcccaggacggtttgttgaaatgactttttttcccctcattgaatggtctttgcaactttgtcaaaaatcactgtactgtggatgcgagggtttatttctggctctctcctcgtttcattggtccatacgtttgtcattatgccagtaccacactgaattgatcactgtagctttttagtgagtgagtcctccagctttgctgttcttcttttaagattgttttggttgttccagaattcaatcccttgggaaccaatatgaacttgaggatggtttttgatatcttaacaatactaagtcttccaaactatgaacatgggatgtgtttccctatatccttgtccgcttcagtgtcttcttaaatgctttgttatagattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcaggtgaggtttgaagaccagcagatgttggtagaattttgtaagatataatttgctttgtgttttatcccaaattcctaattttgtatgctgtattagtgaacagaccttggtttacatatgggggaaaaaaatctttgtacctcctcctgctccggcagcattgtgtcaacgcggacagattcaactcggagccagccttggacttgtgtccatcacctgtagaatgaacagactgggcttggtgaaccctgcgtctcccagctctaactaacagtaggttcctgtggaggtttatgcttaatagttaactgacccgagtatattcttgagctaatgacatagctgcttctgtgtccttatttgtaatcctagtacctacatttgattctagcagtgtccacctttcatttctgtgatcaggacatggctctaaaattgcaagtcctaacttatttgtcttagccagttgtttgtaacccttcgatgttcccattttcctttcaactagaagccccaaatctttttatttatctaaaattcagcttaaaaagggtaatcaggctttatgggacaggtaagagctatctgtataatgattttttttcccccatataagaaatgaaatcatgggaggccaaggcaggaggcttgcttgaggccaggggttcaagaccagcctgggtaacatagtgagagctcgtctctacaaaaacaaaaaacaaacaaacaaaaatggctaggtgtggtggcacacacctgtagtcctagctacttgggaggctgcggtgggagaggatcacttgagctcaggagtttgaggttactgtaagctgtgattgcatccctgtctccaacctgggtgacagagccagactgttaaaacacaaaaaaaaaccaatcacaaaagatgatctgtagaacaaagggactggacttaatcttccacaaggttcccaggcgggtcctgggtccttgcaagtctgaaaagaataaaggaggtcccagagttttttttttttggcctttaaatgctctcctatccaaatgattttctatcctggaaatgacacagttaactggatgagtggtatacagaccaagtctaatcgagaattctatcgttatgccaactcaaaagtggtttatgtggattctgcagttttacattactgtaataagtaaatgaggacgtcagtactaagtacatcctttcttagccattcagaacctttctaaatgcaaggtccagaatggaagaatctcccagaatagttaatatggtttggcaggttttttagttaggtatgacagagctgttaagagatctcattccaaacttcagcagttcgctaccacttcaattcttaatctctagtaggttaaaagaaattcctattgttaaatatctgtgtactttacatccaactctgtcaccatttagaacttaagtgtagaagatcttgcctattgagagtaattttaactcacacctcatgacatatgggtgatacctgagtatgttgggtcccagatggagacacttgaggcagtgagctggtatcatttgtttctagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaagtgagttgtgttcttttatatctgccgagatgcaaactgaggcctttgattgtggctccatggtgggacgaatgtgagggcaaggcaggtagctgctggctgctctgtgggattcatctgtacctctcagttgacctcaggcagagccatggtcaggtgtgggaccagctcacctgactgaattctctctccctccagatttgttagcatcagtgacctcctggtaccaaaagacttgggaacagaaagccaggtgagtatggaagtgtgaaaggatatgggcaggtttcactggaagacatccctccatggtcttaagtcttcgtaatttttgttttcagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaactactgcccggtgttggtttgtgtgtcctgattgcaagggtcacagctgccgnnnnnnnnnnnnnnnnnnnncttccctgtgagtagacctcgagttttattcttgacacagtaccattactagacctatcatctttgtgcagaaaaaatagtgtttaatgattttgcttgtagcagcagttataagggagtaagtgaactgtcaggtagagtaggtgctttagtaaataatttttgtgtagttgaaatgataaagtgtttacatataaggccctttcccctgacagtgatgagcctcacggcagatgctgttgtttaccacagataaacactgactcttcagagtatgaaggagacagactaaggtagatgatgtgttaaaggaactagggtggtgatttagattgttattcatattgccaaaatgatggagcttctcgacttcagttgatgttttgggctggatcattctctgttgatagggttgattgtagcagcatccctggcctccacacactagatggcaacagcaccatcttggaatgacaaccaaaaatgtctccagatgttgagaaccactgctttacctgtatgataaaattatctgaagtcccagcaagcctttttctcttcccatgcaaaggcccaagctgggttagtaataagtgaaaaaagaaaaaccacgcatcttcatattcttcattcaacgtatttactgaataccttgtgtgccaggccagtggagacaaagatgataatggtagttactgggataactcagtttggtgaacacatgatgtggtttggttattagtagagttacagaaaaggtagcatggaaactgagatggcctcgtgggtgttggaaggcttttcagcaaggggaggtgaatgttattaggtccaacctgaaaggtgcatatttcaggcagatagataggtgtttggcatcttataactgctcactttccttttccttagtaatctgaaagtaattcactgtactgaatagttaatggttcccttaatagactcttgtccttggaaaaataaaatgaaatgactggggttctattagtaactgaaaaattgtcaacaattaaaactctaaaacctactcatgagaaaataaagctcttttgtttaggaataataaaagccgacttaatgacttctgaaagaagtaagtgtccctgtaaaggccaggtgaaactgccat

SEQ ID NO: 13789 - DNA, 5745 bp, Human
tccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtcatcttccagagtaaaatgcaaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcattgcgccccctgtgcctacctctagcattgtaacgaccacatagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaacctcacgcctctcattcgttgtgatttttgcatatgttgttgactcaggctgaaactcctcctcctcctacagcagcactgtgtgccgccccactgctgcccccacctctcggggcagctggcggagaagagagggggctttccaaatccactatgaatccttaaaaggctgaataagggaacttgaaacgatgcagacaggcaggcaacccgtagtcgagggacatagggccataaacgtcgaagccaggtcttgagcgtcagacagaatgaggtgtcccagagcggcggaggagagccagacgcacgctggttccggtctggacggaatcgccgcggagcacggcagaggctagggcggaatggctacggcagcgcagttcgccaaggctcggtctccgccctgcagcctatttcctctaacccgcagatccactatgggaggaggcggggagcgggctggagagcactaacagagacaggcggggcgagtcgtgggcgcgtgacgtcaccccggggtgtgcgcggcgcgagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcgggtgagggccgggacgggtgagggcgagggaagcgtcttgggctgggtccagcggcgggtgagggcagagggtatagacagacctagctggggccctgcgcctcccacctctgtgtctcattttgctggttctcctccagctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacggtgggcttccgcccgaacaaggccacctagcctgctgtcaaaactttcagccacatcgtgcttttcagcgttctcttccatttgctcccctagtcgctcttctgtgtttgccctctgctcacccaaactgtgagcttcctgataatcaggcctatccatttccctcaccctcctcccgctctgctgacagttctcttaattgatttctcagatcccagatgcagtgactggttactacctgaaccgtgctggctttgaggcctcagacccacgcatgtgagtaaacccagggcaggttagttttgggtgcttgtgcagtatgttgtccatctccttctcatctaagttttttctctctagaattcggctcatctccttagctgcccagaaattcatctcagatattgccaatgatgccctacagcactgcaaaatgaagggcacggcctccggcagctcccggagcaagagcaaggtgtgaggggaggcttaatgaatcagtaattaccttccacaacagtggaggcttatcctgccacccctttggggaaactgaatcgtaggggaggtgtaagacttactcagggtcacccatctgggattgaagtccgggattcctgtgctcagttggtgctcttccctcttccctcaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcggggctgatccctcccatgttgggagacaccatgtggcaagtgacaaagctctgagcccgcccctcttggggccacagtggtagggatgggggaaggggatggaccccatggctggggtagtaccatgactggaggcgggggaggcaaccagaggcctgctgctttggggaggtgcattcccccaaccatgtcccgacacctctggagttcaggcaaggaccttccagtcctacttgtcctgcatcttctcaaggataggcacaatcatgtcaaatttgggtcgctttgcagggtcttcattcatgcagatcttcatgagcttacacacatgaggggaaatacctggtgggatggtaggccgaaggccttccaatgccacctgcgaatacaagaaaaaaagcagcctcacaatttgagtctgtcatgtagagagaagccactggcccttgggacaggattactgtatatccgaacaaatatgtgaggagccaaggcccactacagttattttcaccatcaccaaccactcccgcaacacaaatgtatgctgttgtgctctcaccttcattccaatctccatattggagaggtcagcaaagggtacctcccgtgtcaccagttcccacagaagcactgcaaaactccacatgtctgctgagcgtctgtttgtgtcttcaggcttcttctgcagagctggagagatagggcttgtctgttctggcccccttgcctgtcctgtctctgcccccttccactacttctgaggtggtccttttttacctcccgacatgatgacttcactcaccttcgggggctacccaggcaggtgcatacatgcgaccaggacattggaaagagaacttgacatcagccatgctaattcgggcagtcatgtcctcatcaatctgaggaagagaaaacagatagaaggaggtaagtcatagataggcaaagggcttttggggcctgggccaggagtgagcttgtggcctcaccattacactacggctattgagtgcatgtcgtgggatgaggggctctagtgtgtgtaggaaggccatgccccttgccatgtccaaagcaaacttcacagcctggctctggtccacgacgaaatctgagaggaggcaaaagtcaaatagttcagagaggctccctctctgccatttcctccccaaggaaattcaacatccctactcactggtgccttcatgtagtacattgtagagggatccatacggcatccagtgtgtgatgagagtaggatgaggagcaggtggagactggcaggcacctagcactgggagcacatttggatgcgagaaaatcctagaagagggagggagtggttgagacccagtacaaaagatctctttcagtgctattcagggttccttggaactagcagcttccaggttacgccttgcactacctgagccggggacactcttcattgaagtccctgctcttccttgtactccagtctcgaaccttcagcaccttcacgacaatgtcattgccctgccagcggcccttccatagctgcaggacaggtaggggttaggaggcttgaaatgttgctgccacttccttgcccactaactggaggaaaaacttaaaacaggtacaaagcaagtaatttatgggggtttagtgagggaagggcaagaagggcaggggtcacctctccagagtgattctcgttgagcttcgtcaggaagttaagctgtttgaagtcaatgccagagtgtttgttcagggttccatttcctaagagtgtgggcaggtcaggtacccagcttcaccctaacccagccccaagaggccaggattatttccttttacaacccttcttcccacagtggtgactcacggggccgagtgcgggtggtccccttccagaatgtgtccttgtatggaatacggttgagattctggcccatcttctctgcccgctctagggaagaaaaacaacctaagctgtggtacagagggagaagacaggtgggaagggacgagaggacacaagctaggggatggggagatggacctcggagaagctctctcaggggtgccttggctttgtccacaggcatctctccatacttgttacagatgctgacaagggccccatttgccaccaggtcctggaatgaaaaggccattatgatgagagccactgctacctcgctggcagtcactgaaccaaccatgaatgcacaaatgtagaacttaatcctgtaagtgtcacacagtagtactgacagaatgggttgagggttccaaaatctcccaccaaggctcagactttacttcctacccatctcaggaattaagggctgagtactcacctctgccacttgatcttggccccaaaaa

SEQ ID NO: 13790 - DNA, 5745 bp, Human; identical to SEQ ID NO: 13789

SEQ ID NO: 13791 - DNA, 11113 bp, Human
atcctaatggcagtggataatcactcttgtatgtagaaccagctgaccccccgacacacacacaccaacacacacacatatacacatccaatggtacctgtttggtcaacattgtccaggtgctgggctgaatttataggggcatgtttctggcatttcctctttcttttctcatcttcagcagagtcactgccaacaagagcctgtttgtggcatttcttcttcctttctacttcttcctcagagtcactgcaaggtgggccctgtttttgacatttcttcttccctttcttccctacttcagcagaggcactggcaaatgatgcctttttggggcatttcttcttcctttcctcctcctcctcctcagagtcacttatacataggctggggggatgctgggaaagagatgctgcctctagggcccgtaatgtggccaagagctggcggcgcttggagccctggaggaaaacaggggatgacagtgggcctaaagagaatggatgaggcctggagaacaagaagggagagatgtggacctgattcagactggcagaagcatctgaattcttcccagtcaagcctgccagaacccagaagaacttttatgtcaccaccccaacttctgggaagctggagagcagagaaaccacctatcccactttcttcaatgtgtaaatgagctaatggaggtttccccaaaggaaaatgcaaaggccacaagcaacaagaccaaggccagagaccaggaattccaacccttcaccttgagcttttgcctagagctgatacatttctgtaagaggtaaggaggcttctgaacacaggagacacatgatcacacacgtatattaaatatttaacatgtctctagctgcagtgtagaaaacaaactgaaggggagaaattgcagacagagaggccagcggcttggacaatggtaatggggctaggggatgaaaaaggaggaaacaaagcaggccgattccatgttggaggcagactgaagggtaagaaaagcctgaggaagcagggccctcacatctgcagaggctcaaaggagaagatgtattgtcgggaaggctgattctgtgttgcagtcctaccaggtaatcctaggccaggcacttaccctgattctaagtttcccacaccctcctttgaacaatgatactgacaactcttactgtctccaatccatcctccacactgtaaccgacgaccctttcaaaatacaaatctgaagaaataattccattgcttaaaacctttcattggcttctattctcaatatacgcaaaacttctacctcttgaacttgaacagcatatatgcccctttcatttactatgtatttcaaccacaaggaccacttgtgtttgtgactctgacagaacatgctctcttgtcccagggcccttgtacgtactttttcctgtctgaagaaccctcttcgcttcaccaacttctactcaacaactctctctgacccaacgtcagtttcttttggaagttctcggatcttcagatcaggactcgcccttaacggtgccacaggtgtccctccccgcaatacacacagcgctgggatccaccaatgtccgcttcgcggcctgaaacagctcccattgctcccgcgagtcactcaccttgttttgcgaggaggccgcaggcggaggtcgtgagattacgggcccaaggcccgcggctactggggccgcctcggcccactcaggctcttcgaacatgagggtcgggagggcagggtcgccgagtccccgctcttctccacgtgcacagcgctcctctggaagtcggagcgctcagacctgccagaaccgacccggaaaccaaagcgtgacagccaggggttgctagagcggccggcgcggcgcagcgaaccatcgagtttaaccaggcgcggctagaagggcagggaggcggtgggaggggagggacggaggcccgcgctgcccaagagcgccacgggcggggcggggccggcggcgggctgcgggcgcggccggacgggagttccccggagaaggatcctgcagcccgagtcccggtgagtgcgagaggacccgcgccccctgtcacccctcacttctcctgagtcccaagtaaggaacggagccaaccctggggaggacccccggtcccctctcccagagtatacggagcctgaacctccccacttcccccaactctgttcgcggatagggtctagttgcctgctctcggacatccgttcagcagacactacctcttcgtcaccccctgcccaccctgacccgcctttacctcgcgtctagaggacacagccagggatcatcccgcagccccgaactccttcacagacccccactagccggggacgcagctcaggccccctacccccaacacaaacacttctctcctgtagaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccaggggtgagctgaaacggttggtggatgagaggaaggctagagatctcctggctacgtggagtggagtgctcatgtctggtggtggcggctgcctttgctagccagtgtaatgagtgctaagcatagcctgtggggggcagagggttttcacagaggacgcagtttgagctgaatcttgactgcagaataagagtttcacaggcagaggctacagagagctttccagcctcagtagactgcatggccaaaggctagggggcaaggcacagagcagagagaacaggaaattgtctggagttccatatggctggaggatagatgatctctgtgggtcggagcattgggtacaagaggaaaagaacaggacataagactgtagaggtctccaaggatcagccagatcatgcaagcatatttaggctataagaaggtctttattttaaaagcaaggttttaaagctgtatagtgacataatgagattgtccatttttcagtatcgtcttggatgctttgtgaagagcaggtggaaaggaggcaattgcctagttcatcgtagaagtaatgatgtcttggactagaattagggtgagtgaaaaagagaagtgatcaaattccagaagtctttaggacgaagaattgtggaacttggtgtggggagtgagtaagggcaaagatgaggaccagggttctggcttgggaacttggttgtttttactgagatggagaaaactggaggatgaggcattttattttggacatgttaaagttaaggtgacaatacagcaaggtggaaatgttgagtgtgttgttggttatgcagatttgcaattcaggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtagccattgaatttacagttgggttttttttttttaagttaaggggtacatgtgcaggtttgttggatgggtaaactcaggtcatggaggtttgttgtgcagatcatttcatcacccaggtattaagccgtggcacccattagttatttttcctgatccctccctcttcctacccgccccactctggtaggccccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggtggctcacgcctgtaatcccagcactttgggaggccgaggctggtggatcacgaggtcaggagttcgagaccagcctgaccaacatggtgaaaccctgtctctactaaaaatacaaaaattagccaggcgtggtggcgtgcgcctgtaatcccagctactcggaggctgaggcaggagaactgcttgaacccgggaagcagaggctgcagtgagccaagatcatgccactgccctccagcctgggccacagagcaagactctgtcttaaaaaagaaaaagaaaacaaaagttgagaggtgagcaaatagtgaaagtgaatgtacaccagttctacaaggttggctgagataggaaggcaagaagagcagtagtgatggtgactcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatggtgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtactcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacctggtggcaaatggggcccttgtcagcatctgtaacaagtatggagagatgcctgtggacaaagccaaggcacccctgagagagcttctccgaggtccatctccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggccccgtgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagaggtgacccctgcccttcttgcccttccctcactaaacccccataaattacttgctttgtacctgttttaagtttttcctccagttagtgggcaaggaagtggcagcaacatttcaagcctcctaacccctacctgtcctgcagctatggaagggccgctggcagggcaatgacattgtcgtgaaggtgctgaaggttcgagactggagtacaaggaagagcagggacttcaatgaagagtgtccccggctcaggtagtgcaaggcgtaacctggaagctgctagttccaaggaaccctgaatagcactgaaagagatcttttgtactgggtctcaaccactccctccctcttctaggattttctcgcatccaaatgtgctcccagtgctaggtgcctgccagtctccacctgctcctcatcctactctcatcacacactggatgccgtatggatccctctacaatgtactacatgaaggcaccagtgagtagggatgttgaatttccttggggaggaaatggcagagagggagcctctctgaactatttgacttttgcctcctctcagatttcgtcgtggaccagagccaggctgtgaagtttgctttggacatggcaaggggcatggccttcctacacacactagagcccctcatcccacgacatgcactcaatagccgtagtgtaatggtgaggccacaagctcactcctggcccaggccccaaaagccctttgcctatctatgacttacctccttctatctgttttctcttcctcagattgatgaggacatgactgcccgaattagcatggctgatgtcaagttctctttccaatgtcctggtcgcatgtatgcacctgcctgggtagcccccgaaggtgagtgaagtcatcatgtcgggaggtaaaaaaggaccacctcagaagtagtggaagggggcagagacaggacaggcaagggggccagaacagacaagccctatctctccagctctgcagaagaagcctgaagacacaaacagacgctcagcagacatgtggagttttgcagtgcttctgtgggaactggtgacacgggaggtaccctttgctgacctctccaatatggagattggaatgaaggtgagagcacaacagcatacatttgtgttgcgggagtggttggtgatggtgaaaataactgtagtgggccttggctcctcacatatttgttcggatatacagtaatcctgtcccaagggccagtggcttctctctacatgacagactcaaattgtgaggctgctttttttcttgtattcgcaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctcaggtgaagtagtgcggcttcttcacattgatgccatactcgctgagggcaggggtcaagtcctccatggttagagtgtacttgcggtcctgagggaagagggaagagcaccaactgagcacaggaatcccggacttcaatcccagatgggtgaccctgagtaagtcttacacctcccctacgattcagtttccccaaaggggtggcaggataagcctccactgttgtggaaggtaattactgattcattaagcctcccctcacaccttgctcttgctccgggagctgccggaggccgtgcccttcattttgcagtgctgtagggcatcattggcaatatctgagatgaatttctgggcagctaaggagatgagccgaattctagagagaaaaaacttagatgagaaggagatggacaacatactgcacaagcacccaaaactaacctgccctgggtttactcacatgcgtgggtctgaggcctcaaagccagcacggttcaggtagtaaccagtcactgcatctgggatctgagaaatcaattaagagaactgtcagcagagcgggaggagggtgagggaaatggataggcctgattatcaggaagctcacagtttgggtgagcagagggcaaacacagaagagcgactaggggagcaaatggaagagaacgctgaaaagcacgatgtggctgaaagttttgacagcaggctaggtggccttgttcgggcggaagcccaccgtaggcgtgtaatcttccagctgcatcaagaagtccaccaaaggcgtgctggacaccacgggcttcacgtctccgttggccgcgctcggcagtacgtaaaccccgttagatatggccccctccgggggcgccgcgccacccgccgacaccggagctggaggagaaccagcaaaatgagacacagaggtgggaggcgcagggccccagctaggtctgtctataccctctgccctcacccgccgctggacccagcccaagacgcttccctcgccctcacccgtcccggccctcacccgccccacgccgctcagctggctccccggcccgcgccgccaagggtcccgtgcccccagcagctgctccagccccaggtccccccgctgtccccgcggggctggccttgttctccgcggcggtgctggagggcagcgcggcgggagccgagaccgggggcgcggggcccggggccgaggcggcggaggccggcgccgcctcggggtccgcgccggagccgctgcagctcatcgggccggtgggagaggcggcgaacagagccgcttccgcttccgctcgcgccgcgcacaccccggggtgacgtcacgcgcccacgactcgccccgcctgtctctgttagtgctctccagcccgctccccgcctcctcccatagtggatctgcgggttagaggaaataggctgcagggcggagaccgagccttggcgaactgcgctgccgtagccattccgccctagcctctgccgtgctccgcggcgattccgtccagaccggaaccagcgtgcgtctggctctcctccgccgctctgggacacctcattctgtctgacgctcaagacctggcttcgacgtttatggccctatgtccctcgactacgggttgcctgcctgtctgcatcgtttcaagttcccttattcagccttttaaggattcatagtggatttggaaagccccctctcttctccgccagctgccccgagaggtgggggcagcagtggggcggcacacagtgctgctgtaggaggaggaggagtttcagcctgagtcaacaacatatgcaaaaatcacaacgaatgagaggcgtgaggttttcggtgtagcagacatttaattcttatttgccaactcctgagctaggacctgggaacacaaagttaaataggacacgattctagtcctctaggcaccaacg

SEQ ID NO: 13792 - DNA, 13741 bp, Human
tccctctccccaggcaggcccagcaaaatctgtaggattcagacagggttctgacagctgaagacaagttgttgaggaaattcctgatggaggatcatggggtgctcaggagggagaatataaggtttcagaggctgagagggaaagaaaaggtgagggggagtcttagaatagtggctcccattgcccaacacccagaaagaagacatgccctgcaatggggagaaggtgagtatgagacattggctgtagcagcgatggcattgcccaggctgccaaggactcagagagtccagccttgcccactgacctatgaggagggaatgatgttcacagcacattttcattcgtaagtcaggagaggacattgagcctgatggcagaggcctggtgacatgttgttccagaggttccggaatgtgtgttttcctgttggaaggaaacttcgcagagtagaaaagggatctgagacttttggtaagattatatatgggactgtcaggggtctggagccatctgtgagggatcagggccctttcagccttggctagggagcaggggtcctggaacttcatcctggcccatagctgagtctgcccataattcttttctgactcactaggcaaatctcacacagaaatggggcagctttgggagtgggcccaggaagtactgaggatagcaggtgagatcccaggaagagatggatgtggggccgagacactggagagagaaacaggactgtcagataaagggcgtctgtgactcctagatctcattatgcctactaccataacctacccccaattcctaatattctcctaccctagagggggggaaattgtcagaaatttggctgcaacactagcaacactactcagtacttgaaatgcatttttgcatttttttcattcaacaaatatttctggaacaactcttatatgccaggcactattttaggagtcagggatatataatggtaaacaagacaggcaaaacaaagcaaagcaacaacaaccatcaccagataagtagacagatgaaagaatttcaagttttagtaagtaaaataaaacaagcaagggtctgaaatggctagataaggcggtcaagaaaggcttcattgagaaggtagcatttaagcaggagtcagctagaaatattgtgaaattccagttacagttctatttgttctgggttggttaaataaagctttttcccccaaggtggaaactaccaagaaagactaattactagtagtggtggtgctctctggaagagagacacctcctgtttctgcctcattactgtcaacccttcacttccaggcactttttgcaaagccctttgccagtcagggaaggcgagaggctgggcatggggcttggacatttgacaacagtgagacattattgtccccagactcactagcccaagggtaaagctgaagaggcttgggcatgccccagaaaggcccctgatgaagcttggaaaaagctgttctctgagtatttctaagtaagtttatctgtgtgtgtggttactaaaagtagtaagtattgctgtctctagctgccttagagcagggcttgacacagtacacagcaatattagttccctccttttctcacctcccccattgtggagataaactcaatcacaaaaggtgatcctcagtctactcacttccctgacttatggatgcctggacccattgccagtgtgagagtcacagctggacgtcagcagtgtagcccagttactgcttgaaaattgctgaagggggttggggggcagctgccgggaaaaaggagtcttggattcagatttctgtccagaccctgaccttatttgcagtgatgtaatcagccaatattggcttagtcctgggagacagcacattcccagtagagttggaggtgggggtggtgctgctgccaactctatatagggagttcaactggtcacccagagctgtcctgtggcctctgcagctcagcatggctagggtactgggagcacccgttgcactggggttgtggagcctatgctggtctctggccattgccacccctcttcctccgtgagtaaagctgggactagaagcgaaggattgagttctgggctagggtaaggtagggccagtttttaggcctcggtcaaatttggggtcaggggctatgggaaagggatcggtcccaatggatcaagatatctattttgttctccctaggactagtgcccatgggaatgttgctgaaggcgagaccaagccagacccagacgtgactggtgaggccctgactccctaagtctgtcttatctgtctggttgtgtctctgcattttatcaccttctggttttttttttttttttttttttttactttgccatctccctacctccaccccagaacgctgctcagatggctggagctttgatgctaccaccctggatgacaatggaaccatgctgttttttaaaggtaggagggactgaggttagggcgtttaggaccttagacttactctccttcacaaagggtgtccctgtctgtgggaggtcttaggaattatctgatggtatcactgacagcttctctcaagctatctcagtaggtcaaaggtttctcactgggcccctcagtgagtgtgggttttttcaggggagtttgtgtggaagagtcacaaatgggaccgggagttaatctcagagagatggaagaatttccccagccctgtggatgctgcattccgtcaaggtcacaacagtgtctttctgatcaaggtactgctgggccaaaatcagggccaggctggaaagggctggaatcgacactggggacccttcccccaaatggccttggcatggagcccatagcaataggtagcagatttctttcccatgtgccctcctttcctgtaaaagcttgggctaagggagtgtgcatgcgtgtgggcctggcaggtgcaccatccagtggctgttcttcagtcctagtcttagttctacaccgctctgctgtacctcacactgctggccatcctttttttctctggcaattgcttcccttgccttccatgaccctgtatcaagtcctcttcatagggcaaggcaagttgttcccaacacaatggcacctggctagaagagcatgtggagcatgaaatccagtctgctgtgctcaccaagtcccatgtgacccaggctgtgtctgctcagaggaaggggtgccttttcctaccttgccaaaggtgctgtgtggttggggaagtcctgactgtcggctttgttttccctcctgcctcttttctctctcttctcaaatgtctcattctatctcaaccagttccctaatgttccttggggatccatcctagcctttccatataccttccctcagtgatctcaaccatcaccttggctctgaggaatatctatgctgtggacactggatctagatctactttctgagctccagacatctctttccaattgtatgttctacaggcacctaaaattcagcatcccccaaactaagctttgcatcttctttacaaaccaacctttcctcctgtgtttcctgtttcagtaaatgaccccaaaatgtgcctgattactacaaaccaagtgcacacagggtctcatgatctgggccttggttatcttctcaggtttatctcctcccctgccacattcactgtgtgccagccatacgaatctacatgaggttggagcacactgcttcctcatgtttgggctctgcatgctgctccctctgctggtaacaccctttcctcacttgtcaacctggaaaattcctgctgatttttcagctcttgggcccaatgcttcctctttggtgtgaaaccttccacaacttctctaggcagacttaggcactctgtctatattctcagtgcactctttacactacaccttggtagttgcatggctaggattgcaggagtcctttctgcttttgtacagtgaacttcctgaagtgaaagacagagtcttgttatcctcagtgcctctcacaatgcctggcatatagtagttattcagtgactgtttcttggatgaatgaatgaatgaataaataaatgaagaaatgaatgaagaaataacgtatgggtgattgcaggatgaacagttgtggatatgtttgtcaacactgatagtgttgcagataaatgtgccacaggagtgtctgggtacagagctagaggcatgtgtgttatagtaatagtgactggatttgcacaaactgagagtgtgtaatgtgcaaaaggacagcacattgttgtccacagatggactgagaatgtgtagggccacagaaggatatcgtataagcacagtagataaaaaatgtgtgtaaatgcagagtggcagtatctggggatgcacagtcaaaaagagagtacttttgaatgcagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtcagtccaggctggaatccaagaacctggagtagtggtgggttggtagtgatgccagtagtgatggtgatagtggtagtgatggtggtggtggagccactatgtggctttttaaggaagggaaatagagaagccacgtatggtctagaggtcacgtgagggaaggagaggaagtcattctggtgaaggcaactgtgtgtaattctgtgtgaatagtccctcattgttccccatgacccttaggacaaatctaccctctttagtcttacatacaagtctctccatggccaaatccctattggcccttcagctttgacttttattatacttttaccttaacactaagctccagaaaccctatgctattctctgtacactcagtttgctccatgctttggaatctttcctctctctggggttccatctctccttgtgtgccttttaattcctacttcagatttcactttaagtatcatcttccctgggaagttttcccagactctccccactgcctttgctgagctgatcctgtgtgttttgctgctgaattttggtgtatgatcaccctcctttagccatctctctgatggctgtgagctccatgtggtcagtaccattatctggcccatcctgggacccagagaaagcacaaaggagggcgtaacccggtctcaccaaatgcctgttgattgattggacaaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggtgagaaagccctagcacttgagacctgtcagaattcatccactttccctgagcttgtggatctcacgtgtcctagctctcactttaactccgtgttgcgacaccttggcccttaatctagccccatttccattctggattttcccattgccctcatatggggaaacccacaccccactaaccccagccatctcttccaccttggacctcactctgacctctggcctccttctgtgttctcctcacccatttctctctccaggccatggacacaggaatgggactggccatgggaacagtacccaccatggccctgagtatatgcgctgtagcccacatctagtcttgtctgcactgacgtctgacaaccatggtgccacctatgccttcagtggtgagagatgcccccaactcccccaatgtgctctcacatctcttttacttgtatctcccatccttgacacatttctccattgtcatcactgtgtcacttattttgtcccctctgtccccatccttctgcatgcccttctgcatccctcatctctgaggcatatttctcaatcttgtctgtcacggcccaagcccctaacttcatctacctgtctaccatctactcccatggctgtgccccctgtggacctctctgggcccctatgactccttgtgttctccttgctcaatgccctgctgagccctctggctctcccttgctccctggacctctatgtgtctctgtacctccttgcctccctttgttcttgcatatctttctgagtcctctggctccccctgatttatcctcagaactccatcttgtttcaggttcctggttcctatgtccagacccctgggcatagcactgcctggggatgagatgttctcattgctgagaaccagctgagaagtgttgggtactttagacctttagaggctggcttcactagcctctggaggtttctcctctgagtagccaatggagatacccctcccttgacccgtggcatcaattggtaaaagccatctaataatacctagggctgttctgagttcagtcaggcagtaaatagtcatgctgcacagttgagaatatccccaagaggagtgagcaaccacatcacatccaacctgagatatatgtataattaggacagtggtaagaatataaaatcgtgaaaatatttttttcacacaaaatttttttggctcctgacccttggacaaatttgaccagttatgactatcaagttctgttgaaaaatacatcaccacatggagagcaaatctccacagcaggattgcacactataataagaacatacagctaagatgaaacacacacctgtagtgaaaatacaacattaaactgagaacatacgccatagtaagaacacataagtatcaagagaacacacagccatggtgggagcccattgggaggacacacagacaaagtgaaatgcagaaagagagagagagtgagtgagagattgtgaaaacagggccacaggaaacacacagaaatagagagagacaccaagccatctagagatcacagaacttcatggccatgtggccataatgagaatgctactgaactcctaaatgaaaaatgtcatgtatgttccatagctgttgagagagcccacagcatggagagaacaccttatattaaaaatacccaggccgggcgtggtgagtcacgcctgtaatcctagcactttgggaggctgaggcaggtggattgcttgagcggcttgagcctaggagtttgagaccagcctgggcaacatggcaaaacctcatctctacaaaaaatataaaaattagtcgggtgtggtagtgcgttcctatagtcccatctacttcagaggctgagcccggaaggtcgaggcttcagtgagccgtgatcgtgctactgcactccagcctgggtgacagagtgagaccatgtctcaaaaaaaacaaaaacaaaaaacaaaacaaaacaaacaaacaaacaaaaaacccatatatatatatatatacctagctgaggtgagaatgcactattttggtaaaatcaccaacatgacccagctacagcatggggcagtccctcccctctcactggtaaatttttctttctctgactcacagttttgttgttgttgttgctgttgtttgagatggagtctcactctgtcacccaggctggagtgcaatggcgcaatcttggttcactgcaacctctgcctcctgggttcaagcgatcctcctgcctcagcctcccgtatagctgggactacaggcgcataccaccatgcctggctaatttttgtatttttttttgggttacaatgtactatttattaatttaatttttgtatttttagtagagatagggtttcaccatgttggccaggctggtctcgaactcctgacctcaggtgatccgcctgcctcggcctcccaaagtgctaggattacaggcatgagcaaccacgcctggcccctcataggtttttatctattctctttgcttcttcacaactttggcttgcacgtggaccatcatgttctctccactttctcactacttcatgatctttcagtctcagttccaactgatacctccctcagttgctcttttttcctagtaagatttccagagagggaatctgaatggcccagtccatattttcagaccacaccacattaaagtggttgattgccagcctatgtattggctacattaatgggttgggaactcatcatttacttcattgcacaaagcagcatagctctggttctcaaaatagggcccctgggccaggtgtggtggctcatgcctataatcccaacactgtgggaggccgaggggggcagatcacttgagtccaggagttctagaccagcctgggcaacatggtgaaatctcatctctactaaaaatacaaaaaattagccaggtgtggtggcatgcaccagtagtcccagctgttcaggaggctgaggtgggaggattgctcgagtgtgggaggcagagattgcagtgaaccgtgactgtgcctctgcaatccagcctgggtgacagattgagaccctgtctcaaaaaacaaataaataaaataaaataaatatggttcctgagcagggtaatttcagtgggaaacctcccaggggaggtggatatgtcagtcaccgctgtatactcagtacacggctaataagagaacttgtggtagcagcaagaacactaggtatttactcaacaaatatttgttgagcatctgataagaagtgggcattgtcctaggcactgagatacagtagtcaacatggcagacaagatgcctgccctgacaggctctgctaaagtgagagaggacaataagaaagagaaaggaagaaagagaataattttaggtaatattaagggttgtaaagaaaataagacaggatagtgggatagaggtgaggagaatgagggctgtcttctgaagaaatgatttttgagctgagacttcagtgatgagaaggaattaaccacacgatgtgctggaggaaaagcattttagggagggtgagcagcacatacttcaaggaatcaagaaggaagcctggtgaggctggaacacagagaaagagcaggtgggtgacttgaaagggcagggacggcagtggccaggttacctagacctggtaagggttttcaaccataaaagggagtcatcagaaagtcttgagcagggctgtgatatattctaactcattttttataaaagatcactctgactttttgcagaacataagttataaaagtacaagcatgtaagcaaggaatccagctagcaatccgtgcagttgtccaaattagaggtgatgaccgcttggactaggatgatagcagcagaggtggtgaggaatcaccatgatatattttggaggtagagctgacagcattaactaatagctaagataggccgggtgtggtggcttacgcctgtaatcctagcactttgggaggccaaggcgagtggatcacctgaggtcaggagttcgagaccagcttgaccaacatggtgaaacctcgtctctactaaaaatacaaaattagctgggaatggtggcacatgcctgtaatctcagcctacttgggaggctgaggcaggagaatcgcttgaacctgggaggtgaatgttgcagtgagccgagattgcaccattgcactccagcctggggaacaagagtgaaactccgtctctaaataaatgaatgaatgaatgatatcagtcagagtagggaagggaaaagaggcttcaagaatgactcagctttcgtggactcagcaactgagtggctggtggttttgttttctaaaattgggaaagactagggagtgtgtgtgttggtggggggcagaaatcagtttgggcatattaggttttgggtgcctattggcaccccataagcatgtcaggtaggcagctgatttggagcctaaacctcaaaggagaggtcagtcagagctgacgagaacagattggaagtcatcagcatatagatggcatttaaagcccctggactaggtgagattaccaaggaagtgaaggtagagagagaagagaagaggcccaaagtaggggattccaatatttagatatcaggttgaagaaaagagtagtcaaaaaagataagaggaatactgggagagtcaggtgtcacagaagccaagttccaaaaaaagacatttaaaggagaaggaagtagtgagcagtccagtgctcctgagaggtagggtcagatgagaacagagaattgaccatgagatttcgcaaattggagaatactagcaacctggataagaacaatttcaatggttgagggaaacagaagtgtaattgaagaggattgaggaaaaaagacaaatgggagcctagataattccttaataagttgttgtgaaaagaggagaagaaaaacggggtgctagcccagctactccctcactcttccaccacctcatagggagagactggagaacacagccagagtgagaacattcagtagaagtggtgcttcctttttaagttctggacactgtatttcattatctataaccgcatctctgtacatggacacctgaaatccttagggagtgcccgccaaccccatgatgttggccttacctggaaacttagccactgttttccacacttgcctttctttcaggcacctgctgattccagtttcagccagggcacagtgcccaacattgctgaccaagtcttgctctatttctccttctcacctggcctcttccatcttggcctctggatgcattctctccctctcatgactcatttctgcattcatcactagcctcttctctgcctgggcttctgccagcggccctagagcaacctatggtattccacagggacccactactggcgtctggacaccagccgggatggctggcatagctggcccattgctcatcagtggccccagggtccttcagcagtggatgctgccttttcctgggaagaaaaactctatctggtccaggtgtgtattgggggagaggcttgaggtagagactgggacaagcatatccaactctgtatttattaccatcctttgtcctccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggtgaggggcttctgggtgcttagagggcagcttgttctgctacctgtctgtggcatagatccccaccagggcatgagaaggcctaggtcaggatccccagggcatgagaaggcctaggtcaggatccccatgacatggaagccatgctatgtttggtgccttctccccaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaagggaccttggtcgtgaaacaatcttctttctttgagttgaaaagttagcacttctcctttgagggtgtcgagctcaaacaaggctgtgagaaacaagggaggggagcactaaggggcaaacctatctctgcgcagatgattcttaggtccagatcataaactagctctttgcagactatctacacatagtggggggaaagagaaccagagtcggaagaggaacagctgagtttatacagcaagtaagaggtggagctaggactctgattcaacttgctggtagatggccacaacccagccgcaaggcatcagaaacaacagggcctggggcaactatgcatgtgcaaagaggattggctcagagttgtggggtaggaggtccaatctgggggacctcaaattatggttctgggtgattcaagtaacaccactcatggcttgtgttgccatgagttaggcatgacaagtggaatgaagttgaagtggggaaacagaaatacaccagctgtgtgtcagaggcaagctggagagagagaagaaagaatgaatggcaccatggagcacatttgcagaacacagtccctgggagtcttgctggagcctcaggagctttgctggcacagaggatctggcctacccaattagcctcctgggtatctgcaccatctagaccagcaaatgtcactggcaaggaggttgcagtgcttggttattttctggtcataaactggtgaaggctttgggttccaaatttgctgacagctgtttaactgggaattgggcctagactataggtagctatgtctcagacaaggccctattcctccactgcctttacaacccagctgaggttggaggctggcttgtttcagcctcaaaaaatagcctgagtttccagcagagggcccttattctgagcttccgtgtcctagcctcattttcctttcctgtaaaatagacacaatgccacccaccttccagtgacaatgaatatagactcaaacccatcccttgaactgtcttgggaaggggctctggacgtagacccagactgtggctcatggcctcatgtgatctggagtcagcccctcccaacctgtcagccatttgctccgtaggactttgatgggtagagtagtagctaacaagctctgactgtcacacaaggctttgtactgggaggccaggctatagagtggctccagcttaaagggctgggagctgggggacagtgtctcagattagggtctaactaggaagttgactggagctgagaacagaggttaggggccaagcagcagggttgtgggtctactccttaggagcaccttgagctttacttttcattcctaatggtgtcttggatggctaccctcacggggttggctgctagtctaaggggtggagacaaggacagagtttcaggtctggtccttatcaagttcatgcactacacttgggaccactgctgcatcatgccagggagcctagaggtgtctaaacagttatccaacaactgtgatacccaaggttaactttctcttgttttcagaggcagggagtactaagtctcccctttctcctttcctcccacgtgttctcttgcagggaatcctctagcttgtctccagggaactcccagaaatggtttgtttcagtcagtttaggctgctataagagaatatcttagagtgggtaatctatcagcaataggaatttattgttcacaattctggaggctggaaaatccaagatcaaggctccagcaggttcagtgtctgctgagtgcttgttctgcttcgaagatggcacctttttgctgtgttctcacatg

SEQ ID NO: 13793 - DNA, 72455 bp, Human
  misc_feature (1)...(72455): n = A,T,C or G
tgtgggggccagaacctttacacatcttagcccaggtaattttttctacagtgttaataagtaggatgaattgcccctgtttggaagattcagtaaaatacattgacttggcccagatcacttactctacacctctcctaagtccccagatgtgactcccaggaaagacacaaaaaagggctacccagagggataaggtagtaaccagggaagccctcccagaggaggtgggccttcaaatggcccctaaatgacaggcaggagggaaggatctgggagggtattgggggtggggtggcatgggcaaaggcctggaggtgagagtcagtcagtcattgatgtgagaagagcaagaagtagaaatgtaaggaatggtggggaggggagtcagagctggatgaccaagcaagggttcagctgtagagggtctggcccgccaggctcagggctcgggctttattgtgctggtggtagggagccactgagggtgagtgggggagagcatgccagagcatgcctcagaaagaaaggtgggagaaacgctggcatggagggccgccccctgagttggtggggtggccgggctctgccaaggctatgtgccagctgcctggactgtgtccaggaatgggcacaatgactcaacattgagaaaatcactccccagggagaaagggccctgatgaatcacccagctgaggtggggaggctgggaggctgggaggctgggaggctgggagctcactgagtcaccgtccaagagttggtgaggaggggagctgcagagagaggggccggcagtgcagttgacggggggattcaggtcagaccacattgagggctgtcgggggactctaccttcccgccattcccgggtttggtcctcctggccgtcctgtgagggagatgagaaaactgaggcccaggaagtggggggaggggatccgagcaaggtcatgcggcaagtcgctggcaaaggcctagcgagacccaagcgcaccctccagtccagacacgtcctgccgccccaaccgctttcatgccaagcagaggcctaagaaccgggtcggtccgggcagggagctgaccccggtgacccgctgaatccccggacgcggcccctccgggcagccggcaactgaggccggattgcgccgccgcgatgggacggcagggggcgcaggagcgtcgcggctgccgcaggctcctgaacccagaagccgctctgcggagaaacgcgctcccggagcgcgggtcccaccgcggaactgcggaccgtgtggccctggggcctgcaccctctccggctccggggacggcgacagagacctgcccacccaggcctgggggccccagtcagtggcggccgccgtgtgtgcgctcggtgtctgtgcgcacgtgtctccctcgcagatgggcgactgctccagggcctgtccgtctcacagcgacctccaacattctcccgacttccccctgcctcctaggctgagggagaggagcaagcccgaggctcctgcggtgtccgcggcccctgccccccttccccttccctccccaccccaccccactgcgccggtctctgcctggggctctggccgggccccggaccccagagtggtggcggggaaacagggtgcgatcagacagggtggaggctctgagagcggcccctgcgagatgcgagagaagtggcgacggggcgaggggcagcgagcgcaggctgacagcaggccagctggaagggccgagggaacccagggcgagacagaagcggggtgacagcggccgggtgtccggtggggtcggaggatccgacgggccgagaggtgcggtccgcggtggcggggacataggcggggccggggcgggccgggggcgggcggggggcgggccggggcggggccggggcggacactcgggcggaccaggcgaagctgtcgcggacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcaggtaggggggcccccgcgctgggcaccaggagaacggggtgtccggcgagcgccgggccgggtctgcccgcccccgaacccttctcagggaggagacccctcctctagttctgaattctactcctgtgctgggacggcagcgcagaccaagagcccttgaagccccagctctcagtccacacgtcaccccagactctgaactcctttcggatccggggctccaccccaagcactgagcttccagtccacggtgggaccgcagtgcacactgagagctgtgcccaagcctcgaattccctttccttagattagtggggaccctgcccacgcctcggaaccttcaccatatatgtggggctcccggcacacctggagcacctgaacccccagctgtcatccaggactccacctcagagccggcctcacccaaagccccaaacctccattccaagcctcaactggacacccgctcagattcccacccaaacatctggacttcagtcctcagcctggaacctaccccagagtccaaatctctccttccatcagggcttcactggctttctctgtgggacccactccccgatcccttccctccctcctgtgttggagatctccgagtctttcctcgtggggggcccctcctcttgttcctctccaggtacagtggtcccactttattctctgggcttctcctctggtttctcttcaagtatttctgggctctctaatttggtctgttgccccatgtgcccacctctcttggtctatcttggtctctctcctgtttctctaggtctccatcttcgttttggggtctctttctgcagccaccccttcctcttgtatctacctctgctttgtggtgaggagggggcaggctcagagagcagggctagtgtccctgggacacccccgccccccatgttctcaggcatggcatggtgtgggctcaggtggaagggcctaaatgtggagtgtgctgccctcaggcgatgcccagggatctgaggtggtggggggatgatgtggtgggcactggcttttgtaacttataaagcccctcatcccagctgccctggtcttgacgggggcggctagggcttgagatagggaagagtaaactgcaatctggtgtcaacctgcggtgggatgtgtccaggctgggtgggtctatagtgtatgtgtttgtgtgagtgttcctgtctgtgtgtagcacgggctgggttgcatgtgttgggtgtgtcttgtgtgtaatcatgtgtgttgtgccgtgtatgaatgtgtcatcgagagtgggattatttgtggggagattatgggaattatgggtctatggcattgtgtgctatgtgtggctggggaggcagtgttgtggctgtggagtggtagctgggtgtgtggctgttgtgtgtgtagagaacttgtgtgtatgtggctgtatgtctgttattgtacagtggagttgttgtagggacagcttgcatacaggattctatatgtagttgtgtgtgttactggctgttgtgtgtggccaggaagggccactgcaggggcctgatggtttccactgggtgtcttgtcagagaggagttggggcagggggtgccgtgtgtgccaatgtgtttgcagcctaggtggctggcttagagtcactatggcacatcctgggattgcttgggtaatatatctattaggacctgagtgctggtgtttgaatgtcatgtgtctgtgtggtggctgctcccgcgattctggacaggaaagggttgcagccagggctgaggggtctgaggtgaggagccagttgacaagtgtgtgagtgtgtgagtgtgtgtgtgtgcgtgcatgtacacgtgcatatgggaatggggtggggtgggaggaggcagtgggccagcagcgctgtctatgctgaggggctgtgtgtgcccacaaacgtgtgacattaggtgtgcacattatctatgcaggttgtgtctgcatgtgtctctgtgtctaggtggcgtgcgtattgaatttaattggatgcatacacctgtggctggggaggtgagaggtgtgtgaggtgcgtggtgggagacggtgtgagtgtggtgtgaagtgagggtgtgtgagctgggtgactttttggtgtgacgtgtgaattatgtgatcttttctccccatgagctgtgtgtgcctgtggtgaggagtgagtggaggatggccagtgagctggcggtgtgtgtgttgggggtgttgaggactgtagaatgtgctgcggtggcagtgtgtgcatgaggtgtgtgtgaggaatgaggtctgtaacatttggggcgtgtggaatatagtgggtgtccccataaatgtctgtggagtgacgcatgtgtgcaaaagggcttggctgccatcctgttcttgctcccctcctgatcaggtccctagagatgccctggaatgttctccatgcccccccaaccccagctgcccctaccctttgcccttcatcctccttgccttgaccaagccctttgttttgggtttccggcggagcaggcgctggacaggcgggcggcaggcaatgtcgtggtctgagaacctttgttctcttagtttgactggtgtttggggccttggtttggaggagggtgtggagaggatgcacgtggcagcaaggtcactgtgtttactacaccacttcgtgctccgcagaggggaggcatacggcgcaggcagtgaggcctgggtggtgtctttggtggcgcctgttggtgtaagaacagcttaggctgggcttggagtttgccagccatgcagtcttagtccatagtggcccagcgcccttcctggctcatgtcagcggggctgagcagccgagcagccaagcactcacttctccaagttcacctgccctcgccccttctctgtgtggctgcagcccctggagacaaccaggaagacctcgatttagttctatttgtgttcactccaggtcagatggaggagaaagagtccccatcctcacagagacacttatctgaaaggagagagctggtcacacctttggggaccctctagactgacgcagtctgtagggggatcgaggtcataccttccagagagagctgtgggaaaaccctactgggctgcctcccagcaggtgcttgagagaagaaacatccaaggttccttgagattggaaggcttagagaagtctgagtcagtcagggaaggggctggggtcgatgccgcagtgtcacataccagaaggttctctgaaatgaataggcttgaactggaccttgaagggggtgttggggtgggcagagaaatgcagcctggggctgaggaaggttctggcctgactggcaaaagggatcttgctggccattccccaggcaacactgtctggctttgggtagccatccctgggcctccagccttctcaagctttcacggtaccttttttatcccattgtctctggctggaattatcttcattgtcgttgacattgtcatcttcatcatcttttaggcagttatttccaaattccagggtcctttcacaaatgtctcatttagcaggttaactcatgcaattgtccaaaagtctttatggaacactgctgtgtaccaggcaggcacagttttaagtgccggggtcatggtggtggccaaactggcctcatggagctcctaccttctgtgtccagccatgctgtcagttgcccacccttctgtgtttcccccagtctggggcgcctggttctgtggggctccgcatgtgcaccctctggtgctggggtctggctcctaccagaatgtgagctctgcagaggctgggcccgggtctctcctctacccaccgtgtgtgtcctgagctgggtctggcagagtccagatgctcacacctatcatcaagtgactggaactgccatgtagggttggcagtccagctctgtctagggaaactggggtccatcggatgaggggactctcatctcatcaggcagcatctcatcaggcccttcttttaccagtagctccagagaccaagaagggtcaggtgactggtgcaggtctcacagcagggtggcgcggctggtgtcagaagacagcacttcttgctgccaggttgggctctggtcctagcaccatgctgctctctggctggcctctgtgctgcctgcggcgggtaaacgattattaatgacccccctggcaaggagacaggaaatgtttcccagccacagctggggacctgctccctgccagccccagctatccatacccgtcctgaccatggcatcggtgctgatgttatcttcattctgcctcagtcttctttactccttctgcccatcccccgacctccctgatcttgacatcctaagggtaaatgacgagaagctacagagctttcttttccatatccctgtccctcaccactttctccaacctgactcatctctaccttcttccttgtcccatgccagccagaagtagctcttcctccaagaaggcttctctgaatgcacagccagctcctccagtgtccactaccctgagcccgaggcactgagtccccctcattgcagactctagtcctccactgatggtttgctctgacagccctagggctggcctgggcacttcccgcagactgtccctaattgctgccttaggactgacatatgaagggtcctcccagatgctacctccaggaagtctccagttccactcagcccagggattcttacctcctttgagcacagtgcccttcctgtctgagtcacacatgtgtacttccaggacttcctaggtggacattagtgaacacctgctatgtgcccagcacagagggtgggaagagatgagcaggatgcaggccttaaaatccccacaccttcctccaagcctgagcaatgttgcatcagccccttggcaggtggcacagacctaggtactagggctgggggaggggaggcggagaaacagggagtgatgttggtagagtgtgtggggagggcaacgagggagataaactcaggggccatggtgatataaagcagggacccctatttcagcccagagtgggagggaggggcatgttggggagcttccaggaggaaacaaatctgaactgagagctaaggtcaagccaggagaaagttctggacagaggggagagaatggttactgtgaaggttcgctggtggcagacagagggaggagagcctgtggcagcaccactccatggagcaggcccctgggtgccagccggctgggtccggggggatggggactggtaaagctggcccagccagatggtgcaggacttgtaagccatgttaaggactgcggacttattctggagggaaattgaccctggggaagagttgagagaacggatatgacagatcagatctgcatgttcaatagctccctggaccatggtgtggagactgaaggggaggctggtgtggtccaggtaagcgggggtgatgaggcctggacagggaaatggctgaagaatggaggggaggggacggagtggccagggctggtggagggagctggacagctgtagacgtgaagggcaagggaggagaatgctgccccacccaggtgtctggatgggttttgtgcagtctctgagatgtataggagggaagacaggggttagtggcagatgcctgggcctgtgtcagggccctttaaggaccaaaaggtcttggaaaagcctcagaggagatcatgagctttgagattaaagggagacctgaagccggcccagggctgctacagcctcacctgtaacatgggaacttgagatctgccctgggcaaagggtgttcagaattcaataatcaaaacaatctgtgaaatgtaatacttaataaaattcaaatccaaaaatgtctgagtacattccaaaatgagtaaaaatgtaaatttatgaaaatgctaaacatgcgtgattgttctaatgtaaattgtaagcctcagctgcttcccagaactttggatctggctcccttgaagctgctgcctctgatgtggctgccccctgcagctccaggaccttcctgttcagctcccttgagagtagccggcagggcccctcctctgcagagcctgtactctggctggtggcttcagggggcaggcattctgcctttcctgtctcccaccctaagggagttggccttgcatgcctcccatccacggttgcctctactgggggctgccactgggagacaggaagggcatgggagtttcgggagctcagggtaagaggggctgagatctcgtggtgtggagggggagcgggaaggtcgggtggccgaaagaatggagagggccgggagtgagagcaaagggagacaggcagagctgaagagcagtatcgccccaacatcaatactggtatttcagaatgggaaagctgttccatttcccgaaatatcagaatgctgaggtccgatcttgcagtctctgagctgggcattccttggcccccactctcgggtattcttgcacaagaccatttttctgggctgcattttctcacttgtaaaaggaggaagttgggggtcaatatctccaagcgatatatgagctctagctctaggagtataggattttgagaatctggaattgttagtctgtggggttctaactgggacaattctagcattccttgactctcagctcccagccagggctgtgtggatgcgtggttgtgtgattccgacattctgagactttaagatgctgaggctctaggagctagagatacggacattctgtgaatctaggattctaggatttgatggtttgatgattcaatgattctaaatggggctgctgggaagagctgcaaccacctgccttgttaatgtcaatgttcagttattaaaaacataacaagaagcaatggagacagatagctcagaatggtgggcgctccctccactcccagtgagggaggacagaagaggctgggctggccttagagaatagagaccttttcaacctgggtcacacaggttgtttctcctgtcacaacagaactggtgtgtgtacattcgagagagcttccactcccaaagcttgcagggtaaggggctcatttccttcagcactggcctctattccttaaccatttcagactgggcagagagaggggtaactaccctttcctcccagccctcgaagtctctgggcagaaatggcagcagtggaggaaggagaggtctgctcacccccgccccttccctgacagcctgagggggaaaacaggacatgaatacttcctggacacagacatggaaatgcatgaacccctgccttcgagggccccgcgtccaaaggctcagacaagggcagaggccaggacagccagtggggtcccatcagcaccctctcagtataggctgaggagggaagaccctgttcttgccccaagggtgacagtgagaaggggtcaaggaaaggagtcccaggtcagggactggaagtgctgacaggtcctcccctgtgtgcaaggccacagtccagcctggcagaaggccagcccaattgtccagtgtttcactgcctcctgagtccttcttatgccttggcacccaggccagagttggggaggggtccaggctgcaggggagggtttccttccagagtgcccatccctgatggatccttagaagcccagtacagctgcacagttccaagggcttccgctgcctggtaggttcacagaccaaagctggccctggtcacacagcacaacggggcctgaaatcaggcttcctgattcccagtcctgggtgttcctttttgcccacagcctcccccacttcccctgggacacctgaggggcaggagtggaggtggggctcaggttagggagcagagcctctgtccatcatccctccgtcttcctcttcccacaggccagaagcaggtgtggtggtgacagctgcccccagtcctccacaaggctccattgtccccggcagggagcccctccccagctgcaggccagaagtgtgcctccccgggccctcctgtcgtgactctgccacccgcttcctcctgctgccccttccctcttctcatctccgcttgccctcaggccctccccatccccgtgaggtctcgtctctggcgctctctgggtttaagcctctctccagtgaaagttagatttggaagggccctgggagatcaccaagtccaacccttttattcttcggataaggaggccaggtcagagaggggaaggtcctgtccaaagctgcacagtaggctgaggcagagcccagtgctgtgctcccttcagcgctgggtcatgggtgcacactgcccttggcatcaggcgtccagggtttgagaactgactgtgatgatcagcgctaagcacacaggcacctacagaaatgcggtagggggcttctctcctcagcccttcttcacagccctgagctgccctcccttcctcttctttgcccagctcctctctccttcactatccctgctgtctgctgactcctgcctctggcagacactgtccttgggacacagactagagctcaggcctccaggactgggatgcacacccatgcacccagacacagacacataaacatgtgcaagcgtgtcacggggtccataaatcccagctgaaaactggtcagaccatcaggaggccaccctggaacccagtgtcctcctcttcctgtcaggcctcacacacctcctccaggaagccccttaggacccctgaagaccatcttcatccaactagcccctttgtgacaactgaactctgtgagcctaggttcctcctgtgactcgaagggcaaggctgagtccccccttcagtcctggggccactccttcagtgtcttcaggaggggctcagcttcctgttgctgggtggggagagccctgaggtccccacaggacgtgggacaatggggaggcggtgacagatgagaggctgagtcttccctaaagcagactccaccctcccctgacctccctggctggtggcttggacacagccctggcctggactagggtcctggtctgaccccacaatgcagaggtctgggaatcagaagccctggttctccagcagcagttctctaactggcggctatggagtccaggcctccagggcactggtaggttattggcgggttggtgcagattccagtgtccaggaggggtgagctggcctggggggcctatgtacaggagataggagggtgataaacacaggctaggtgggattacagggagctgggaatacctagctaagaatcccctcatcctaggcactttccccacacttgaaattggctggagggggaaccagaagttaggtggggttggggagggacaggagccagcaccctgcctccacctccgggcagtgcctctgctggggggagggaacctgtcctgggggtggtgggaggtgtgaggggggagctggattctccagtgaaactggccctccctcctctcaggggaggggagggggctgtccctggctgctcagcaggtagcccatctggctgtgggtggaaaagaagactcaggctttgtggataaaagggacagccctgggtcaggcacttatctcaaccctcgtcatttcctctgccggacatgactgggtgagtggggtcattgcacagagggaaggaacaggccagggccagtgcataccaggccctacaggagagtcaggcacatgggtgaccctgccacaccctgggctgcagtcagcccctcatagaggcccagacacacaccacagtcactgccggagatggccacacctagaccatcacaccacacacagacccagtctctccaggtgacactcaggcccagctgcaggcgcagctaagagggaagaccctgcagggcacagggacacgtgggacaaccagacgccctgcttcggccacaccacaagcctccacacaccaggtgcagctcctgtcacccctacggtcaacccaaggagagccagagattccagtagtcgtgggcaggtatccagtgcccaggcgagaagagggggacaccagcagggaacccagaacctcctccatgccagactgtgccctccccccagctcacagaaggagtgcctcaggctgtttatttcctagcagggactagcagggatgggtgtctcatccccctccccctcccagtccccaccacacgattctgaagctgccaaatcaaatcagcccctgcacccgcgccaggctggcatggcggccagcagctgacgggaacgaagccaggctcagaatatcccaccgcctgtccgatgcctgagtaggcttgttgggtgggggtggggaggggcaggagcctggcagccaggccctgggcagtgcccctcagagaggctgggggtttggaatgctgcagggtggtgggcttctggagaatgagtgagcaggtctctgttgtgtctccaggctgctgtggcagtgtctccaccgctagcattccgggaactgtggaagtggtgctggtaggatacaggtcgggggtctgatcccagtccagatgactgggcgccaggctggggtaggggggctcccacatggtctcacattcatttgagactcacagcacccaggttggaagccccttggttgtctgtcagtaaaggcccaactcactgtggaggcccagtgactgtgtgaggtggacattacggatcccattttacagacagagaaactgaggcttagagagggctagtagagctccctggagagaagcagaagtggaggaggcctcagaaagagtaaagaggtggtcatttccactccttaggagccctaggtggaaagaaggaatatggctctgttctcagagtcaaggaacagagaatatggcagagccagaggtgcccatgggaagcagagaacaaggagggagtcttgggagagagcagggtgcaagcaggcaaggctccctggaggagggggccatccgtgggcttgctgggggctaatgggaggacagtctggggagaaggggagaaggcctggccggcctcagcccctgaccttcttgtctctgcagccagcctggacccccttgcaaaggagccaggacccccagggagtagagacgaccgactggaggtgagagctcagtggagggagaagtgggtgggcttgagggggtggggcgcagactgaagatcagtctgagtggtgccctcccccttgggaggacggggaggctggagtcacatcccagccccagccctccagactaggaccacccctatatcaagaccatctcccctcaccctatatatccccagcctggaagtcctcccatgaggattcctcctcccaactcacctggggagtcactacagactcctcccttgtcctccccaccctcacccaacaattcccgttgattctctgccctgagtatttcccgagttcctctcctctccattctgccgcctgcttgggtccaggctccctcaactctcccctgggccactcactggctgcttgctttcagtttcccccatcatccacgtggccaccaggaggatctttctaatgcacagacctgaacttgtcactctcttgccccagaatcctccatgctccccacccccatgccccctccacaaccccagcctggcaatcgttccccttcatccattcctgcctcccccaaactgctcctgctggcctcttccccactcagcttcctaaatccttcggggatcagctctagcctcctttcctctgggaagtcctctctaccccttgaccatgggaccaagctcactcctgctccctcctctgagctctcctgccctggcagtcagatgccagggcgctctgctgtctgtcgcccaccgtgctgtgccacgagcaccctgttttctccatcacgtgactctgtatgtgtgtctgccttgtcttctctgcactgtgagctctttgagcctcgggactgtgctttcttcattcctgaaccttctaccacccttggatgggtaccggtgcagggctcagccagcgcatttcctgccctgcgaggggtgccatccccaccccccgaccatgccttccttccctgtgaggggtgcctcataggactcttcagtgctcaaaggggccttgacgagcaaacaaggtgggctgctgatgttgaagatcggcacagaggagggtgtgtgtgtgtgtgagagagagagagagaactggacccacagccagaacagagtctgcccaggcctggctgagagggagaggaagatgatgcttgtatcagccctcctgtgtgccaggagcctttgacacccaccttgtttaattattacagcacccccatgaggtaggggctgctattattcctatttcacatttggggaagctgaggcccagagggatcattcagcaagtgagttgggacagagctaagattggagcctagatgtgtctcaggctcgaggctcactctttcccggcccctgagtaagatgggaaagaaggtgcccacacagggcctggtgcacaggaggggctcagcacaggttccctgctgggacacagggccaagacctgagaatgtgcctccaagtggggctgggccctgctgctgggagctggcaaagggagctgggaggggagggcctggaaagccacattattaatttatttactgccatggcattccccatggggcggggctccccccagagctgggacagatggtgttcctgggagcctgcagtgtctcagcagcctcggccacccgccaggaaagactggatttgtcatccacccagggagccacaagaagagggggctttggcaaagctgagaccctcctgggcaacggggactgtgccctgagggaaggagtatggctccaggcaccctgctatgcctctggggcagcccccgctgcctaggccatctgcctgccctctgcaggttcaagttctgctctttgtccagctccaccggcctcgtccttcccatgaggcttccctgggtcggccccacctgctcctatccctgtattttctctgcctttccttgagctgggtcctgctgcctcttccctctgaccgaggatctggagccatgagctcctcagccctcagctctgtcctgaccccatccccacactcatccccaaaacagttagtgtctgcctggactcttggcagggcctgctggatttctgggtcctgccagcaccccacccgagtgcccaggcctatactcagcactgctgggaagagatgggctgcctgaggggacgctgccaacatggagagggcaagactggagagagtggggacccgagggcattgctcagaccacaggggcagctggagggaaaagggactgggagcctgaggggccctcctgtcagggtggatctgggaagccaagatggcctcatatagtggacaagccacagggtcagatgagcacgggttcaagtcccaactcccttgcttcctaggtgtgtggccttgtgcctgtcacttaaccagcctgagcatcagtctcctcacctgccaggcgggataagaacgtctatcactgccgggagcggtggctcacgcttgtaatctcagcactttgggaggccaaggcaggtggatcacaaggtcaggagatcgagaccattctggttaacagggtgaaacctgtctctactaaaaatacaaaaaattagccggttgtggtggtgggcgcctgtagtcccagctacttgggaggctgaggcaggagaatggtgtgaacccgggaggcagagcttgcagtgagccgagatcgcgccactgcacttcagcctgggtgacagagtgagactccatctcaaaaaaaaaaaaaaagaacctctatcattcttggatgtaatcactgttattcaacattaccacaatagagctgttgggagaagttacaaagactgtatgtgtggggtgcccggcgcaggcctggcacatggcagatccttggggagagttagcctcctctctgtttccctcaaggatgacatccttagagccaggactaggctgtacccctgtgagacaggatgctctgcagagctgggctgaggcttatggaagttctatgggcatggcacactctcctggcactggctgggcagcagccaagaaagcagagctgccagcacccatccccacccagcaggcgtgtgttcagcacaccctcctgggatggttacctagcccctgtgccagcagctgacttggaggaggggctcttccagctcagcctggcatcctccttcagggccaggcctctgcatcattactgtctctctgaaagtcaggtctggggcagttcaagttggtgaattgagcatgctgagtcaatgccctctttgtgatggctctcagggcccagatggcggcttgggagccttagctgggatgggggcatggggagaggcggacgtggatgagggcactgacatccacaataagtactgaaatgcactgcccaacaccggctcctctattgctgcccttgggacaaagaccacaccccttggcagggcattgctggccttgcctgctgggtcccctcatgtccccttgtgtccccttatgccctgagacagccagcgctacagccacattgttgtgttcactcccagcacacagcagctccccctgcctccctgcctttgctcacactgaccacctgtctggaatacctttcctttctttctccacctactctcttttcaaggcccagatgaaatgtcacctcctttgtgacgttcctcagactggtccctctacctcaggccgagccagtctcctcccttccctgggcactcacagtccccatttccctgagcccacagttgggaaacctgttaccccacggggtgctgtgggtagtgtatccttccccatggggttgtaaacacccaggaggcagaggctgagactgagtctcctttgtctctcttgggcccatgtggtgcttggtataggcctggtatatggtaggtgctcaataaatacttcttgaatgaacaagagtggctgtgagtagggctggagtagttccaagaaggggcacagttgggttgggcggtcttggagacttggaggaggcaaccttagaactttgaaggatggagagggtcaagggcaccaaccgaagaagccagggaccagctaggcagtcagagaggtccatgaggtcagcttctgacagcagcagctaaggacaaccaggaccagaacaggactgggaaaaagcagatagaggaggctggagcaaggactcagccccagaggaggctgcaggaggttggctcatgctcagaacccggctccaaaacactctgcccatgagtgctgggctgaggaaggcttggtgccagagtcagggtgaggctgaggccaccagtgaatatgtgggcccagctgcgggggtagcactaggcaggggcgggagccaggttggagggggtattgccattgccgctgcaggtggagtagggcttcgctggggaaggagcagcttgtgcgagagtgtgggcaggagtgggaggggagaaggctccgagtatacgagcatagcttaccagcaagtcctggggtgaggctggaggggccgcgctgtaggcagcacttttcaggcccttatctaacattctcaagtgagtgctcctagctgccagatgtgctacttcctcctggattctgcacatcaggagccagtggcctctacaatgccccatggccccaagggagtggctgccaacaagttggccttagcatctggcatccatgggggtcctgaggccctgccatctgtctgtgcccctgttgggctgcacaggcccggggcgtgcagggacctgggaccagggaggcggtctcagctgccactctagcctgtctctctgcctgcccatccactgtccacacccctggctgactgagtaaagagagagatgggcatcgcaggtcctgccatcaaagaagcctagtctaaaggaggaggcataaagcaccggggacttatacccagagaagacacatgctgagaccacgccaggctcgcgggcaaggcctaggcccagggagggccagcctcgtcaagggcctggagttgagactcagggaaaggcaggagctggcatagaggcgcaggcaggtccaaggcagtgcccaggccagatgctgcggccccgggctgaggttgctccagccggccccaccccccaccgtcctgcctggcctttggctgtaaacactgagagaacaagttccgtttcccgggaaatatttatctcaggctgtgtgaagagcgtgtgcactggcctccgtgtgtccttcctgcagaccggctggggcaggaggagagggagcttggcagcgcccttgctggggggagtctgtggggctaggagggaagggtgtgccagaggcccctgcctagagcctgaatttgagtgctggctgagggagaggtgggagcagatgggagagaagcctgttttctccaaaccccacaaatgccctccacctctctcatgttcctttcttcttcctggtccatcctgtctcctccaggttccggcctccagcctggtgtcccctcctcaggctgccttttcctcctcctcctccctgtttcctggctcttagccgctccatctgggaagtcttcctcaactttaaaccctcgaacccttgtcctctgccctccatctcccactcctcaggctttcagcagcttcacgtggagcattgggctggtcctgtccacagttgttcagttgctgtaacagcttgtgcaggctgccctggagccctgttctgggaagcacaggtctgggcaccctggggctggggcgaggcccggagctgatctcctctgtccatcccagtagagccagcaccagtgcagacacatgggggatccaggttggtggaccaggggaggatggaaagtcccatggatccagccggaatgttggagtggggaggcagagggcccagggttcctgctggccagcctctgggcttaggggtgtgtatcccagacaggccaggcctgccaggggccctgacaacaggaaatccttgaaggaacaagcagaggctgaggactctgagcacaacaacaggaaacagccgtgacatggggcaacagccctggcgactgtgcccagttggggtggggacgaggggccaagcttgtgggacccagggtgatgccaagagggacactgagacactgtgggacagggggcgttctgcacatgtgacacggagcttatgacgtgtaatatcaagtacgtgaccatgatcatagggtactgtgtggagtgtgggtgagtcactgagtatgtgacactggctgtgaggcactccatgatagcagatgtgtacagtggctgtgccaccaagtgtgtaacactgtgtgatattgattgtgtgatgctgacaccgagtgtgtgacattgcacattgcatgctaccacgtgtgtgacactgaaagtgacagtgagcacatggagggtgtgtctccatgagaatcaaatacagaaacgtgagcaaatgacgctgcagtagcaggtatggtcctgagtctgtggctcgagtgtctgacactgaattgtgacattgagtgtgtcccaagcatatgatctagtgaggctgagtgtgtaaacaaaggcatgacatggagtgatagcaagtgtgtggaagtgggtgtgtgatgctgtgtgatcttgggcctgacattacatgtgtgatgctctgtaatggttgtaacagtatgcaatgtgcacatacagtgctgtgtaggacactgtcatgggaaggcaccgatgggttcaggcgggaaagtaacaccgtccaaaggatggttttaaaagattgctctggccggatgcagtggctcacacctataatcccagcactttgggaggctgagctgggtggatcacctgaggtcaggagttcaagaccagtctggtgaaaccccatctctactaaaaatacaaaaattagccaggcatggtgacaggcgcctgtaatctcagctgctcgggaggttgagacaggagaatcacttgaacccagggggcagaggttgcagtgagccaagattgagccattgcactccagcctgggtgacgagtgaaataccatctcaaaaaaaaaaaaagaaaaagattgctcaggttgcagaatatgtatgtgtgcgagtgtgcatggtgcgtggcaggggaggggagataagttagggggaggcagagagaaggtgggtagagcaactggaggctcctgcagctgcccaggcaggagatggtggtgcctgtgttaatggaatggcagaagagttagagatatggagcaactttggagatatttgaaaacagaaatgacagaacttgctgataaatgagaagatgagcaagagggaaaaccagagaacaatttccagggttctggcttgaagaaccaagcgatggatggtgaagatgtttctgagatgggcaaaggcaagggggagggtcagcactagtggggtgggaggacaaggaggcagaaaccgagtgagctgttttggatgtgttaagggaagcatccaggtgaaggtgtgcagtgggcagcggggccaggctagggatacatctgggagtcgacaggcatggggggtttgttaaggtcgtggacctggctgggataatggagagagggagcttggcaacagaagaggtggggactgaggaccgagccttaaactctgaatattccattgtctagaggccggggaggtgagaaggagcagcaacgagacagaggaggagggccagggaggcagaggagaccaggagtgtgaagccagaagccaagggaggaaagaggctcaagtgggagggagggtcggtgtgtggatggtgctggcccacaggtaagatgggaaccggaagattgtgctgtgctgggcactgtgggtgagtcaggctaatgggagccatttcagtgatgggctggagccagaagtcagactggcctgtgtaggatggtgagggaggtgaagacgttagcctggagagccctttggagacgttgggctgtgagggctgcagagaaggacatgatcgctggaaagggagattacatttttttattatgggtgattctaagcagacacaataccagagagaagcatataagaaactgccatatactcatcaccccagttcaacagttgctgggatttggcctcatttcttcctctcttgccccctatctgttctttcattttcctttgcttaagcttaaaattttttaaattgtggtaaaatatacataacttaaactttaccatcataaccatttctaagtgtacagttcagttgtggtaggtacattcacactgttttgcaaccaatctctggaactctttcatcttctcaaactgaaactctgcacctattaaacgacagcccccatcctcctctgtctccagctcctggcacccaccattctactttctgtctctatgacttggactactctagatacctcaagtaattggaataatgtagtatctgtctttttgtgactggtttttaagtttacttagcataacgtcttcaagttttacccatgttgtagcatgtgacaggatttccttcctttttatggccacataatattccagtgtatggacagaccacatccatccaacaccagacacttgggttgctttcacattttagctattgtgagtaatgctgctatgaacataagtgtacaaatatctcttcaagatcctgcttccaattctttcagatgtatacctagaagtacgcttgctggatcacacagtcattctattttttggtttttgaggaactgccatactgttttctgtatctttttacattcccacggacagtgtacaggggtttcagtttctccacatccttgccaacatgtgttattttctgttcttttttttcttttattttttaatggtagccatcctaatgggtgtggggtgacatttcattgtggttttgatttgcatttccctaatgattagtgaagttgagcatcttttcatgtgctggttggccacttgtatatcttctttgggaaaatgttgattcaagtcctttgcccatttaaaacattgggttgtttgcttttttgttgttattgaattgcaggggttctttatatattccagatattacctctttatcagataaaagctttgcaaatatttttctcccatttcataggttgcttcgctgaaatatgttaaagcaaatcccagacatgatgtcatttcaccaaaggtagactttttttttggtggggggagctttccggtgaagactgaaaaacctgctagacaaattctaaaatagatgtgactttggatttttgttttttaaggctaggaggtcctggatgatgctgaaatgtaacagtgacacagagccagtgtggaactgtgtctgatgctgtgtgagggtgacatggtggctttgggaacatgggtgcaacactgaagatatgggagactccaagtgagggtgacagtgagagatcactgtgtgtgtggccctgtgacacccagtgacatgggacagtgggacgctgtggaccctgaaatgactgtgtgtcaccgagcaggtgggacctgctgtgtgaaggccacaggtgtcatgtcttcttgtgtcatcctggttgatgagtgtgacacagtgcaggactctgcatgggagtaagagggactgaagctgtgctataggtgaccgggctgcatgtgattcaagtgggctcagccccagcttcagctgctgagtatgggagggagcatggacattgtagggtagatgaggagaaacactgaatgggaacagaaatggtgtctgtgcccagatgcgagctcctcccttctctgaatacccaggaaggcttcctggaggcaggatgtgggcacttcagcaggatgttgtaggtgctgattaagagcagggcctgtggtgtcagacagccctgtctaggctctgacattcagcaggtcattttatctcttgagcctcaatttcctcaagtataaaatgggagctcttaggaggattgcatgaagcagtgctccaatgcatgcagtctctggcacttggtaaatactctatggtctcttggggagcagcaacctcaacacctgcaccccaggtccccaaataacaggagcaccagtaggagcacagtgaaggtgcgctgagtgaggtgtcctcttacacccacagccctcctctctccctctcccccaacttctgtcccctgcttggtgttgtcagcgataccccctcctgcccactcactcctgccccctcctctcccctgccgtccttaccactgtcagcctccagcccaggctcctgcagcctcatccaattaggccaatgcaatttgctcaagaaaaagccccataatttggttaatcacaccagtaggggatctggtcccggtcgggagggtgggggtggataggagtccatacccgcagctgaggcacaggtgtcaaagtgcctgtcttttgggacctttacccacttccttgggctcctttcaggagccaacagagtccaaagcttgggtcttctcaaacccaactacagaggccttgaaacaggagtctggacttcctgggttcgcttgtgttcctgggagggtccctgctactctctgggcctcagtctccctttccaaaaatgggagtggaactggggagtctcagaggccccagttggcctagctctgcatcccagctctggtcagtcccccttgtggcttctgaggggccttctcctgggccttggggagggagcactgaggggtaggtggagagcacagggccccagggaagtgaggaggggtaagtgtcctctgagtctcatctggaatgtgtctaccccagtcctataatcagagaccctctagttccaggctgcacacctgaaggtggggcaggaagaaaggaagctgccctttcttggtcacctgcaaggccaaagtctcttaaccgtgcaggctataccttgcacaggagctccagcagaggtggggtggtgctgaaactgagcccactctccctcaccaagcctttcccctcaggcccgcatctgcccagagaattggggtccctcctttctaatgtgcacacaggtggccccagccccctgctgggagtcagcttaggcaaggtttgatggctcagcttaatcttctcagcagctctgggggaagagaccattttacggatgaggaactgagcccaggaaggtccaaagacttgtccagtacatgtggtgtgtggcagggcaggcagatgagcccgcatctgagggaggcgatgggagaagtgacaggggtgcgcagaggaggagaattagaccctctcagattccaccactctcagccacacgttcactcactcatttggagacaagactaaccaccagcgcattcacagccccccagacagccacatactgactataccactgtcacatggacatcaatgacctgaatcacatatgcatagatgcaggcccacatggtcactcccacgtgcagatggccagtgcacacacatagacacagggtactcacacatgtttacactctcacgacccatgtgggttacagattcctacagagacacagacctacatactttcacaaggaaattctcccagtgacccagggaacatagtctgccatgatgatgtgatggtccgtaggggctcgccactatggaccattaatgggcaggctgcacacatgcttaggtccccagcaaagcgggagttctgcacagagtgagaggagaggtcagttctgatgagtgtatccagaattttgcaatcagaaaaaccacacaaaaactattttaattttcatttccaagataaaatttagtttgaattgtatagagggtccgagggtctggtgggagggcatcatcatcttttcaaggctttggggttctaaggcacccacagattcacaacagtcccacaagatatcccaggctgacatatttacccagcccagtgtgtgcgtgtgtgtgtgtgtgtgtgcgcacgctgtgtgcatgctcatgctggctcccagatcctcgggatgtgaggaaggaaagtaggagagattccagagactccggatgtttgttctctggcttcctgggcccttcaaaggaaaataactctggatgtcagcctgcctgcctggcgggctgggtggagaggtgggctgttttgggaggtgggctgtatgacagcctgcctcagcccctgtggccccactgaccgggaccctgtgtaatgaggcagagtgaccaaggcccatggccagcgtcccatgggctcgtaggcccatcgcctcccctctctggggcttggctctctcatctgaaaaatggaggtgggaaggagatgagactggatgggctttctcctggagactgattagagagacagagactcaggcccggggtccagaaaagacaaccaaagctggggagggcacatgaaggggggcaaagaaggtctgggttcaggggagtgcgtggggccccagagcctgccatgtctccgccaactctctccctcactggaggagggctctgtgccttggtgccccacctgcccagggccctgtggctcagccccttgcttgctctgtgagggggacgggagaaggatgagagtcccagtgatagggggaggacaagaccaggggagagggctgggggtttctggagggccagagcaggaagagcaggagagaagagaggacaccacagtgcaggaaacggaggagcaaaggctgggagtggggaggctggaggggtgcagggaatcagactggggcgctgcgaagaggcctgaggccagagcaggcagtgcctggatggagggagcgagcagctcctcaccctcagctccttgatgaggtaaggtgaccacgagccctgctccaggctgtgtgctgagcactttgctcggagcctgtcactctggaggaggggagggggtgttcccaggagctatgacagtcttgtgcaagggagggacagggtcacatttatgtttaacaaagcactgcgctgggagagaggagctgagagaccccggccctggggagcatggtggctgggaccccggagggcaggcgtgccccagacggaccccactcagaagattgcttatcccaaccccccaaagagaaaggctatttttaggaacaataaaagtgctcacacattcctgcaggggcagagagagggaaagggggcaggagtcagtgcagaggaagagggtggaccccgctcttctcccaactctgccttggtcttcagggacttctcctcaggggcttccccagccagccctgcctctccagcctccgcctgtccctggggttccctaccggctcttatgtctatccctctgcttctgaattggtacttgttctgtccctgtctctctttctcatacttccactttccccctccccctggggtttggggaacagctgggatgggccaagctctgttgagagagccaaatacagtcataggacaaagcagcgggaggctgtgggatacacacatgccgcagagcacagacagagagaggtggccaggcacagagagagcgcccagggaggctgagaggcagggagaaaacacgctgggacagtcagggagagccccagggcaggcatcaccgggcagccagcctctgtgccctgctctctatcttgtccctaagaagaccagcatggctgggcttgcctcccgccatccaccccaccagccctaccccaggctggcccttcctccccgccctctgcaggcccacactaaccctaggccaggccgcctccttcagcatttacctcccacacacaatgggcacagtgaggacataagagacccagtctctggcctggaggcagatactcagccttacccgacatctgagagggctcagcccatcccctggccaaggcaggtattagaggggccccaaagacaagcaggactctgggacaaggtgtcctagtgtggcccaaagggctgggctgaagcatgggtctcctggctccagatgagagcctgggtgaatccttccctgcctcctctggccttagtctaccccatcaagcttgggattggactacatgaggcctgaggccctgtagcccctggtccctgggaattctcagaaggcctgggagggggacaggtgaccacgcaggaaggcttcctggaggaggtgtcctcactcatgaaagaaggtgatagtgacagtgctcctcttggggaagagccctccatcctgacctgctgcccccacccggtctgcacgtggagatgatcctgaagcacaaagggcctcccggcctgcagaggtgcctgggagaggttgccaaaggctctcagtaggagacaccccattcctcaggctccttctctgagactgtaactgtgccagactggggaggctttgagaggtctcagctatctcccctgcctagatccttcctccacacccctcttctccctgatggcatgtagccctcacagtacagtagtcctgggcacacaggagtttacccagtcatttacagctcagcaaacgcctaccaacacctatgaggggctgggtaatgctggagacctggagaggggcaggacacaatctctgccctccaaaagctcccagtctgttgtgggagccagacgggaaagggtggcactgcattgatgcacacagtgcatgccatggtgggggaaaggggggcagtgggagccccaggtgggagggtcagacttgcctggagagagaacaacaacagactctccctggaggggatccagagaagggagatcacttcattcattcattcgtcattcatccatccacccattcaattattcctttggccatcatttcctgagggatgtaaactctcttctgacactgacccagcgggacactcagcgtcctcctcctctcctgcttgagccaccatgcctgcctcttggaggctcctggacttgctttgctcagctcccaacccaccctgagggggtgaggctgaggagggtgtacagacattcagggtcaccaaactcagagctggaggcctgccacctcaccaggggcctttctcagggcacaggctccctggtggcagggccttggcccttgcttgcacacccttggggactaggagccccctcatccatcctgctcaggctctcttttgtggcgcgactctgattcacagtgtgcccaaatctgcctccttgtgactgccgcgagctgcctcgtgggccccaggccagaggacaaggatagctagaatgccaggtgaccaggatgactgtgatggcatggagagggggatgctgtgatgtgtttgggaggaagtttgtggtgtccaggagaatgtgggcagcagaaatgggaccactctcggttcttccctgtagatgaagcagctgaaggtgggagggggtgggaggagacctgagctggctctgccccgcttgatctgatgtctgccttgcagggccatcctccccctccccacactcagctcctgcctccctccctctacccactctgactgttccctcctttcctgactccagactctgggtgagggactgaggtgattccagtgagtcaggccctcagggaactgatcgtgcaggcaactcttgcctgccttctcctgctctttccctcttcccattccttcatccacccccaaacctagctcctgatggatccaagggtgcgggggacaaccgggaggtcattttggaggaggcaggagctggaatagaagctgggactggcttgggaagggcgagaggccggggcggagctggttgtgggcgctggaagggaggagccaacagtgtggggtcaggctcctgtggatggggacacccttgggaggcactgggactggctcaggtgtattctacagtgcacgtgtctccagtgtggctcggaggctggagacgcggccctgttggagtaacaactgaagccggagtctgcgaagggtgggcaggagggtggagggatgggggcatggagcgggagggggtaagtagaggagggaggggaggaagagaaagagggaggaggaaaggtctctggcaggtccctcctttaagactgggctcctgcgctgcgagtggccccgtccatactgccttgttatccatatctccccaccactagtctccctctgtccttccacccccagcctctcccctccattgggaccttccctggggcgtcccctcattggctgttctcacctgagcaaggcccctcccctccagtccttagcctcttcacctgtacaatgggatgacccaaacaggcacctcttgggcttgtaggaggatccaagatagtgtcagtgggtctcgaggtgtggtcccccgaccagcagcatcagtgtcatctaggaatgtttggaaacgcaagttcttggacctcgtcccagacctactgtatcagaaaccctgggggtggggccagcaatctgcactttaacaagcactctgggtggttctggtgcacatgaaaattggggaacggctggtggaaacctctagccacaggaggtgcttgggaaaggtaccttcccctccccaaagcctgatgcctcactcaagcatgacactgacagttgggctagttcagctgcgttctgggtctctgtcttgcctcctccttcagactaagcctcccaagggttgccaagcctctttcctctattctcctcaccctgatccagctcagcctcattgagagaagtctggggctgcaagatcttcgcactcacaggcagttcctctttgcacatccaaggcaccagtgtctttgagaggcgtctccttggccaggtggcaggcgtgggtgtgtggggaggaaggaggaggaaccgccttgttctgctttcttgtctctgactctgcaggctgggggtgctgtaaggctgcgaggaggcatagagtcagcttgggtgctgggctgaggccaggggccgaggctcagctgaagcgggcttctctggtctgagcctacaggatgcctcctttggggcagttctgccagtcaccctgactgggcggctgtgcttgctagtgccagacccatgctaggcacagaggtcgatacgttctcctgtgctcttgaagggccctgtcctctgggaagataagaggctgtgtatattgcccaccggaacaggaggcaggaagcaaaagaggcgtagatgacacttgcctggcaccccctgtttcccctctagctgccttcctgggtttcccattctgtgggcgcttctcttgagttaggtgctttctcccagtgttctcaaggtgactatttggaggtttgtgggaggagtgggctggagacacaggagtaggtgggggcaggaagtatgcaggagagagatggagagtgggaggagaagctatgagaggaagagaggacgcggaggtgggaaaagacgtcaagactcctggagaggaacaggagtgcagcctgggacagaggtggacgtcggccgggggaggcagggaggaaggcagggaggtccacccgaaaggaagggaagggatgatggacagagaatgagagggctccgaggtcctgggggatctagaaggacccttccctttacagaaggggacaccaaggcccagagagagaggagggcctcacagaggacctaacacaagcagagttgcatgaatcagtgtgaacggacagtcccaagagcacagccggaccttgggaggtacttgactcttgagtttgatgttattgccttcctgtaggccagtgtgaggggcactgtgaggcttccttccagagaaggaggcatggagccagtgccaggcagtggggtgagccataggaggacctgtggagatggggaaaggcatagagactcatgaagatgaaacaggaaagatcttatggcagcgaccccaaccctcaggaagggcgttggtcttgtgcttgtggctccaaaggggataagaccaaggtctctggtttcatagaatcttaggctttaagaacgagttagaagtaatttagtccagaccctctcctctccccagataagtgcagaaatgcagatctagcccacggctgagccccaaccctggcttcagaggaggcctgactcagaacaggctcccctttcttggtacctggggtgaatgaaagctaagtccgtggtaatggtgctgtctgtggtgctgactggccttaccttggactacagagctgcaggtggagctggagagagcagaaaggctccatctatccatctacccacccacccagccacccatctacctatccacccaccatccacccacccatccatccaccatccctcccccaacccatcctgcacccattcatctatccacctacccactcatccatccagcctcattgaattaaaccatagaactatatgctgcagagctagaaagatccattttttagtaatgacaaaactgaggctcagaagaggaaaggtgttgcgtaaggccacacagaacttctgtagtcagtctggtacaggattggaaattgcggctcttttctacacaccacaagttctcctctgtggtctgggaaattgcctggtttttatgctgatatctatactgatatttgttccaaaaagctgtgaaggcaggaaatgtgacctccttcaccccatcccgagcctgagttctgtgtgtgtgtgtgtgtgtgtgtgtgtgtgtgtgtgtgtgatgtgatgtgcatgtctaagtgcaaccttgtatatgcattgaatatatgattgccttttgatctgtctgtgtgcgtgtttgtgtgagagcctgtgcatatacgtatgagtagaggagtgcgtagcaatatgtatttgtgtggcatgtgtagatgggcatgtgagcaggtaaagctgtgtctgtatttttcctttcctcttccttttaagatcgaagccccctgacttgagccttgctccccatctgtgcctccaattcaggaatctccctgcttcccattagcagctgctccccactgattctctccttccttcactgaagcagcaactcttccctctgagcccacacctcatgggctttgcaatttgagctatttcctcccctgagttggtgcaatgggggtgaagttgctttgagatctgaggaagattcatggaggagatggcatttgagcaagccttgaaggcccctttgagtgccagatctgaagtggcccttcccagctgcagttcctgcacccaacaccctccattcctggggcatgctgggcaggaccaggaggtggattgacagaaggatgcccacaaagagccctgggcttcatcagtcacattaccatccagtccgctctagcacagatgggaagcccttccctgctgctgccccaactctccccaactttcctttcctgctctccttattgctactatcctgcacttggcctgaaaagtcacagaaaactgaacaatcagagcaaaggtcaggcaggcacccaccaattccagtaaaggacagttgagggcattccccaattgaagcaaagggcaggttgaggagtccaccaatcagaataaaggacagactgttctttctgagcaccctagggtgggagctggggatcgggtgctgagcaggaaccagacagggctagagatccagaggtttgggttctggacctggctctgctctgactggctgtctgaccacaggttgatcattgcttctcattgaacctcagcttcctcatcggtcaaatggggagacttagctctctgaaggctgtggctttgaagaatttctccccctgtatcaggctcactccgtcacctgggtctctcttccccaagtccacatcacatacatcagactccaccaagggcagggcctctcaggagtcagcttgtgggctcctctgcctccaagaaggaatagacacaaaccaacaccaccttctgtgctgtctttagagcccccgtctggggagcgtgcatctggaagactttatcttgggagtactgggggcatcagctcttcctcccctttttagtcttcagaattgaccttggaaggccataatagcctgcgtgtattgtgcacaggtatcactcgagctcttgccctgtgaatctttaaggaactgtaccagtgagaacgtgtgtgtgtgtgcgcacatggatggtgtctgaaggcctgctgggatgtctgcgaggacgtgggatctgtggctgtgtggtgctgaagttgtctgtgctgtgatgaggagtgcctaagggtcaaaagacaagtgatccaatttgggtattgtgttgtctggaatcagtagcttctgatgtctgagggtagacatcttcccatgaccaagatatgtgtcttcatccttgagcagtgggagggaccaaggaagcctgggggttggggaaagcgatgctgagtaagcatctggggagaaggcccactactgccctcctcctgggaacactggattgggtgggggaaggggaggaaactgcagccaagaagacccaggagtgaaatttggagctgaagcctggatgcaagtcttcattgagagcccagcgtggaactttctggcaaataggcattcagcccactcttgtgcacccttgaggatgggaagctcacttcctccctctctcctggtgacctgtggcatgcctttgtagcatggccctacctggaagaaggtccttcagcccactagaccaaggccagcctcctgtgaaatcctatgggtccccaggctgtccatggggccacagagttcagatcccccatctaggagggtctgagagattggagttggagactgataaccctgggtctcctctgctttagatgaggcatccctgggttatccagtcttagtcacatgcaaaacttggtttccaattccctcgtttcataggtcgcctcctctggatgagtgtcatcttgtcagcccctgggacacaatgaacaggggatggtctaactagactataaaagtgggggaactgtcatcttcccaattgggttaacagacctctattaatatggcctgcagtttgagcatttttatttcttgccagtcatgcttacactgtgggctcatgctgaactgtggtcttttaagaccctcaacctcatatcatgttcacatgaatggggacccagccatgtctccttcatcttgcagttaatcactttgctttctgaacacagacccaaccttccactgggaagacatctgaaaggacttccaagggcttgcgggagggcatggctggtggctggtatgagtcacgatcttgccttggccctcgtttcctttgttctgttacctttctctttgatccccatggctctggccaagttaatagagcgagaagcagggacttttgtctccgttccggctctgcaaggacgagttctgttcctgggatgggaaggctgtgagacagtcaaggctgacgtctccttctcctcctatagttgccaggggtggcccagctgttctcccaccttatgggttatgcaccccataggctcttgctactctcaacccagcccctcactaggctggaaaatgagactaggtgagaccaccttccttctggggaaagtgagcgggacccagcttcagcgaatattcagctgagcatctactctgtgttgggcattctgtgaggcacttttaggactctgatttttattttcatttttaagggctcaatttcattttatcttcatgtcagcctgtagggggcaatagccccagctgcttccaacttacagataggagactgaggctcagtgactgaaccaagacactcactgctcatacacagcggagctaggattcaaatttgggtgtttttttgtttgcttgttttgttttaatttggagccttgtggtttccctactgtgccagaattgtcctcgactagagaacaagagacctggggtctaggccaggcttgacctgttgactcactatgaggcctttgctaagtccctggcccttctctgcgcctcagtttccccacctgtaagatgagggtacttggacattctgtggccttaagactgtttgattttgagatcctaagatcctgggattcctgtgcctgaaagactcgggctctggactaagctggggggttttgctcacagtcctttgggcagatggggctgccctggcctgcctggcaaagcctctcactgccctctcctctcttccaggacgccttgctgagtctgggctctgtcatcgacatttcaggcctgcaacgtgctgtcaaggaggccctgtcagctgtgctcccccgagtggtaggtgcccgcccttgccccacgcttcccaccccacccccaaatcctttgaccagctctatgctgtacctcactcagggccaaggaggaaggaagaggcagggtccctgcccagaggactttcatggggaagtgaagggtctggatgggtgttctgagacagctttctggaggaggaagccttaggctaagcatcaaggaatgaacttgcataggaatcctgcaatggctgagccagaaggggccttagaggttaagtggaaaagctgtgtctcagataatgaaagggattcacctaggataacaggacgtggtggagccagctgagttttggaatacatgcagcaggagaagttgagggtagacatgtagaagaacttcctggaagccaggtctgggaggtactagaatagggctcagctttgatgaatagacatgcattgggttaaagtgccctgcctggagatgggaggctggaaaaatggcctctagcagccttttagcagctttctttctgtcccatcccaataccatggatgagttgcaggtttggggcaggtttggggtgatcatggttgcctgagcccagagtgccttactggggagattgtgcccctcatcatctgttccaggccactcccctacctggcttcaatggccactgttcatcccttaggcaggaggatgggtaaaccagcccttgaggcccaaagtagcagggtgttagttgcaccagaaagagggaagcaggggacgtttgaagcctggagaagggagtctgatccagcctaaggggcatggaagacttcctggaggaggagattccctaactgagtcctgatagccttgaatgtcctcttccctactctaaacccggccaagggcagcctctgctccaggaaatatggccaactcagaatgtgaccttcccatccctccagagcccattgtccctgaatctgcttgatggatgaaccaccggaggcccagagagagagggcacttgtcccaaggtcacacagcatgacagggataaatgggacttggtatctaagcagccccattccctctcctcagctctgccttccccaaacctcctagaagttcagagcccaggaggagggctaatgagtgagctttattgagtgtgaaattggtaggaagtgggtggtgtgttggcgcccaaaaataaatcctcctggagaaggacgggactaaggcaacatctggcctggggtgaaggcacatctggaaagggagggtggtggaaactggcaggtcggtttctgtagggctgccccgagagcctctgtggccactgaggctgccgtagggtgggaggaggaagtgactggctctgtttcacaggcagggtgccctggcggctgtgccagcctagatgctctgcaacagattaattgtctccccaaagctgggggctgggatgacagctgtggtccaggttcctgggacagtgggaaatgtcagccctggcccacccaagagccctataggagctagggaagccctgactttcgggagtcctggcttgattgcacggaggggctcagcccccagtgaggtaagggagctgaggtctgctctgctgcccccagggagggaagcagagatggggaggggacccccgcccagggaggagagctgctggcacctggcttcctcatcagcacccattgtggcaggcagccccgaatgcagatggtgctgatgtgtctgaaatggttccctccttctctccaatagactcagctaattttaacccagagggctgagagtaagggggtgggagacatacggacatgcggaagtgaagcgagaatctgtccccctctgcccccatggactacccacccctccctctgcctgggcaggactttctgtataaccccggctggtctcttaacctctttgggccaaataactcaggcccctcccaggctgctggaagagatggatgacaaggaggctagatatagccgaagagtgggcggcctccttcccactgaattctttatccctgaacatcccacttaggtttccttccagccaaacaagagggtgtctgcccctctcactcccttcaggccttatcattcccaccccatgccacacccaccacggaacctggctcagtgtctctggaagtagtggccaggcatctcctgtggtgggggctggctggcgacagctgatgacaagaagagtggctggcaggattgtggacgctctcagagtcatggaaggcaactgcttcttctgggaaggattccacacttactgagggtgggccttcaacacgtagctccactgtcagctcctcccaaagccctccaggataccctcagctgggaggcaagcccttctccatcctcctgcggagaaaacagcagagttgtggacaaggctgcgttgcatgggggttggtcagggatcccgaagggttgccagttctgcttggaaggaatgtggatttttgcctgtaggtcagtgagggcaactacttctgccaagacatggcctggaactgaggccagagctgctctgggcccttggggagggaggattaaagagcaagagctttgatctccctctgaggagtaatcggtccaaaatacaaatctgctcacgtctccctgtgcacgtcctgccctgccccagttctgttcgtaagcccatcccactcagccctactgaccttgggcccagcccctgtgccccttccctcactgtctgttcctaaatgctccatgctttatacgcctctggacctacctgtgtacctgctataaggcctgggagcccattctgcaccctgcccactccctgaatgtgtctaattcccactcagtgacagctgaaaggtcacttcctccaggaagccctctccagccccaccggaggatggcgcagtgccctgctctgtgttcctcccctggctggggttatgggtgtgtggtttcttgtagaggtgaaggagggatgcttcctagaacattctgagccccatccctggtacagctcagagtggatgctcagttattgtttgctgaatgcctgaggctggagtcaggcagggaaatatcccaggtgggaggtgatttgtctgcaccctcagtccttgaaactctttacctggcacattgggttttgggtggtaaaaaaggtcataggttcatgaatcattgcctgcttagaattccttccaagaggagaggacgaggtgcttagttcaccgggtgttttgctgccctggctgcatcttagaatcacctggagagaaaaacaaacagatcattgccagagctccactcccacaggttccatgaccttgccccacagacccctgtgtacaggctgggactgggcagctgggagggcctctccacagggtctcataagtgccttctgtcctaggaaactgtctacacctacctactggatggtgagtcccagctggtgtgtgaggaccccccacatgagctgccccaggaggggaaagtccggtgagccattctctgcacccccattgccctcttgcatggccaaggattctcagggctgaggcaccatccaaggtcatctggtctgaccctccccttccaacattgatccccgcctccctgccaggtgggattccttggccaggttgctgactccagcacagaagggcagaagcaatgtcttctcttccttggggaaatggataggcacagagaaaataccaattgatggtaaattttctccttctaattgcttctaaatggctgcagcctcctcagagcagagtctcagaacattggggctatggggtgtatcagttagaacaccggcatgctgtgagaactactgcgaggctggacctggaatcccagcatgctgggcctgcaggagctcacagtgccaactccttgcatctgagaacagggagatcacaggcagcgtcctgctgagggttctggagccccactgcctgggttcaaatctcagctccctgtttactagctgtgtaaccttgggcaaatgacacaacctctctgtgcctcagttttgtttatgaaatggtgataataatggtgcttataggattgtggggaggattaaatgtgtcacacatgtaaagcatttaaatcaggcctgatccatggtgagggctgtctgttggggattaccattgtgagagaatgctggaatcactgacttcaggatcatgggatcagggcacttggccccctgataccttgatgcccatttaattcagcctcctcatcttccagatgggtggatatcatgagacatgaccaaggccacatgccaggtatgaggcagagccaggcctaggactcgggtcttctgactcctggctgtttaggggaaagtgagaggaagtggaactcatcagatgagaaaaccttgggggcaggcatgctgctgggaggaggcaggctctgaaggatgtggccattgcctgctaagcactgaatgcagggccattgtggggcccagggagcactgggcaggagctgagggcagagtgggcaccagtggggatgtcccaagaaggcagctctctacccctgtgaggagggcttttccagcaggccaggtggtccagggatgtggctttttcaggtagcagctgagcctggcaagccactcacctttcacagggaccatggaaagaattcctgtttgaggatgctggactcatggtcctgaggcccctccttgtgctggaaaccctggtttctaggatgctggtctctcctcagccctttcccgtggaaggagttggttctgctctgatagccaccttcccatttcctattctcccactgagctcctttcaccttcccctaacaacttctccgtcaaggagcatgggaacaaagccattaccacctctctctagcctttgtgtcccgtctgtaagaggatggtctgaaaggtctttagaaccttaaggggaaaaatgtggtcatgtccccctttctcctctaattccaaagaacttcgctctcctccagcatcccccacctctaattctaaagaactttgcttcatataagctccactcctccaggaaggctcctcggagcagcctgggaggccttcctgggagggatgcaggaaaacaggctcaggaggcagcggggagcagcctgcaggtttgcttcactccctaggacccacacatgctcccctcagctgtctgggcatgtagagtgggtgcgtatctgcggtccaggcatttttgagagggctcagatccttggcatcagctgccctttcaacatcctccttccaaccacttcagactcagtaaggcctttggaaaaaataccaaaaaaaaagcaattaaaagtgaatattcaaatccaattatcccagagctcagtggagatggggaggtgagtgcctgctggtagacaggggctgaagattccaggaggagggccaggggatgagaaggcaagagagtgaggacagcaaggacctcccaggggacatacccatcatcaggacacacccgtcatcatccccaaacaggaattctttccatggcccctgtgaaaggtgagtggcttgccaggctcagctgctacctgaaaaaggattgggggaaggcccaggcccagtgctctctctggtatctgagctctgcttgcccacctttgtgcctggtgtctggtggtgagcccatctccacaattagggcggagaggccccagggttggctgggccctgctctcaggagctcccagcaggatggggacttgagacccaggtgtatggacgagggaagagcactggaatgggattcagacaggtctggattctagctcagccccctccctgtctctctgctttcctacctgaggcccggtctattggcttaatggggtaacaggggccaagtgcttggcacagtgcccagcacacagtaggagctcagtgattgctacttgcactcccaagtcccaaccaatgattagccttgagtgaccttgagaaaacgacttctcttctggccttttttctgtgaaatgggtggggttgggtacagggtccttccgatggtgacctttgtggctctggtccccccaggagggagagggactgacctacaggctgccgtggagcctgaggctctagcagtgcccgaggaggtgggggtgtggggagggtgctactccaggaaaccctggactgtgggcaaacagcagcaggtgtggcgtggaggctggatcatagagacagataaggaggcccgaggcaatgggcagggaatgggatcagggcagtgtggggagagacagggtggaaaagggtcaaggcgggagtgaggaggcccccgccagctcccagccccacctgtccctgttcctgccgctgtttgggctctcagatgcccagctgcatccccccagtgtgtttggctttcctgtcttcttgtgcttgtaagggctgcttgctcccttgcaaagaccgtccctgctccactttcatctcagccaatcccattgtaattatctttcatggcctgaccagaagctgtcttggggaagcctgctccacagttccctgacactgagaaggaaccaagtttcagaaaaggggtctgggccatattggcctcccttagggttcttccacaggaagaaccttgggctgggagtcagagacctgggatccaggacaacatggctgcaatcacaatccgatgccctcttcctgggcctccatatgcccttctgtaaaatgatacgctgaacattctgatattgagggctggtgaggctctgaattgtaagggctgcaaacgaccttggggctggagaggagagaatcctggaaggctgcctgggccagggtcttcctgaaaggaggcttcacttccctcttgttggtgccccacctccatctcccagactgtttcaggccccagctctgccgccttcctcttcttgtgtctcctgctatcttaaagcctctgattacctgatgctgagtgcagcaaaaatctcaggcctttcagctgcaactgaagcacccaccgcccacctcggcccaggctggctgtctccctctgctaccattttggggtccccagggcccatccctaagaaatttcttcccctaagctgaccaggtcttctttcattgcagaatctgaccatccctaggggttgtctcagaggacaccgggaacggtctgctcccatctcgggatcctcacatgctgggggaaggagggcaagaagagggtccaggtcctgggggctcagtgagagtggggggcttagtgaggggatgggggcccagtgacagtgggcagcctcagtgaggtgatgggggcccagtgaggatatgagggctcagtgagagtggggtggcccagtgaggggattggggcacagtgagagtgaggggctctgtgagggggtagggacttaagtgaggggatggaggctgagtgagtgtgtgggggctcattgagagggtgggggctaagtggggaatgggggctcagtgaggggatggaggctcagtgagaggatgagggctcagtgaggggatgggggctcggtgaggggatgggggttcaatgaggggatgggggctgagtgaggggatgggggctgagtgaggggatgggggctgagtgagaggatgggggctgagtgaggggatggggctcaatgagaggatgagggctaggtgagaggatgagggttcagtgaggggatggggctcagtgaggggataggggctcagtgagaggttgggggctcagagaggggatggggactcagtgggggatgagggctcaataaggggatgggggctgagtgagaggatgggggctgagtgaggggatgggggctgagtgagaagatgggggctgagtgagaggatgggggctgagtgaggggatgggggctcagtgggggatgagggttcagtgagaggatgggggctcagcgaggggatgggggctcagtgaggggatgggggctcagtgagaagttgggggctcagtgaggggatgggggctcagtgagaggaagagggctaagtaagaggatgagggctcaatgaggggatgggggctgagtgaggggatggggctcagtgagaggatgagggctaggtgagaggatgagggtttggtgatgggatgggggttagtgaggggataggggttcagtgagaggatgggggctcagtgaggtgatgggggctcagtgggggattagggctcagtgagaggatgggggctcagtgagaggatgagggttagtgaggggatggggctcagtgagaggatgggggcttagtgaaatgatgggagctcagtgagaggatgggggctcagtgaggggatgaggccgagtgagaggttgcggctcagtgaggggatggggacttagtgagaggataggggctcagtgagggaatgggggctcagtgagaaggtgggggctcagtgcgggattgggtctcagtgagaaggtgggggctcagtgagagggtgagggcttagtgagggtattcgggctcagtgaggggatgggggctcagtgagaggatgggggcttggtgaggagatgggggctcagtgggggatgggggctgagtgaggggatgggggctcagtgagaggatgagacctcggtgaggggatgggggctcagtgggggatgagggctaagtggtagatgggggctgagtggggggatgggggctcagtgacagggtggggctcagtgagaggatgggggctcagtgaggtgatggggctcagtgagagggtgagggcttagtgaggggattgggtctcagtgaggggatgggggctcagtgggggatgggggctcagtggtagataggggctgagtggggggatgggggctcagtgagagggtgagggcctggcgaagggattggggctcagtgagggggtggggagtcagcgggggataggagctcagtgggggatggagggtcagtgggggatgggggctgagtggtagatgggggctgagtggggggatggaggctcagtgagaggatgggggctcagtgaggggatggggctcagtgaaagggtgagggcttagtgaggggattggggctcagtggtagatgggggctgagtggggggatgggggctcagtgagggggtggagacttagtgagagtcggggggctcagtgagggtgggggttccctggggggatggggttccgtgggaggatgggctcagcaacaggcttggctgcttaatgatgcctgggacctagtgggtgttggaggggggcttctccaaagtagagaacgcgagaaggacacacacaggggctcagagaagtgcaggggacccagctctttccaggctgttggccctaccagcagagaacctttccctcgattctttttccattaaacaaatagttgttaaagggacggaactgccataaagtccacgcctgttcctctctccactctgtgcccatctgtccttatcttcagtggggcaggccatgaccacccaggcacccagtgctgtcattagccttcgcctgggcagctggccctgggttgtggagttccccacaacccccagcatgagcctggaaggcagggtgggggtggggtagtagtaagggaggaactggagaggagcagggagcggctctgagttgagcaaggagctatcgggggtctgagcagtggacgaagctcccgctcccatgtgggtgggggagactcagccttggcacattccccctcgcagtctgtgggcatctttggagacttcaggaggacagcagttctgggagggctatggcagaggaaaggggctcccatgggggtaggttgaggtgagtgtgggctatggggtcccgcaaagccgggggagggcaggctgcagagcaaggtgccgaggctgcctaagaattgagggtccttggaagccccagtgcttgggggcatctcggcttatcaagattggtctatcccagctcagcctctgtcttgtccagggccactaagatgataggaccctcactgagaccaggtttccagtgtcacagtctccttatgtggagagttttacccaggcagcatgatcgttctgaaatcatacctgaccattaccgtccctgctcaaatccctcccagggcaccccctgccctcaggctcaagcccagctccatagggccctggcccctgtctagccttgctctcggctgtccagtcacaccaacctccttgtggccatacctttcagcaggcacacaatcttctcgcctccaagccttcacaattgcaattccctggacatcctttcctgtctgcctcgataacctctgcctgtcctttaggactcaactcaggtgtctccctctacaggaagccttctctgactccatcacaccctgcacctgagtgggctggggcctgctcttcctgcctttggcagagctctcatctcccgactgaagcgtgggtctgtacgttgatctctgcgtgttcttggcctcctcaagtgaggcatatgtctgacccctctgctcatctcagccctcagcactgaacctgacccagaaggacccagtgaaatgagagactttaagtagaatgctccccgaggtttttcatctagaacacttattcttgctctgccatggagaatggattgaagagacccagctaggaggctagaggcttggggagaggctgcttcagggttcagggaaaaggtgtctccatgtgagctgggcagtggcttgggcatagagagcagaggacagttgtgagagacaactgggaggtgactcactgatcggatgggggaggtgaggaaagaaggcaggtttttggacaagccgtgaaggacctggtggatggttgtgctgctttgttgtgaggtggagggagtggagataataattcagatggtatgggggtccctgggccacctcagggacgtggtggggaggctccaggtggcctttgggtatctggggtctggagctcatgagtgagggctggagagtcatgaggccgtgagcacagaggaggggttttgtgcaaaagagaagaaaggctgaggacagattccttcatcagggtcctgggaaagagaggccaagcagctccagtccaggggtgggaggggaaatagttgggagtcggcaggatgaggctgcagtgcgcactgaccagcaacgcaaggaccagtgccaccttgtggcctccggttaaccagattgtctgaggccaaggagctgggcagggtttggccaggggtcaccccctgcctccgtgaagcctcagccttcatcagtttaatcatcaggaaacgtggctcccgttgccctcctgccaccctacgtccctctccttcccggggtgactggcaatgtggacagccgggaactggagcccagcacttcaggaaccttaaaggtcctgggtgtaggggctggaaggtgggagacaccaccggttcctgtagatcctggattacttaaagtggccaggaaggaatgggtttggttcagaatgctgcgtgagcttgaacgagatgctcaacctctttggtcctcgatttgtctagagtctctgacctagtgatctcgtgacttgcaggccaccccctccttttcctcatgtgacctttgctgggcttcccttagtgaccctgtatgcacacagttccccaagtttctcttctgtccaggccaggcagttcctacaagcacaattaagtggaggcagcatgagggatgaagaacccaggacaattaatcatcaaggagtgacatttggtgcaaactcaggtgcttaattaagcgggatgagccagaggctggggggtagaggaggtgggttgtgtggtgggacagagagaaactcattcttcccataccaacctcccctgccttggttcccaccacccctctgccactgtcataccctgccactcacacctgccccctgttcaaagctcacacctccacaggtatttgggaaggttccagcatagtggttagacctagccctggtgccacctacctgggttcaaatcctggctctaccgcttattcactgtgtaaccctgggcaagtgaattagcctcttggtgccatagcttctccatctgaaaatgaagatatctaattcatagaattgctgggaattctgagttcatctatgtgagttgcttgggctgtgcacgggacataggaaatggccaataaactttagttatgatgattacctcctgtgcttagcactaaaagctgatcaacaattgttttctgaggatggtgacagggagggttcttctctctccaccctagttctccttgggaagatcagagaggtcaggtcatgtgcctaaggtcagattgtagcaggcagcctagctttgagcccctgcattcacttcctctgctctcccactgcctggaagatctgcactgggccccacccgagcctttaccagcaaggggcaccagaggccaaactgtggctgcctgtttctccacatagggtccagggtcccctacttttttacttgtgctgtcatcgtgtccaacctgaggcaggtcagcttgcccagatccttgcacatgtgcagggtccaaactgtcctgtgttcccaggccaggcctcgttcctccctgagtcgggggctctcaaggtggcatcatgtcctcttttcagggaggctatcatctcccagaagcggctgggctgcaatgggctgggcttctcagacctgccagggaagcccttggccaggctggtggctccactggctcctgatacccaaggtaagggctaggggctgggcaggggcaggggcagggagggactgtggcccctgcactccaggtcatgtgtgtcttctattcctcttcatctctgtctccttctttctcttgctctgtgtctctagcagtccctccatctaattctctctctattgtactactaaattctctgagcctcaacttcctgactataaaatgggacaatagtatttaccttgagggggtgtttcaaggaggtgcaagtgagatcatgcatgttaggggcctggcacaagcgagggctcagtggcccgtggctgtggttgtgatgtgcctgtgcctgatgctggatggggctgtagttgctctcacattctctctgtcactgtcattggccctatttctctttttcttctcctccatgcctcctgtccgccatgtccctctctgcctcgtgtctcagtctctctaggtctctgtcctctgtctcgatgtggaaagtgcacaagactgggagtcaggagacctgacttgctgtgtgatcttgggcaagtcacttcccctttctagacctcagtttcccaatctgtaaaatagaggtgctcagcctcacctgccttcctccctgcaaccctgggaggatcacaagaaggttgtgagtgaaggggtttccttccatgcagaggctgttgctgtggttgtttttgttgctgcctcaggacccgcctctgtgtttctgtgggttttggggtctctgtgtgtctctgtcctggcctctctttgtctgcatctttgtctcccccacctgggtcccggctcggtatctttgagcctcgccagccctgcaggagcacctcattgccctctccccctcagtgctggtcatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctcccacaccccagccttctgccccacctcgaataggtaggatgaagccattggcccagtcagcagctttctgaggggtgtgcaagcccctgctggactctcagcccccataaggttagaaggcccagcctttggcgtacgcagcactaaccttggtttctctttgggatcctccagatggggtggggataatgtccaggagggcatgaaccaagtgaggtgtgaagagagatgctgcggagggacagatggacataagggcctgaccaatagagatagtgtggaaaactagccagagatttggagtggctggagctgggggccttgaggagagaaaggccatggtcaggccagccagacccagggctgaggctgggcggaagacaggcagctaggggggctttctggagtggctgaggaaggagtgttagtgggaagtggtggatgctctgccagagccccagaacccagacaagcctccctctgcagcccctcgaggagttcccagggtttctgctccgtggaggggattgtggaagtgcagagcctgtggggacgggattctgccgctctttccgtttcttctcctgtatggaggtgggggttcaaactcgttctatcctagtaaccaaaggatgagttccccaaattgctattattgggggtctgcttctgtcgagggggctgccattccagtaaagggcaggcttgggggcatggacagataaatgagcaggtgttggttccccggggactcctctccagctcattaaaatggaattaaacgcttcccaggcgcctgacctttctgagctgctggcaggagagggcagtgggagtcagggatggctgagaggggaggagaggggggaggggaggaggggtacttggctgggtctcctctgcacccatcttcctgactgagggagccaaggccgctgcttggtttctccgcaagctgctccccccacccccggtttctggaacggagctgctgttgcacggagttctcagggggtcgcctccccctattctttgctcttggtctgccccagggctggtcagctttgaggggcactgaggtgaggggctgtgtgcagaggtggggattgggaggtggtggctgggtcacgcacctccttctctgctgagggcaaagggcctggggtgccaggtgcctgagaaggacttccttagattgaggctatgaggactgggtcaggagggaagtaaggggaagacatttggaaggttgcttcccttgtgggcggaatgcttgccatggccgctgctcaccttggctcaggctgggccagaggccaatgtgtgtgtgtgtgtgtgtgtgtgtgtgtctcagggacgctggtgggatcagatcacttacacttaactcacccagtagaactctggtctggtcctgcggcaggctgggtgctggagccgactctgccttcagggagctctcagtctgggggaaggcagggacaccctccccaccacaggccagatgaaatactgttgccagcaggtgttctggtggcaaagcctggagcagcaagtggtacctcatcacagagaaagcatttgtgtggggccttggggcacaggtaggaggtccacaggcagggaagaagggaaaggggattctaggcagaggaggaatgtgagcaaggcaggaaggaggccgggggaaggggtggtgtgctgaggggagagtgtggtcctggggaagctgaagtaggggtgcatgctgttgagcaggatgctagccagctgggctctggctgccaggagttttcaacaaccgtcccttcacctcctcaaataccctgggcagggaagaactcttgaaaggtgtttagattattcacatctgcctctcctctaagcctgcaccttcccactcatgtgtaaatgcacttccctaggatgccccctccccaaggcatacatgtctgacagatgcaccctggctcacaggatctcactgcctcccagaggtagcacaggcagccccagacttcccagctgctgccagatcctgagggcagagggtgcagaaggaagatggagagccacagggtcggttgatcttttgggaaggccgagtcaccagctccttcctggacaagccccattcccctctctcagtctctgctcttagtattcatccactgatccacctacccatccaccccctcatccatcagttgaacaactatttcttgagtacccactgtatgtcaggcatggagtgctaggtgctgggaacacagaagtgaccaagacagattagacaggccctgccttcacagaccatatggtctggagggttggtggtgagaagcactaaagtgagcataaccccagctacttgggagtattccttgagctcaggagtttgaatctggcctggagaatagagtgcgactccatctctaaagacaataaaaataacaaaaatactgcaaaacaagtgagcaaaataaggataggatcacacgtgatggcaagtgctagcaaggaaacccctcgagggagtcctgcaaaggaatgctggggtccagtggcgacgccatcagcgagggctctctgaggaatatgctggccaggtgcagggctgtgtggctgacttctgggcctttacagctcactgctcaaagcaccttgattgcaaattttttgtgtggaaagtctttggctctgttccttaatcctgggataataagtccctttgaggagtggcagcccttggtctctggcatttgatgcctgatttgtgcccactcttcccccagctgcaccagccacaccagctccctgcacggggatggggtgttcatgccattaaccattttgaacttggttagggtggggacctgggggctgtgctgggttttaaccctctcttacagccacagtgcccaatgttgagtgttcccactgggtcccagacacttgccctgattagcaagagcaggtgtaagtgtgtgttcctgttggcgaacaaaaagccatgagtgtgtgggggtgattgtgtgtgtttgtgtatgggggcgccaggtgcatgtgcatggcttttgggtaagtgaactatttcctgtgtacaggcatgaatgtgcctgtggggatgctgtggacactgtaagggtgggtgtgtggatgtctttgtgtctgtgactgcaccgtgtgtgtgtgtgtgtgtgtgtgtgtaccacctccatgggagattgagtgtaagtgcatgtgtgtgagggcctgacgttcttcatgagagtgtaggtgtgtgtgtttgtgcacatgctgggtgcaagtaggccaaggcagcccgagaactggttgcccccacagccttagaggggtcccagccttctctattcttgagagatgggaccaggtggaaggaacaagaaccacgtcctcctccatgtgctaacagtaaaatgccaacatatttatataagccatatgcaaatgaaccatagccccagcttctcctccctcccgcccccgctgtcctgtaggagtcacagattgagcctcatccagagcttaagtttaaacaccatccttgacagcccaggtctcttccaggtcttcctgcctccaatctccctccctcaaattcaccctacaccccacagacagtggccctcagatgctaaagtctgccatggctccccagtactctcaggctaaagtctaacttcttagcctggcactcaaggcccttccttctgtggtaccatggaccacacccctacctggatcctcatctccccgcaccacctaccgccagtgtcctggtctcttcaaggtctacttgtcctccccatgccaattcaggaagccttccaaatgtcctcccctctgagctacccacctagttttctctctccttcctcaggtatgaggctccacacctcctcccagtcatgtctccccactcgtcccaccccagacagactgtgagcttcccgagaacctgctggtctcctcctccccatctgctcctggcaggagacccagagctgaggcaggcattggctgctgactggggagggaggaggaaggaggagcccccagtgcaggcgctgtggggagctctgcaggtggtgagcagctttgagtaagctccggaagctagtgacgcaggtggggagccttgctggcagggcctgtagtgggtccctaggctgccaccctccctccccaccgtctctcattttcctcgacaagcacccaagtaggagtgggggaagggacttcacagagtatgaaagatgggctgagttccctggtgactggcacagggagcttggagagggacaggatgatgggggtggtggagagagtggatctagaggggggaaggtgtgggcagagaacgggagggagtgggtggtgctgtcttcactctgccactttctgctatgtgattttgggcaagtcactccacttttctggccatggcttgcctgccaggtggaggcttgcatcacagtggtgagaatcacatgtaaggcaaagcacttcacgaacccatttatccatttattcattcacccgtccatcctcaccatggcaggtgcatcatactgagcccattcctttatccaagacttaggggcagctcaaaccctaactcagacaggatagagccgggaggctgaggctaataccaccaattctaaaatcaggacctgcagcgctccataatctgtgagctaaaaaggggtctaaggtccctccatcccctgaaccatacacccggactgtgctcttgatgagacagtgattgaaaaggcagagacaaaaaagtttcacgtccttaggttagtcctaggagacttcctacaggagggattttcctggagctgtctgagtggtcagaaagatggggttatcactgaggcccacagactggagtgtgtatgtgttggtggggaccagtgtgtgctgcgcatggggagggcactctggcagagacagacactgagagaggtcacagctagttcccttctcccatccctccaggtgcactgtggccagctgagtgataatgaggaatggagcctgcaggcggtggagaagcatgtgagtgggagtggggccatgtgcaatgaggctgaagacccttatcacagctggtgggaagatggcctggccagggagctggacagacctgggtttcagcttcggctttgctgcttttgagctgtgtgaccttgagcaagtcactaaacctctctgggcctcagtttcacacctgaaaatggggataatgatagcaccgactgacctagggcagtggtgaaacaaaactggtcaaatatcttgtaaatacacacggttgccaacttacaattttcgactttttgatggatttatggggaagcaaccctatcctaagtccaggagcatctgtacttagaaagaaccctccacataatgatactgaggctctttcatgcctgagactttatgattttgtgactttaacaaggacttacgacttcctgagggggctggagacagaaatctgacatcttgtcttggaagaatctaggggctagggatggagatagaccctgtaccctcctgttcctggaccgccggacgctccaggggctgtgggagcccccgggggagccctcaggaaggtagagtccagggatgaggtgtttgggacggcggcggggtccctgggcccggcaggcagagggaacggcgggagcaaaggcaggaatcccgctgcagcaagcgcagcgagcttggggcgagcggcgcgctaaccgctcggcctgccccagaccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggtgagggcccggcctggacaggtcacgagggcggggccgggcagaacttggaggggaggtgggcgggttaggcgatcccgggagccggcggcgggcccggcgcggagctgagcggcgcctgagggacccggacacggaggtgcggaggggccctctctctgaccggcgcctggcccttgcaggggaactctacgacctggatgcctcttccctgcagctcaaagtgctccaatacgtgagtccctgcgcccctgccggccacctccccgtcctgtctccctccggggaccaacttccccttgagccctccatctcagttccaattacgatgtccttccttcctctctcctccacccgcctgaagagccccggagaggggagcaggtggggagtggggtgacccggatccgcggtcaccccctcgccctgcctgtccctctctcagctgcagcaggagacccgggcatcccgctgctgcctcctgctggtgtcggaggacaatctccagctttcttgcaaggtgagggcccaggtccactgtagagcgggggcggggctgggcgaggaactcgggtctccgagggggaaatccattgcctttcctttaaccagccccctgcactccgttcctcaggtcatcggagacaaagtgctcggggaagaggtcagctttcccgtgagtcccgcgtctgtcttctcgttggagtctgcaggggcggttgaggccgggtagacactcctgggatctgcctggagtatttggatcttctagactcttggaatccgatggaattatctggatcttgggactacttagaaatgctgcagggatcacaacctgtgatcagcaggctctattaggaagaatctcttagcatctacagaaaggcttacctgggacctgttcacttctgttggagtatttctggatatggatctgctagaatctgttgacgagaatccttggagtctgcttatctctctcgtagttagggaagactctagagtcctttatagcgaattctgccagactcccctccatctctgctcatcaatgctgaccctgtccaccatttggactgactgaagggttctttgaaacttccagatttgagggtggggacaggttgagatcccctgacctggggagtactgggccctgactcagtctctcctcaccccctagttgacaggatgcctgggccaggtggtggaagacaagaagtccatccagctgaaggacctcacctccgtaagtcatggcctggctgacccagaggggaaagaggagaccccactgccagcccctagagccagggtctctgttacagagcagcctaggaatggggcagataagacctggggactttctactgtcccatctccatgacacagagcttccagccttgcatgagtcccttagaactgcctgttgcaaaatgtgatggagggctggaggagggaagcatactgcgccctgcttccctgccctgacttgcctcgcctttgcaggaggatgtacaacagctgcagagcatgttgggctgtgagctgcaggccatgctctgtgtccctgtcatcagccgggccactgaccaggtggtggccttggcctgcgccttcaacaagctagaaggagacttgtgagtctttgtgggatgatgcagatcaggagatgtcactgagaggctggctagggctccacgagggtaacaatgtgggatgggtactgggcaggggctactgtctcagcagcagtgggttgaacagtgtgttagtgcaagagaatgaaagtcatgttgaggtccaagctagttcctcttctcttctcctgcttcctgaagtttgggtaatctgctcttggggtattgggttccctcccttgccatccctgtttttgcattactgctataaactgctagatggaggggtgggtgtgctctgggttggatgaaccctctgggacccacaaagcatcatcaacacagtggacagtggctaaagggaatatgcttggggactgggaaaagctgtggatcttttgagcccctgacagggcagctataaaaatgatacacaaaaatctctttttttgtgggcagggcacagtggacaggaaagcaggcttggaggcttagttggaaaggatatctcgagaactgaggacaaacctggggtctagaaatggtgtcataaataaatttcatatcctacaccaactcataaacaggcagtaggtgcctgaattttattgcaaatggatcttagttcagggagaaacagtgctgcgtctgatgagccatttctgtcctgggtgcaggttcacacttgggctggcaggatgagcagtttgtgctgtgtcacataggtggggagaagtagacagatgaggggctgagtcctgatgcaaagagatgctgataggatgctggtctctggagtccaagcaaacaggctgggtttcagggcctggagctcctgcaggaggtggacactagagagcctgggactaggtaggtgtcagagcccgggcctgaggtctgctggggtagggtggagatccaggagtcctaggtctgagctgcagaacctaccagcatggaactgtgttgacagttgggtgggcctggagaaacaaagataggggcaaggcagaatcagctgaggcagggagaatgtgggattggtggcatttggaacttgtgggcatcctaatggtgggagaatttatgccattcagcaaacaaatattgagcacttaatgttgccatcccagtgctgaccagatggccttgggaaggcctttggggaagggaaggtagagtgaatgggggtccagcaggggccatgacttcttgctgctggctgtgagattgggttctaggatggccccagagctggagaagaggtggtatcagcaggaaataaggatggggccttggtggcagctttgaggcccagggcaggggcagggctatctctgggtcccacgcatttcagggagtgagtgttgaatgactgcatgagccagggtggggctcagctcagtgcagtgactacagagaagcttcctgaaacacagctaagtagccagagaacaggggctccagaagcccttcagctgtgagtgggatggggctggtggcaaggccagggataggatacactgacgacattagcaaagacctccgaagtgtttcctctgtaccaggctctgcactgggcatgggtgatatagtcatggccccatttcataagactcaaagctcattttcagggcatagagggaagagagtgagaagggtattctaggccgagggaacagtgtagaaaaaaaagcatgaaggtgtgaaagagcccaaggttttctcagaatgatgaggatctttgtgtggctgaagctgagagatgttctgggttgaggggtgacaggtgggtggggctagctgagggaccacaaatgtaagaaaggtgtgcagacagacccaggatggtggggatgggatctagatccgaatcactggatggcaagcatgaatgggggatgccccaccagggtggagcaccaaggccagccaaaaagtggggaagggcttaggcagggacacctcagggcagcgtgatgtgggctaaggcaggctcttcccatgacccacaccattggtccacccagccccatgcagctccccagtgacaaatcatttggtggccagattgaatgacgtgagcaggatttggggcttatcttgtctcaccagagctagctccatgagcagggcaagcagtcctctccacaccaccaccctaagatttctggaggcaccgaatcagggccagcggagtccagggagagtggggtagtgacaggagctgcacaagatagggcagtgccaccgcccctccccaaggctggaggtgtgcctggggaagagcagaacaccagcttgagcccaggcaatctctagtctgagggaggagacccagctttgggctgggtaaatcccaaatcagagacgggaggtatggctctggtttcaagcatctaaggaggactggagccctccccttgggcagcccccagtctgcagggtcatgggggtgggaagctgttccaagggcctgtgcagtggttatatagttggcaggtgggtacccctgtgggcttctgatggaacagaagtaaggagagtggggagagaagccagtcttcccttccctcctgagtgagcccaccccctcctccaggttcaccgacgaggacgagcatgtgatccagcactgcttccactacaccagcaccgtgctcaccagcaccctggccttccagaaggaacagaaactcaagtgtgagtgccaggtgagtgacctgccttcagcctctctcgggcaccgactcgctcagttttcagccccgagagccattcagaagggaaatgcccatgtctttctggactggtggcagcccttccccaggtggctccataacctcataacttgaaggcttgcagttgttcaggacccgcgccactgcccgcaggcactgtatgtgatcgccctctagtgttcaatatgtgcactacagcaacacctaggcagctagagctggcgtgaaggcggctgagacactcaggagactcctcacctgcaccggggctattccctcactccttcacttagtagccaaatgatataattagacactgacagtttctggcttgtccagtgagccctagggaaggaaggagaagacccgggtgctgttggaggcagaaggttggatagggtgacccctacaccccgacccccctatgatctccatttccttcattccaggctcttctccaagtggcaaagaacctcttcacccacctgggtgagtgcactgttctctctgcctggctgtgtgtgggcatgggggctggcatttgcagaggagaggcgggaggtcttggcagcctggtctcaccctgcctggtcttctcccttccccagatgacgtctctgtcctgctccaggagatcatcacggaggccagaaacctcagcaacgcagagatgtgagtgactctacccaggggacagggcgagagaggctgtggccttcagtccccatcatctcctttcctgccccacccacttccctttctctgccttctgcgggacttcatcaccttttgagggatcctttatttcatgcctgtctccctcgctagactgtaggctccaatacagcagggacagggctggctttggatcctcagctcctatcacagtgcctggcacatagtaggtgcttccaaaaaaaaaaaaaacaaaacacttgaatggacacgtttctggagccagccagccctgagcagagtgtcttaccttggagcactcctcccaggcctcggaaatccggcctttgcctccttatgggacgtgagggcgatcagagggggttgtcaggccccagaggaccaaacccctccctccacagctgctctgtgttcctgctggatcagaatgagctggtggccaaggtgttcgacgggggcgtggtggatgatgaggtgagagggcgtggagggagtatgtggccctaggggtgtccgggagtccgccggcggcgctggggagcggcccgaggtttaacagtcccctctgtggccgggtcactaacttcttcctctcgactccatctctgctccggcagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccagggtgcgcgtggcggcccgggcggaggggcggggcctgcgccgggcggggcgggtccgagcgagcgggggtggcaacacttccccaccgcctccggcgtcccggagcataagggagtcgggttccatgcctgggacgtacgtaacctgcggaaactgcgagggcaggtcccggccggatccctccctccaaccgatccctccctccaccggtggttccttgcccctctcccttccccagaggtcatcggtgtggccgagctggtgaacaagatcaatgggccatggttcagcaagttcgacgaggacctggcgacggccttctccatctactgcggcatcagcatcgcccatgtgagggcggggttgggagtggggtgtggggtgatagggggcggggcccacgaaggaccctcggttctcctcctccgactgactctccttgtggattgatcccttggtctggcactcagagtcccgccgctggggtgcagccttcaggacacgctggccacctctgggctcagtttcccatctaaaaattgggcatacgatttcctgccctgtccactcagcctcctgggaccatgagaaactcccgttgtcaaaacctcctctcttccctggaagcagtctcaacccaagccgagtgcttttttggaagtgctgggtctcggtgtccaggcctactggcgctctggcctgggaatccagccccaaggtccctgacatgatcccctccttgcttctccttccctgccatgggccttgggctccatcactgaagcctggatcaggtgtgggggagtgcaaagggccagaccaaatgctgggagaacttgatgaggaggaaccggcgcgggggtctggatgaaagtgggggtgaggtctttactgtggactggagcttgaaggttttgactggggccagaatgggacaggaagtggggtgtctttttgaccccttcatcccagtcctgggcattgctaaattttcacagccaccttccttgagccccatctttccctctttcccctagtctctcctatacaaaaaagtgaatgaggctcagtatcgcagccacctggccaatgagatgatgatgtaccacatgaaggtgaggcttgcagagacctctggtcctcctcccagattccccggggacccagggccaggcagggcttcctgatcaatctctactgaggatgagaggataggcccagagccacagcaggcctcctgccctccttaggggcagctcccacccctgcttagagacctctcctccaagctgcttctgagctcagtcccaaggctggaagtagccagaggaaccagcccagggagtaattggttcagccaggtattccccatgttcagggaataattcccatcttgggaattactgagggctaggaagctcacccaggacccgtccccatggcttccctaggtacaatgcccatgcagccctgggcagtcttaattgctgataatctatcccattccctaccctgggtcacaaaagctggcttagttccatgtatatggtagtcgctgttcatttggacatttcctctcacctgtgtccaaaccagagaggcccagaccttgtgagttggatcaaaactgtagtaggaagagttaaggttagagagtagaaaggtctccacaaaaggaggactgctacagttactgtgtatgaaatgctgccatggtttgggggtgtcatgaaggggtgttgtcgatctttgccaaggttatgctgttacagataaagggtggtcacctgcaggaaggcgcgcggggtgggctgcagggctgtgaggggagggtggtgatttcctgcccagttacagtccacagcgtggtggcccaactgtggtacattctgggtgacggatcccccacctgccatgggaatttgagggtgaagacaccagatggggtgaaggctgtcttctaatgctctggctggtctcctctaggtctccgacgatgagtataccaaacttctccatgatgggatccagcctgtggctgccattgactccaattttgcaagtttcacctatacccctcgttccctgcccgaggatgacacgtccatggtgagttgctctcctccacttgactggccaggccgaaggtatgtagccagaggcttaagttaaatgcgcatcaagaacttcctgggaagacagagtcatcaaggaaggctgtggagggtccctcagagatggaggggcttgtagtctgccatcaggaagccatggggcctgcccaggggctagaggctggactggatgatcccaagggctgctcttggaccaaccatgcccagggcatgtgacctcagggtttgcatccctcccaaccctgtttttctaacattttgtgtgggcttggtttcaagagttcttagttcttagatctctaaaaatgcatagctccgagaacggttgcttcaactattttgtggttctctagtttagatgtaagtttctaagactccagatcttgagtgtggagcttgaagaaggacccaggcaagggccctgtcttgatactggcagcccctctgatacctccctctgccctctccaggccatcctgagcatgctgcaggacatgaatttcatcaacaactacaaaattgactgcccgaccctggcccggttcgtgcgcccacagacagccccagtcttcgcctccctctttcctctactgtcacatccattgcccccggcattctggagaggatctctctaaggatgactggggagacccagtcttatgggggtggggaggatccatgaatgagaagcaattcctagacactgaactgtcaataaaggcaagaaatgaggcaaggcaaagcctggaggcaaggccgagagtgtgtagccagaggtttaagttagatgtgcataggaacttcctgctaagacagagtcatcaaggaaggctgtggagggtccctcagggatggaggggacatgtagtttgccatcatggggccgtgatggaggaggagaggctgaggcccctcttctgccctcttccctcccccaggttctgtttgatggtgaagaagggctaccgggatcccccctaccacaactggatgcacgccttttctgtctcccacttctgctacctgctctacaagaacctggagctcaccaactacctcgagtgagtggctgcatctcccccacatctggcagccactggggtccccttccctgggacagggaagcaccccctgtgtgtcaggcactttacacgcactgcctcatgggatcttcttagccccaggggactagaggggaaggctgtgagccccatcttccaggaggggcttgctcacagccaagcagctagtgaagactgagcctgatttaaacccgggtctgctggactccaaaccagtgcttctttccaggaagggaacccaggtgttccaacctcctgtcccagtggctcctgggcatgtcatctcctgtctgtcctcttggggatttagggagggaactgtgggctgacctcttttttttctcctttctgcctctcaaccagggacatcgagatctttgccttgtttatttcctgcatgtgtcatgacctggaccacagaggcacaaacaactctttccaggtggcctcggtgagaccctgccctgctcacagtggggaccctccatggggtgtcttggagtctcatcctctcccagcctgaagatgggtgggagcgagtgagaccaggagccaggtttagacacaggaggaggttcccccagggtttgcccctggctctgagatagggaggaggggagaaaggtggaagggcaggacactgctcagcctaaagcagtggcacttggatccggatgtgaggagtgaccacagttttcctgggcttttccagaaatctgtgctggctgcgctctacagctctgagggctccgtcatggaggtatcactcttctgtcccaccccgtccttcttcccctttaaggccagtgacttgcaaagttatgacccagctcctcctattcccaaaccatgctctccagacaggctgcgagagctgcagccacacctaggacatgtctggctcattttcctggagtgggcttggaagggtgcaggtgcggatgatagcaaggatttgtgttcagcgtgtttccctttggctgcctgggaacaccccattcagccccctcctgccaaacttgggatgggctccactcccatcacttagcgtcaccttagattgtttggtttgggtctgcctacctcctcgtgcacaaggtctgagccatttctgagttccctgcacttggcacagggcttggcacagagtaggagacacatttccaaggtcaccttgcctcatgctacttcccacaacacctctccagaggctgcccctgcttgcacacccccagagacgaggttctctgtctctctcccaggaggcctggtggcagtgctggttctgccctctgcccccctgagataagctgctccttttctgagtgacagcccttcagcatccggaaatgggggccttgcccttgcctcatcactgcctctccttgtcagcaaacaaatgtgttctgcatgatttggtgtctaggactccaaaggatcatttcaaaaatgttccagctttcagggaccccagagcttaccttgttgggtccctgcatgtgacagctgaggagtctgaggctcagagtggtctagggactcaccctgggtcacacagagggttgaaacagagctcagaaagggaactggggcccctgactccccctttctgactgctctgctgacctgggggctggagctggacgaggcccctgcttcctctcttggggtcaatggtaagggagcccatctgccccagctgggcccccatcactcctctccccccagaggcaccactttgctcaggccatcgccatcctcaacacccacggctgcaacatctttgatcatttctcccggaaggtgatggggttgggggtggggtggggattgagggggagctgggagctggctggaggtgggataaggagccaaggagtggaggctcactgggatgggcaaatgggtgggggtgtccagtaggagggcatgacacccctgccctcgcctcaggactatcagcgcatgctggatctgatgcgggacatcatcttggccacagacctggcccaccatctccgcatcttcaaggacctccagaagatggctgagggtgactgctgttagccccagtccttggggctggggaggaacaaccaggggaaggatttgccaggggagcattcccagggtgcagacccatcccctgcaacatcaacccttctctggctgcacggccccccccaggcagacccagcactggccccttggctcccatcaagggtgcccaattccctggaccgctctgggttgggccctgggagccttgtcctcagaagggcaaagaggctgggccccgctccttgaccccatcctcccctcaacagtgggctacgaccgaaacaacaagcagcaccacagacttctcctctgcctcctcatgacctcctgtgacctctctgaccagaccaagggctggaagactacgagaaagatcgcggtaggtgtagtcctccctgggaaggcacaggctgcccaccctgcccagctttgggtgccccctgtgcctgaataccctctctctgctcagctcagcctggctgtgttctggggagacagaaacctagaccatctcagggtgacaaatggagactcagagaggggaacagacctagcaagtcagtggctggtggaaggtgggccccaacccagccactccctgcctcaggccatcccactgccaagctggggctggtggggacggctcctgagctgggactgaatccctgggcctcagttttctctcctgggaacgggctgtcagaggagcttgggtggatgtatcctacatagaggatgtgatgagagtgttggcctttcaggagctgatctacaaagaattcttctcccagggagacctggtatgtgtggagtgaccccaggatgtccaggatgggggagggttcctggcctgggacagggagggcttgaactagcctgaccctggtacccgatggaggaatgagagggacaggcctgacgactcgatgcctgcaggagaaggccatgggcaacaggccgatggagatgatggaccgggagaaggcctatatccctgagctgcaaatcagcttcatggagcacattgcaatgcccatctacaagtgagtgagctcatggggacaagctgcaccctgcacagagagggtaggctggagtggggacatcacaggaaacacaggtgctgagattggcctggcccagctccaactgattcatccccttgcctctgggcataactgtctcccgctgtgcccctcagtgggtccttcacttcatccttggtcctcagtggaaagagaccatcatgctttcctaggtgtcctcctctgtctcacattcttgtggaagttcttgttttttttgagatggagtctcactctgttgcccaggctggagtgcaatggcacgatcttggctcactgcaacctccccctcctgggttcaagcgattctcctgcctcagcctcccaagtagctgggattacaggcatgcaccaccacgcccagctaattttgtatttttagtagagatggggcttcaccattttggtcaggctggtcttgaactcctgacttcaggtgatccacacacctcggcatctctgagtgttgggattacaggcgtgagctaccgtacctggcccttgtggaaattctatttgttgtgtagccctagtctttcttgctgcccatggtctgatttctggcctctcaccctctgcccccatgcacccgcaggctgttgcaggacctgttccccaaagcggcagagctgtatgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttctctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctaccagtcctcccccatggggctgtttgcagactttgtgcttggggtgggtggagggggggaatagaactgggagaggcaaacgccctttggaactccatggcttccagggtcctccacccttggtgcctagccccccttctggggaagtcatagacctgttggggtactccctaggccagatcgtggaggctaaggggtgggtggcagatgagaaggcctggccatggagcagtgatgggacatgttggctggcagagattgtagaatagaggaaaaacaaaggttgaggcaagcaggcaggctgcctggaggaggtagcctggagcttgtcctagaccctcccagcgctggcctgccctggtcatgagtgcccatacggcgagggcctaggcctctgaactctgtttctagctgcagtgatgcctggctgtgtcccaggaagtcccacatcccagttactctgagtcctgccgaaggtgcacgcctgagtcagactccacaccagatccagccccgggttgtgtctgaggagttgcgtctgttcctctgcatgagagtgtttacttccgcccagtccaagatgggcagactgcaggttggggctacgcggaggctctgcctggcacagtctccagaccctgtccccgacttgcctacccccctctgagctcctctccgtgttcatctcttcctggtcagtaaaggttgatgtgttaagagggtgggcactggggtctcctttcttggtgggagcaggaaggagatggacagggccatcctgtgaccatcagccattgccagctttgcctttgggaccacagagcccatctgcttcctctgcagctccccctgccccactagcctgtctgggtttggaatctgctcctctggctgaatggtctccaggtttccagcttcccttagcgtcatggggctccaggctcctcccattcccagctcctgctgtgggctccccaagtccgtctctatcctctcacagcacaggacccaggcttggccagtgggtccccgggtgggggtgggagtggtcagtttgtggcccacggccaataagagatggctattctaatggtgcctggctgaccccagggtcactgtgggctgatgtagctgctcttctgcctgacccctgaccctgagtgtgtgtgcgtgttcctcttccacaactcttcaggcaaagagaaccttgaccctgcatctgtctgtccccagcccagccctcctttgaggctcatgctgtgacacatccctgtttttcaccaaatggagggaacaaccacagatatttccttgtgcacgcaggaccctgtgctagggctgagggctttgtctttgtcctgctctggaaagtctcacagtttgattggagagctagatctaaactcagatgcaggccatgacaacgctgtggggtgcccggccatggggctccaggcaggatcataaccctgagaacaacaatgaggtttgaaagatgagcagatgttgtttataggcaaaaggggacaggcactcctggtagaagaaactgcttttgcaaaggcctcgagaacagaagggactggcaggtggaggagccgagagatggaggaggaggcaaggccagatcctgaagggccttaaatgccaggttgtggagtttggctttattctgtgggcagtggagaaccagagaaaggttttcagtaggagagtgactcagaagtgcattttagaaagatccccctggagagcagggaagtgactgcaaggggagagggtgggcagggattattctatgggtgatgtgctgtgccctgggctgggcgaggagaggaattcaggagatgctaggttggcagaacatggtgaccagtgggtcgggggatgcagagggaggacttggaggggccctgggaggtggggtctatgccactccatgaagagctgtgggggctctgttcagcatcaccctcacccacaacaggtattgggtggagcct

SEQ ID NO: 13794 - DNA, 11890 bp, Human
ctcaactgatagtaacattgtctataaagtattttaagctgattgagtgaactacattgtctcagctccatcctgttcaccctcttcccagtgagtgaagatgttcatggttttattcttacatttacttgttaggtgacttttagcaaatgaatgagactttctgactctccatttatactcctgaaaatagagtagtaaaacataccataggaattttaatgtatgaaatttaaaggaagaaatgtgaaaactctgagtataaatcatggaatatattagctccactataaatgttaatttcatttctttctattggaccctgaaaatatgctctgaaacgcacaaaattattcaattattggtttcacagaactgattttattaaaaagtatatgttgacaagactttacaatgagctaaatccaatataatgcatttgaggtctgttataaataccacaacacatgtattgctttataaagaaaaatcttaaggaatggataggtggagtttttctaacaagagctcagattatagaatttgatacactcaaaattaatacatagcattgttttaagaatcctcttataacaagatcacttaattatattcgattgatttgtctttttttcttaattccttataaatttattcagttactttgttgaaactgaggcctatcaataattttcttaaaataatattaggaaaaatgttatgtttatgaatcatcttacaattccattagttactttcaagaagattactttttgtttttgaacactgctattacaaaaataagccatttattctaatagtctttttttcggacaaatgcagtattagtcatggagttaattttccacaagtctcactgctaaaatgtgatatagttatttttaaagacaaaaatacaatgtgacaacttatattaaaatatattgttgtaaaagttcttataaacatgaggaaatgaacattttagaaaaaaatctcataaatatatctgataaaatcacaaaatgaaatagacaaggatttaagtacatctctcatttgctgaaaccatgcatcaggagctgataatgaaagatatatccagccaggcctttgggagattataactttgaataacttttaactttgaaaaaaaattactagcatgcaatgaaagattcttgccttgtgatacttttagtataaatttatttttttctctgttcttttatgttttttggcattaagctatagaatgctctccccaagtaaggttttgggtgaattcctaaacgaaatccacaaaataaaaaacaggcaagactttgctgattggttccagacctgaataacataaaatgagtctccttagcattagaagtaaacttgaaatgttgatatttatcatgtgtatccaagtgtatatgaagcatattttatatttttaaaactaatgtaagctaccctcatggccaaaaaattaagttagtccaagtaaatcaatattgatttcaaaagtgataggcaaagggattcaattcctctgagtctgttcatttgcgttttcctgaaattatttgccctgcttatgatttctgagatctttagataaacatgatagttggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggtaagtgctgttttaactattgcactggggatgttaactgtttgggacagcgttttttgtaacaggaacaggaaaaattccagagcaattttgccaattgctattcaacagcaaatccacagttctgagcatttagtttcacattttgttaatatgttttccatgatttatagatttgagattttatacagtatatgctgtattgcttggcaagagaagttataaaaagtttcaaggttagaatgagaaaatagttaaagtagacacagtgaaaaaatatagaaattaatatgtttgttatgtatgctagttagttatatatgttagtactggaccctaatactggagcaaagaaaagtcattttaatcagcattcaaaatatcttttaataagcatattgtgacaatttgttataatttacaataaacgttctatgttataaaacatgagctaaaagatttaggaactcttatggattatttatttctgttttgttaatttaaaaaatttgtttcttggatatatgccttaaggaacgagttttttaaaaagttctgggaaatgatttcgtttttgaaaacagcattttctctatagccacaggtatttgaaaaaactgagggtagtacagtgtgattttgcctcatagtggagtcattatatggttgcaaactctcattcaattcagcatccttgtttttactttgccaaaaaatatggaagcatttttcattactatttaatactcacattatagttgccatattttggtgtatagtaaatttaaaatagcttattaataaagcaagacaaatctttacagtatttacattctataacttaaaataactctgggaatatgtcatcacgttctttttagtgctatgcaattattattatggccaagttctgtcagcaaaattaaatgcccccattaaaatcttagagagtaatttactgagaatctggctacatgttaccttatgtcagcaatcaaagtatttctaaaagctgttttataacgttccatctgatctgaaataaagtgccttacaatttcaaattaaaacaaataaaagacgttttcagtttctaaccccaaagatcctgcttatcccaaactactttgatccaaaagcttgtaatcatactttcatagaaagatataatattctcagttatctattagaatgtagatctttcgtcacattaatgatttatctcccagggctaccaactttgcctcagccacaactgttcactctataaaagtctaactcttatattccaattttcccatatctaaattgctgcacctaagacattgaaatgtacttttttgagcctcaccttagaaacatgttcctatgagaagataactgttacacattatttcaaattcatattctcaattgaataatttactagatagttctaacaccagtattaaatccaaactttaaaaacatcacacctctctcccacctccattctgtgaggccactaaaagccagatatgcaaaccatggcatcttcgattttggcatgaagaaagtagagaacttgtgagtaattgagagagactataactctaattgaaaacttggaaaatactatctttctctacctgttgaatctctttccagaaagagaaaccttcagaatgtgtgacattttcctgataaacattagcaattattaaatattactaatattttgtttagtaaatagctaatttatgaaatattagtttcagaacacagttttgcaatgtgctttaaaaagtgtagaatgttaagcacaacatgaactagtatgcatgcacaccagcaccaagaattctgttctccttcctcagaaccaacagtaaccagacacttttaaaggaatgtgccttccatttccctcccacatacaagcaaaacctcaggttgcccatattcccgtaaggatcttcttcatgagtcattttaatgatgtcgaatggtagggtagagtatacagttaaaaactgtcttctcattctctttttttgagagatgatctgaagcagtagtctaattcggtggtcaatgaacaccacccagaaacctcttacaggaaggcatttcattaaggaagagcctgaagagattgactggaacaattaggctgggctcgcccagaagggggcgcacgtgtacgcaatctaacctgaaagctgctcactacatagttgtaaacatacacctttgtcctcatacctaaataaaaatttaaaagacgctgttagatgcactaaaaatagctataaaataacaaaatgcacattttctaatgaatttaatgttgcaaattgaatgtctttttcttgaaagtatatatttttttaattaataaatgtttcatctttatttaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagagtaagtaaaaagctgttcctgtgtttgatgtgtgctcaagtgtttaaatacctgggctgcacaacacagatattgcatctggctccattaaaaaaacaaaatgtcgcccgggcgctgtggctcattcctgtaaatccagcattttgggaggccgaagtgggcggatcaccaggtcaggagttgagaccagcctggccaacatgatgaaaccccatctctactaaaaatacaaaaattagccaggcgtggtgtcgcacttctgtaatcccagctactcaggaggctgagccaggagaattgcttgaacctgggagatagaggttgcagtgagccgagatcgtgccactgtactcaagcctgggcaagacagccagattctgtcttggaaaaaaaaaaaatgtccacaaaatatccctctacttcaaacaaagaataattctagctcaatcatatatccaatatccagcctttctttggtgtatccagataaggaacaattaaggtcacagaatttaatatgtaagtcttcaaactaaaaattccgggccaactcatcctgctgtgttacctcctcatatatatctcttattattttctcctttatggcttagatttgtgtcctacatttattttttgacaagatctagatgagggaggaagaaatgagttcaaaagtggcacagttggcaaactccacagccacaaagaagcccatattgtccctccctccctccctctctctctctttttctttcttccttcctttctttccctttctttctttctttctttctttctttctttctttctttctttctttctctttctttctttctttctttctttcctttctttctttcttctttctctctttctttctttctttctttctttttctttccttctttctttctttcgttttctttctttctttctttctttttttttttgacagggtctcactctgtcgcccagactggagtgaggtggtgcaatctcggctcattgcaacctccaccccccaggctcaggcgattctcccacctcaggccaccaccaccaccaggctaatttttatgtttttagtagagatggggtttcaccatgttaaccaggctgttcttaaaatcctgacctcaactgatccatctgccttggcctcccaaagtactgggattacaggcgtgagccactgtgcctggccccatatagtctcatggtcttccctgacatcaactacttgggactcaccatgttactctgctgtcatgatcatcatctgcctctgttatctctgttatggtgtgtggccatcacagtgctctggaggactgtgaagaagattaaagagaaaaagaaatatgatgggagattctaacatctttttttttttttttttttttagaagaaaaatagtgttacagagctttttttttcttgggtacaatcctgcccctcatttgatatttccacactttctctttctcctctctttatttttcatttatcttctggatgaagtttgatctgatgcatttggactgcttatgcacttatgtggtcttcagggacattcttcaacttaagcagtatagattccaatgggaaattgaaatccaccatttcctaccaggataactctgccattaatctttggcagagcttggtagaagagaaaaaccatgattcacagataaggctttctaaatgaaaaaatcaagcaggaaacattgattcacatataaagtaataatgtctgcaaaataatctattgaatttgaacatctctacatgatgaaaattggttttctggccatgctgaataaaggtattgctgtcagaaaatattacaatatattttatgcatatgatgtttgttaattctgccagtttcatataacctctagtagggttaaacgttttcataaagaagaccatactcgccaactctgaagctccacatgttctttgttgtttctgaaaagcagccaaggtaagggttggtgctgtttgactgtcacacaatacacagtcaggctaacacagctaaacccctcttgttgtttccagtggaaaattcactatgtggccatatgtgattcctcattttaaacatatgtggttaggaggaaggatactctctgacagaccaaaatgctaaaggaatttacgatgcttaagggatgacggagtacattagatttggtgggtagagattattcgtaagagcagggctacttctttctctgaaacaaagaaggatacagaagtaggcacatttgaaggtatacattgcatgagtaaaggatggaagagaggtctatgggagaaaggccaatggcctgtcagtgccaagctgagatagaaaccacagtgcccagtacatagtggtcatttgaaaaggtaacataatagtttcctttctttcttccttatctttgtacatttagtcaggtattctccttgtctttttatgtatcacctcagtttaggttattttgccagataataatcaactatatcaacatttcacattcacttaatacagaaagttcccctcaatgtttttttctaatattagggaatatatagccaaaacaaactgttttctatttcaaacttgcaactctaagcattagcccaatcagagatcttcctagtgtagagtaatttagaaagacagcaaaatcaaaaggatattagtcattatttaggacatactatgtactagtattgtgtgaagtgctctacacaacttaatttaatcttcatgcaacacggtaagatagatgtgttatttctaacaagatcagataagtgttccagtgttgcccagctgggtaagtggcagaggtagaattccaagatgggactatgcccatcttctttccatttttcctcactttctcaaatgttggtaccatagaaaaatccctggaattaactgatgagttattttaaaaagcatgtgtgtttggggttccactgaagtctttgttaactagagtttgaaaatgaaaacaagataaaggacttgaaaatgttaatctaaaatagacataggcaaacatagtttctgtgtatacacaggtcagtcaattcagtaacactcttggtttctattacaaagtaagtcagtgtttcatttgtggcagctttttgaccatggacaaaaataaacaaataaacaaaaacatgagttcagatggtggacatgccatgattaggtttttgccttagaattttgatcattgctatggtgtgtgattgctggaatgatttggtttttgtcttggaatttttatcatggtcatggtatgtggttgctagaaaattctttatagatcatctagttaacccttcttatttttagatgtaaaaccaaagagtacttatactgagattgttcatacaacaatgggatccatttatatttcttcaggttatactatttcaaaaaagttgttagataatatgacacacttattgaatgcctttttaaaaacaacttctagtaataaaataagttctgttatttaaaatattccactgaatatcttgatctaccatgattactctttactaaatgttactgtgccattttggtagcctgaaatatgcctttaatggttgcaaattcaaacatatactatattatgacttttctaaatgggaagaggtcctattttataatatattaaacataaattttttgtattgttttgagccagtgtactgaaaaatgattaatgttttctattctttaatttttagagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcactgtgtttgacttcttgtgaaatttctgtactttgtatataaaatacataaaacaatagattagaaatcaaaagatatctctggcctgcaatattttactgatgtgaacataggattttccactaaataatttgtctacttctagcattcacttacaaagagttcttaaaaacacctataataggtacttagatttcacaacttacttagatatttgtcattattcccattcctggtgtttttactggttcatatacaatggtattctattagataagaagctgctatgtgatctcagcactcactccttggttgtcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatacaattctatacaatgataaatactctgcatataatttataaaaataacttctgttttacctagttaacaataaaacctatgtgtggagccaaatgttatgcagacaaaggtctgctcatcccataccagtgtatatatagtcaaatatgtgtctagtacaaataaaatgtatctctaaggcataaaatgttttaacacaccacttttagtgaactctatcttatggtacagcggcctttcatcaaaggatcatcattgagactgagttgactggcagatatgtgcgatggatattacattaggtacaatgtgtatttttgattttcatgagttttctacattaaggtaaattccttagagtgtgatagcagcctcagtttatttgttggtttaaacttgaaatctactttttctcgataaaactataatgtagatgaattgaaaatgaattttcttttccctgtctacaaaagtcactatcaagccttggaaacctattctcaaatagagggtagataatgtgccataaattctcttttagaaagaatgtgatggaattaaatgagctttgtctctatactacttagaggaaacatcttctcagcagacagtctgtctgcatctttaaaagcctttgatttctctctatccaaagtcctatgttattctcatgcctaagaagcaaaactatgacttttaaaacagcagttccctttgtagttaatgttggttgacaaagacaaagttaagcacttagtgacactttgttgtagaagcatctgggaaaggaatataccctgtttaggaacaactcctctttttagagggaagacttcatcttttcagggcaaagctggagaagagaagattcccacttactccttcactcactgggcagccctagtgaggtgctgagggaagaaaatctggtgaaacttttatcagctttctcctcatctctccatcctcaccctatttagggtagtgtttttcaaaatggtaagtgtataaccagcctgtaagggtgtatttctacatccaggttaccagacatgccccagatatacagacgtaatgaattgtgcaacataggattttgcatttttaaagcgcatccacgggtgattcttataccggtgctcagtgttgcatatttttcaaaacaccgacttagtgtgatactatgattaagttactgaaatcacaaataattaaaaagcagaaaagtactcttttctagggaggcagaatagaaagtagcctgcttttcacagcatatctatctatcatctatctatctatctatgtatctatctatctacgagaataaatatttttttttctatattctaactaatttaagctctctagccctctacttcttcatccataagcaaggaatgcagatacatctttcattaagatagcatgagacacttctgccatgaaacttgcttgagagtggctttataacacttcttacccacctaagttccttttcccttcagagttgtccaa

SEQ ID NO: 13795 - DNA, 42917 bp, Human
gaaatttcctgagattaaaagtattgtaatgattacatgacattatgcatttaaaatttttttgagctatatattgaaagttttaaatacacaaattttaaaatattaagaaatggtataaagtgaacacaaaattaaagtgttaattaagaaactacattaaatgctaatacaattacttgaagaaaggaatataaattttttaactaaacatagatagatgctgtatatatttttaagattcacacagcctgccttatagttgatagctctaggagtgatgcaaaatgcaagcaaattctgagatgtagctatatgtaatcaaatatagtatgatgtgagaaaaaaggccagcaagtgtataatttctttgaataatggaagttgccagaaacatataaggaaaaattttttttaagttggtagtggcttctgttaatgtttccaacttgattatgggagaatggttcctggaagatttgcaaacccactgttttattaagtaggactttgttggtaattgcctagaacagttccaaatctgcaatcctgcaaagacttctgcaaaggcaactgaaatagaggcttagtttatcctgtgtgaataagaaatttatttgaagaaagcataggagagctaagaaggagctccttgtactgcttcttattctcagaggaatttcatatccttctgcctaaacctgcttcataaaggctttctttcaagtaactgaaggtcattttgtctgccagtgcattcaagtttaaaagtaatatttatcatgaattcccttttatatgtatgcataggtagtaacaccacaggtactgttcttaaagtaaacccaagaagtgtgtccaaatgtaaaagcctctaaaattagacatgcttgatacagaattttacaatactttgcctgctcaataagggatcactaggtaacattttggtaagactaacttaaatgtttcaaattaaatgtgaagattttttttctaaaccaaaatgtattcaaatgagtacatacagaactaaaaaaataattaaattataggatcttgattgaatcctcaaaaagcataatgttataatggaaaataagaattgtgcttattaaggaattaaaaaacaaagatggctataatcccacaggcatacaagggaatcttaccaaatggtgccttttaaacatgtattcctgttggttctgagttcaaatcttagatagctattaagaattaaataaaatactgaggactaaaggaaattttttttctattctatttcattaggagcattttgaacaatattgcatgaaatactaacgtacatattaaacaatgtatgtatttatatgtccagaggctacaaagaagtaacagaaaaaacaaacaaaactttgttactttgttctgaagaaggccttagacttaaatgtacaagaaacagttatgagtcctatttttaaaattatttttaaaaccccaatgcctaagccacactgtggatgactgaaattggaattatttgtggatatcctagttgcattaccagtcaactctgcctcagtttcttcacctataaaatggtatgacagttgcagtcatcatcaccgtcatcatcattatccttatcatcttcaacttcatatcccagagttgatgaaggatcttaatgtttattaaatggtaaaattattagatgatgaaaaagcttttgtgaataagctctgtttttctctataaaataaaataaaattttactgtaattaaaatatccactgtaaaattagagacaggtttgtgaattaatttgaacatctggcagcaatggtcctaggaaatcagatgattttgtgtgttatgtttataaattatccatggaaggaaagctaccagcttgagttctttgatattgacactaatttatcatttctatttagtgcaaactattcataagttatcaattaaatatttatgcattttaatattttataattaggaaagcttgaaaaatgaagacattagcaggacttgttctgggacttgtcatctttgatgctgctgtgactgccccaactctagagtccatcaactatgactcagaaacctatgatgccaccttagaagacctggataatttgtacaactatgaaaacatacctgttgataaagttgaggtaatcgatcctcctactcttgaaactttaaaaagcataggatgaggaatgacttgggtctgttttcctcaaatagatgtttgggtttttttataagtagaaagattttatgttaataatttcatattaaccttttctccaaaacatgttcaatcttttggaggttaatactggaacagtcttttgccccttttttttttttttttttttttttttgagacagtgtcttgctccatctcccagactgtaatgcagtgtcgcagtcttggctcactgcaacctccgcctcctgggttcaagcaattctcctgcctcagcctcccgagtagctaggactacaggctcgtagctaggacacacgcagctaatttttgtatttttagtagagatgggatttcaccatgttggccaggatggtcttgatctcttgacctcgtgatgcacccccctcagccttcccaaatgctgggattacaggtgtaagccactgcacctggctagtcttttgtttttttaaagctcatgttatttccttcaaattttattgccaaattgaacataaaaatgtatttctgtgaagttagaacagagaaaattagaaaaagtcaatcagcaaggaaaagagttaaaatggtatgcacgcaatgatgtggaaaatttggggtaaaggagaaagatgtgagattgaaataaactagaagaaaataataatagagagaaagaacaatagtttggaactccactgtagctcaacagtgaatgtgcttccctaaataactgattgtctctccggcagtaatgtagaaattggcaaggttgtagcccattccataaatctgatatgacatgttcctaattaaatacaagtcttttaatataactaaaggatacaggctaatctttatgaatcagaaagcaaacagaccttgaaatgcaggagtgtaactaatgtgcaacactgacaaagactaattaactataaataaacaaaaagagaaattacatcacctttaaaggatcataacatattttgggcaatctttaaagtgtaaatcttcttagaataactacttttgataaccaaggatagaaaatatttagatgaaatcgtatatttaacttgtattgaacttagatatatctttactaagaagatactaaaatttttcaatattgtttatgttgccttatgaatacaagagtcagattttcacaatgtgatagattttaaaaatctactcccctctcccccttctctctcttactttcaccctcaccctcttttgaccctcatttcatctttccctcccatttttcctctctttagtaaagtttaggctctacagcagattatttttcttctgcacatttgattgtgactctaagtctttattaatattcactgtttgatttatttcactgtatggattctgtctgttaacaggattttctgttgagaatttatggttgataacaacaatcttggcctatgtgacttctacatctccaatgtgatgcatcaatgtagaatataagatgaaagtttttcagtggttaattcatctgccttgcttcttttttcatcttgcataaaaacacattttttttaaaaaaaagttagtgcatttctgaatttatctatcaaattaaacattttagttcaaacttatttgtcatatccccccaaactattccagaggatcagagagatttgatgatcactataactgaatcttctattttgagtaggttttgggaatggtttcaagggtgctatttattcctttcacaagtccaaatacacaatagaaaaaaaaatgctgtttgggatcatggcttctctaggcaaaaatgaaaaaaatgactatatctgcagagctcttttaaaccattccttaccatcaggatcattttcactgcccataaagctgtaggcattctcatgaggttcggacatttttcatgacatcaagaaatttaagctaacaaacatatctgtataaacattacttaatatacaatattatcttagtatctgtgttttctggaacaacaacttcctgtggaatgccaaatataatgtgaaataccaaatataaagcattgcgtctttacatacttcagcctttaccacatacaaacaattctaattttacacagagtcctttctgagaaattttacttcaaaccaaacttagaatcctcagtgagtgagggatccagagagccactaacaatcccttgtggttgactgaaatatattagttatcccttacttaacattccttggtgatgaactcatgatcagaaaaaccagtttgtaggtagacggtatagatacagatataaataggcatatacatatgctataataactctaatgcacttaaaataaaacctgtagttttttaaaatatttatagggtagacctagtaacaagaaatcaaccaactcactcatccattatctaagaaaaaaagaaatacaaaaacaaaaatatatgataaagtaaataagatgacatgaggaacaaaatttagaagaactttagctcagatattaacaaattaaaatgaattgcttttcaaacaagcaaaaaaaacagcacacaatttcttatggggtgatgtaaagtaaagatgatagatccagtcatgtgaatagattaatagagttactcatgacatgaatttcttcatgcagtcctggaagtccagatttcagtgactcgtggtaagcatatttatctcatttttatatattaaggtgagttgtttcaaatgttcttgatttcatatgaaacattctgactaaatactactaacgtaaccaatatagggtacagttaaagaaaaaaatccatggtaagtaaagcacatggaaaatggtaggatgagattcttcatatttttttaaatctcctatgtgtgtgtttctgcctgtttcagcctagaatttatctcatctgtagaatagaaaacctttgttctaaaattataaatttataggataactgaacaatgcctttaacatatgtaccagtttcttataagttataagacttggcattttggactagtgtaatagacccttggtttaggctttggcagattaattcttaaggcctttgatgtatattgcaggcagaattctaagatgttccctaaaagtcccattcctagtatacccatgccctctataatccttaatatcatgggtatttggggatatcacttctataattgggctatactatatggcacagttgaatttaagaaagggagaccacctaaaagggcctgacctaaactcatgagatgtttaaatcagcatcttgatgtcagagtcaaaatttgaagcatgacagagattcaaagcaaagtgaactgtgtgttgatgacttaaaagatagaaggaccaatttggtaaggaatgtagaaggcctgtaaatggtgagagaaactgatggccagtaagcatatgtggtcctcaggcctacagacacaaggaactctgagctctgcatgagaccacagccctagtcatcaccttgactttgaccttgtgagacccttgggagagaagccagtcagatcaggcctgaacttctgacctacagaaactgtgggctaaaaaaatgggtatagctttactaagtttatggcaatttgttatgcagcatgaaaaaattaaaacaagatagaacaacttaaaagttttttatctgaaaatcaaatttgaattattccactgtaagtgttgcatttgcatttgtgagtctagggatttaggtggtcaataagtcaaaccatccccaaaacccaggggaagaatctcaattgagctttgttgatttctactgatggtggtagatttattgcctcctgagttgttgagaaagggtcattaaattatttgtgtttgaaaattatattcagtaatataatttcaaactgatgatttgtgtgatttctcatgatctagaatatctatgatccattgttttctatattagaagcaagttttagacccaacaatgccatcagagtgctatatattacccagtaagtacatttattggtgtgacataaaatggttgcagcttttactgcactttcattttactctagtgctgtgaataggaatgggttgtaggctatatgatcaaaatgtagactttttgctttctgataaactacagctaaccttaagtgagcatttattatgtgctaggtactgttctagtcatattacatatattatctcatttatttctcacaacaaaattatgaattgctattgttattcctattgaatagatgaggatttttggacaaagagtaattaggtaagtaacttgactaagattaaacagttagtaattatatatcataatagtgatgctgtcttctcatatcacaaaataatttccaaaagggtgataaaagactattattctgcccccattttctgtcaagctctaaattgttcttttaacttgatatttgttttagttgaactgaatgccaagtactctacgactcccaaaaggaaaagaaaagcctttttctatgggtagataatgtgaactagaggtaacctttatagataacggactctgttatctaattattataagaaagaatggcataagactacttctaattgtaagtatgcattcttcaacatatatctaagttctggactataattttatgtttatcacatatttactagtctaggaaaacatttttccatgtgccttaaagggttcatcagaaaactgcattgttcaaaagttgatattctttgagtgttttaaactgagatagtctttttgatgaaggtggttatttgaagtctccattgtcatgttatagttttaagttatttatatttcattttgcttaggttggagggggcttcaacttgttttctaagaacaacattagccctaactatgtgtaatgcatttttccagcaaagtgcttggtagcaatattaagatgtatagaggctctatagaaggatgtcaacatccactcatccgtaaaattttcttggcttcatccagattaataaactcctcctcacctctactacattaattaacgtagccttatataattacttttacttttcctgtactacccctgtgtattcaataaacaccaagaaatgttatactacaaagtgctatagagctgttaattgtatttgctgtatgatgacatggagggcatttacaatgacattaagttatggtctttgtggggatgtgtaagaaaaatttctctcaggtctcagtgtcagaatgggttacaacttctaaaaacagttgcttactttctgggttctatattggtaactgagtgtgcttgtcattatggcttgcctgctcagcaacctggagcccaatttttgtctcagtcttccctggtttcatataactttgcctacctttattttcttgtcacctcaactacttatgtagatttttaaaaagtattaccgtatgttgttttaaaactgtccgtatcctttctggaatgatatggtatatgcattcatcagtaaataactgtagcaatgaataaaggaatattagtaaaaactggtcatagaaaatttcttgcatgagagatgctttccttgatattaccctccagtgatcttaaaattgaggcaaattctcttccatggacagataaagtggctagattgtttaaaatcatccttgtaaagagaagtgccataaaatacagcagttacagatgatgaattttttaaaactctagaagatttttgaaaggaatgaaaattatatttaacaaaattgtaggaatggtagagaactcaataagggcagttgtatcaattaaattttgaggaatggtttctttttatttgtctttattataatatggtgcaatgcaaactaaccaagcctcagcaccaagcaatatactcctataataaacctgtgcatgtatcccctgaacttaagataaaaataaaatttttaaaaaataaatagataataactttagaatatatgttgatgctctgtaacaccagaaattgcttaaggagaatcaagctaattccggacaacttccagaaatcaaagcacattttagataatgatatataaaaagtatcttaacattagtttttctaaatataataaatcggtataggactgcattgatattaaagggtaattagtctaggaaattgtctctgtattttgtgaacacaaagtacttatattagtaatatttatactattctggtggcaaaagatatgcaatacttatctttatatttaaaaatatatcctactttggccaatttatacagtatattttaaagtttcatacatatggtttgcatactcaacactttatgttggaagaagaaactttaacacgatcagcctgaattaaatatctttttccagagtacgtgaaaaataaaagctaatctctctctttactaaagatgatctacaggaagggaggaaagaattttgctgatgagattttaatatggttgtctcattgactttccataagattcttttaaaaacagtgttgaactatttaattctcatcctaagctacagtatttaagaaccttaaaaacttaagcaaaaaaaaatatacaatcatgtaggctcattgggaaaacaaatactgataatctttgctggtgacttctttatatttatattatatattatttatgagaccacaaacataagataactcaaataactaaccctggaaataaggtaatattgtaaccatttgataaggataactgcagaacagaattttgccccgagttttcatctagtaagtttctgagtaaaatttaatccagtcttttaatgctaaaggagagagactttgcccctaaaagcccccattctttttctgcttcttctgttttatctttacttctttgagctgtgtccaatattgaggtttcttttctctgaaattaagtgatttgattattaagaatcagaaaaacaaacatttccaagtgattacaattaacacaatattcaaacatctctgttagctgtcaaagtgtttaaaggggcaagaggtaatatgatccttctgaactgaaagctgctttgtcaggaatatgaggattgagcaagctttgccaaatacatttcttcctcatctattttcaagataaaatagaaagtaagatacagcttcattgccaggtattcatggttacggtcttttagataattaatgtagatcacggaaacaaatgtgagcaccaggctcatgtttaaagcagaatttcactgtgcttaacatatctatatgtcagtatgttaaacccataaaaatacatctttagtaactcaggccaaacagtgcagagccttttaacgcctttagaagtcaattgttgccgtagtggtaatacagaggagtagcttcaagattaatttattcaactgtgtagaacaaattgagagacagataaattcaaaatttcattttgtttaatgaaaaccttaattctgtgcttgagtaaaagtccaaatattctggatttcaaatgcgttttatttttaaaacaaaacaaggaagaacagtaatttaaatattatcagctgaatattatctgctctaggtctgggctttctcaataggaattgactggtacaatgggtatcctaaattaagtgaataaataggtacagatatttcctttccaatttggctctgcttgagcacataaccattaacacacacactaaagaataatgggagaaactattggctttgggtgttgctcatttctacacccatttcctcctcattgggagacagtcttgtcataatgctgaataacccagggcctaaagtcagacttctagatgtaagtgccaggtctgtcacacaaactgtataaccttgggcaagtcatacaacctctctgggcctcagttttctatttagaagataccttttgaggattaagtaagataaacatgttagctgtttaatacagaacctggtacatagcaaatgtttaataaatgcaagtaactttaccattgaatcactcactcaattaaaagccactgaagcttatgtgctgatgatcacagatgccttaaaggaagggattcgatttgggctatgatgaaggctaaccccatcgtgcttgggttcacattagatccacttaccaatcttttgctgagagccaagaattcgggaaggcaaattagaccaaatctcttcctgtgccttggcattctcagtctagtagtcttataagtattttcagcacaatagaggaagtttaaaaagacacatataagatatatgtatgcgagatctgtagctatctattggaatgtaagtttttatgagttcactcacaaaatacatatgctgagaaatgatgtacttgaatctgttattagttttaaatctggcagctaatctgagatataaagtatttactcatttatccatcaccttttcttaacagtatttaaggttacttacatgaataaatgctataatatgcacacaaattaacataaaaagatgaaaatataaatcttagttcaataattttatctcaaaatattatacataataaatgtattatatataattttctattatattatctgctatatcatatcttatatatattactgatcatgtgttatgaggtgacaaatacaaacttagaaagtgagacaaagaaaaaataacagttgggaacataatacaaagccaggagtcagatagatacatcaaaattgaaaccattttgtattataactcatagagattcatgaaaatagtaaagtttttctgggcagtaatgctaaattttagggaacccctatacttgctcccactattcctatctaaattcaggatcaggtgagaagaagaaatgggattcacacagaaatagagctcaaaatgttctattttatgttgataaaggcgaggtgtaccccctaaatttaatgcatgacttcagtgtgaagcaagtaagagcttcctaatacaaaactccagaaataaactatgccatcagtcacaggcaatgctggccagccacaagcctcggacaaagtctacccccataaatctttgttcatgcaggggcaaaatgaaatgtatgcaattgatagtcaattatccccaaaagggaaggggaaccatctggggccagttccttctctcaatcatcaattagcttaggagtgagaaaagggatcaacagaggatctaagaagagatttgattgttccagaagaaagtcataagatggaaaccaacttgttttagcctcatccagatgttagtcagtttatgtcccttgactctggtctgtaacctgtgtactcaaacacaatttggagaaatgccccaccaaaagttaaattatgatgccacatttgactaatattagagctgttcttctctaagtgtggtccctgaactggcagcatcagcatcacctgggagctagtcacgaatgcaaatactcagatcccactccagacctagggaatcagaaactctacggaaggagctcagtgaacaagccagatcattctgatgagcctatgatttaagaagaattgaactaggaaaattctccctaatataatgttccttctctcagagtaacatttgagatctttccgttttctggcacagtttgtaaatatgcaatggtggcagaatcagtcatccagtcttacctgaagtttctctttctttctgaatatttgaaggctttgaattcccctttttgtgctaagacctatctttctggcacttgatgctgcattgcatatgtgttctatcatatgacagactctctagtgagcatgtattttcagccagagggttctccagcctggatgttatatgcccagtggcttctccctttcctcctgctatggatttcaagaagtctacccctcggaaagttttctctattccccatgcttttttcacctgaagcaggaatttctaatcccctgcctgtgcagttcttaacaagctgtgaggcctgtcaggaaccaggccacacagcaggaggtgagcggcaggccagccagcattactgcctgagctccacctcctgtcagatcagcagcagcattagactctcataggaatgcaaacactattgtgaactgtgcattcaggggatctgagttgcctgcttcttatgagaatctaatgcctgatgatctgaggcagaacagcttcatcctgaaaccatccctagtggataaactgtcttccacaaaaccagtccctcgtgccagaaaggttggaggctactgatctgaagaatcaacctcagcatattttcaaactgaagttgctgttgatatttttgaagtctgtgcccccgggagcctagtaaaaaacttaccacattctcctcaagactttgttcaatagttcaatgttccagacttaattagtgtttctgtctcctacatccgagtctgcatcacaagtcacttctctggtgcagtgattctcaaccttggtcacatatttgaatcagctctagagctttttaaaatcccagtgcctaagccataccctggactactgaaattggaatgatttgtggatgagacccaggtttggtgtttgactttcctcatctatattttcagtgtcacatgcagttgtttttaaaaaattaatatgcttcttaattttatctctttacttctctagtactgtgtcatctagaaaaagaactttctttttaagttattttttattttctttctgttccacaccttcattttcaggcatagttcactacatttcataaatcagtaacttatgaatctgctaaaagtaacactgtccaaaacattttggaaatcttcacatttctgagttggatattcttaattggatatgttgtcccatcagactaatttctaagccagaattgggacttcacttgttattgtcctgcctagccctccattaatatgcataattttcattggatcttccctaattccacgtttctcattctcactcctagggcaaattctagtaaaccctgtcttgagttttccagggacagagaaacttaccctttgttggttaatgtgtacacatataggcatgaatatctccttgctaatattcaatgtgggctttaaagagttaaatagcatgtatgcaaatatatattatatactccattccttggcacgtttgagaagaacaaagaaatatatctaaaaaatattgagactggataaaatctttttttcagcgtgttctctctagagttataatatcaaaactctgattaaagacataaaattgaaagaaattaaatctaggccatttaagataaaatagtttattctacgataactacactgaatctgtaatgtataaaaggatagaatggacattgaagaggatcagtaaattttggaagtagagagaaaaaaagaatatcccagagggtaatgttgtcaagtccaataaatcactattcagcagtcatcttttggcagggtgtttttttatcatgctaatgactgcaaaaactcatgagagctaatatatttaaagagttcgatcccttggaaaagagtccttcttttgccttatgctattatggagctgatttatcctttgtacttgttctatggtcatcaacaatcttttgactataattagcttcccaagtgggactacctacagagaatgtggtggcactaagaggatgaaggttaacctttaggtttaatgtggtctttgaacttgtttaagataattttgccccaggagataaaatcaggtttctaagttagtaaaatttgcaagaatttgccagtgatactggacagtaataaaaaattaacatgtaatgattatccttttcaaaggcaattggcgattacctggtcctctctgggatatcctttgtaaacacacatttttttcttatacaaaatgtgtgtagttaccctgtgataatatgtgcatcatcattatcattgtcattatgtataaatactagttttatccaaagaagttctacaaattaaaaggcatggatttatgcctcaataaaggctgtgttacaagaaacaatttgctttgtgttacactgagaaagatagaaactgaataaaaaatactaaattactccatcagaaataaagagctagagttttgaaggttccaaatatcttcgttttcagtccaacttctttgttttcaattactgtgactgactcgctcccctcctcccatcctcatgagattactgatttcagcctacattaaattgcctaaattgtctttctggcatccttacatggggaacaagggcaataagggggtagggaatatgaactgactttgctattagataatgtgtctaaagtgtttgccaaagttccctaccaatattatttggagacatttaattagaactagatgacacattttaagaaacttattaagtttctggagcctaaggagatgatggtgaatggagtcttgaataaactgggataaagctgaagtagaaactctttctggtgactaaaaatggaatattgccattttctgacaataagaaaggaagtaagaagagaagtatgtgagcaaagaaaaaatactaaagtccccaaagagacaaagactagacggtatgattaaatgaaactgtaaaatcagctcttatttctttggcatggaatttttcacttaaacattgcattgtgtatgaataagcattatcttttagagttatgaatctatgaaaaataactatacattgggatagatttaaaaaaaagcatgtacatgttctaaacttgatatcctagcaagtcaatacaaaatacgattttatgatatttggtgtaatcaaaaggccattaactattttgatatttgacttgcaaatattcattcattacataactttgttaattttgacttcagttagtaaaaactgagatttaacagtaaataaatggaaataagtgaatttacacaaatttggtgatattatatttcagtaagtactacaacaaataagatctaagaacagttgtttataaaaaagaaatcagaggataaagcaacaaaaatatgcttttattttttctaatgtcaatgatatgtactagataaatcaacctataattagtcatcccttaaaattgacaagtatgaaaacttttatttaacattgatataggaggtttgcaaactacaatcatgttcattataatttttcttacttttatgagaaataagtattgtgtcagaatgaaactttaacctatatctacatgatgggtgagacaattccatgcattcagctgtttcattttccttctgggcacttagctaaaacacattgtttactttttctaagttggctcatgtggctagttctcttcccttaatctgtcaatggatagacaataccagtggaccttgaagtctcaagctgaaaacggtgaagtcctagcaagaaagaaacttggatctctgagtaactacataaagtcataaacttgtttacctgcattagatagtcatgtcagcaagatagaatctcttattgtgttaaaccactgggattttggacttgtttgttacagctactaataagacttgccataatatagacattttcaacttttgccttattatccatttcccagttgtataaagtgagcaatttttaacatttttgtagatgatttaagcagaaatatacttggctgagtacagaattcatgctagttattttcataattggagaacatttcatctagcccatgatgagatccaatgaaacctttcttctccatgtcagatataatctctttactggactgaatggttcattttcaacaaatttaatatttccctcctccaaacagtcctgaccataataacaaaccattcctctctgaacacagctttctaggttacctccttagcttactttcttttctttagctatatcgtcatcactaatcagctagagtcaagaataaagaagctgctcctaatggcttcagaagaatcatttcctctcattgggcattttaaatatcacttttccatgatgagaacaagtgaaagtaacttcaattgcttggcaaggggaccttaatatgactatctctggccttaggtatatctacactaaaatatgccttgtttttcctgttataataggaacaatggtatcctcataaatatcaatgaatcaataaggatctcagtgtatacatgtttttactttctctttcttcaaggatttcctggactatccttatttcccatttgcacatacaggcaaaggaaagattaataaaaaattatccttccctgactaaattggggttttaagtcaaaattgtaaggagtgtgaccgagataaagaggctatagagaaagaaaagagaaacctaggtgtgaagactggttgactgttcacttagagttaatatgtactcaggtaaggctattacattgtacacatctaggaagcaccattcacatagaataccacatagatagtgcttctcagagttgtgcaatggagtggttctaccactaggtgtataatttttccatctttctctcaaatacagagcatatctagctaaaattcttggctcagcaatagattcaaagctagtttcatctaaaaaagttgaagcacatcttctttagtttcctttcataatatgttagcatgtataatgaaggtccataggcagacatggagatgtctgagccatagctaatgtattttcatacctgctttccctatgagataaataagaaagacacatgaaatgtggtctaacaatcaaagacaggtttattttagagaaataaatctgagaggggcttctggccaattttggtcaggagtattctcccttacagactaagagtatatattggttttagggtgacagggcccatcacaagcttggaatgtttctgtgtgggggaaattttatggtgtggttggaatgtctctgggcggaggggaggttatctcagggctagcatgtctgtggttggggaggggtttggaatgtttctggtcagagatgttattgtggtttatggttatgctgaccttagccattaggttgataccctttgaatttaggcatttttgatcaaggtaaattttaaaatgacagtgcttgtccaagatggtgatactcctgctctgtcactctcatgcaactttaaccattttataatattttcttactcttatacacaaaacaatcatttaatgtatcaaaaattgccatgatttacccatactgattcaactgtatttttcaggaggcctaataattgctaggcatactggagtagcagctgggagtataatggggaaaaaaaagaaatatgtagtatttatcctcatggggagagattaatcaaatactcacagatacaacataaaaaactgtatcagttagcttttgctgtgtaacaagcaatcccaaattttggttacttaaaataaccatttattcagctcatagtcctgtagttcagatatatgggttccgatgtgctgctggtttgcactgggttgactcaggtatatgctaggttggtacagtgctggctggactagcttggcctcagctgaagtggctttcccctcccctccaccgtgtgctctctcatcttccaacaggctggccccagcttgtttatatggttattaaatagggttcatagaggacaaatgaaagtttgcaatgtttctggacaactatcctgcttcctaccattctgcttcctctggtatttgagagcgcagagtataggggttggatacaattggatatagaggaattactgtttcattgatgagtctaagattttgcactagtctatactgaccatttggtttttgtactcctagaattggggtgttgcagggactgctgcattttcttactaagccttgagcttttaaatgtctaacaatatcctgtaatcctttgtgagcttcaggccttaagggatattgcctttgataagaagagtggtggggtcttttagcctgatttggactgggcaggcattttttgcccctctgaattgtccttccaatacccagacttcagggttgattccttcctcaagcaggggacaacaaatgggtaacttgttccccatattcatatagataatagctccaactttggctaatatgtccctccctaataagggtgtgagactttcaggcataacaagaaaggcaagtgaaaagagcaaattctgccaatcacaaataaggaggtgggagaaatacctggttacaggctgtcccaggattcctcagatggtaatggacattgaggacagctgtgtgggacaggagattaacactgagaaagccacaccagtgtccaggaggaagttaatttcctggccttcaatggttaaacttacccagggctcagtgagggtgatgacatgagctggtgcttgccccagacaccctcagtcctgtcattggatcatctagttagggacttctggcccagagaacctttgtcctctagggcagtgcaccttccagtgattgccttggcataatggacatgggcaagggggcagcttgtttctcgttggacaatcttttgtaaagtgtccttgcaaatcacacagataacaagccctactgggtgattggcctgctccattttctgtcctctgaaccaccaaggtttgtttgtctgagagccatgactaaggctgtggcttttctctgatatcgcttttccttttcagcctgttcctcttggtccctattatagaacaccaaggttgccaggtttaataatgcctccagattttgttctgggcccagggctcgcttttggagctttctcctcatatctgtggctgattgggtaataaacttatctttcaggatcagttgacttttgagggagttggatgacaggggagtatattttcttaaggcctcccatagtcacttgaggaaggcagaaggattttcttcctttccctgagttatggtggacatcattgaataattcatgtgctttttcctaattctccttagtctttttagaacacaggtcagcagatgtttatgactccagtccccatgatctgggtcgaggtcccagtggggatccatactggggacagcttgctgaccagtaaggaatttgtccctttccaggtatctccaaactctcaggctgcagctaaagccacattcttttcattaaaagccagggtttgatctaacaatagcatgacttctctccaagtgaggttgaaggtttgccctagaccccgtaggacatctatatacctatcaggatcatctgaacacttccctaggtctactttgatctgctttaaatcagagagggagaggggaacatgtacctgggttgggccaaattcccctccccctacagcttgaagggaacataaccgatagcccgggggtttttgtggtcccctggagatttctttgcttgtttccttctgggtggaggagattagaggaggcttattaatatgaaggggagctgtaggaaggttaggatacggaggtaagctgagaggtcctcctgtgagatgtaaattgcaagctttgcatagttgtggattctccttcagtgaaaagaaagcttgaacataagatatttcactccatttgccttccctcttacagaaaagatcaagctgcaggatagtattataatttatacttccctcaggtggccatttttccccatcacagagagaatattggggccaggccatagtgcagaaaaaaaatgagccacatctttttcagagtttgtgggtcaaattggtctcaatggcttaggatgcattttaagggtgagcctgttgatgcctgaatgtttcccatttgaaagaaaagaccgcctgtggttttggtttgtttgttccccccaccaccaacccaagaacacacaatggtccctggaccctgctgatcggaatagttgcactcaccaatgcagcagcagaaacaccagttttcctcttagaccacaaagaggaccaaggaaggtcagatttagtggtccttaccaatgcattctcaaaaatctgttagagtcctaagcgttttcctgttagtattgggaccttacccctgtcaaataaagatgttatgccccaaaaatgaagtggagggccataccctgagggagggatgggatctccagggttggaagagtgatgccttttgtcctcacttctcatcatatgaataggaaggatatcatttctgaggctccccatatcctagctttaggaatagcttttgttaggcctgcttgtctgaggagggatcctaaaattccagatagtaaccccctccaatggggctttgggcaaaaattatgtttttctgattggtgagcctgggtgcctaaagaaaggaacagagtcccaaaatttatgctagaaatcattcttataggaaaaaatagaaaagcaccagagatggagtggtttttagaagcaggactagcctcagagaagagatgtgggaggaagtttgtctgacaggcattagtacccaggagtcaagggtcaggatagatagaatagatgggcgagtctcacttgggcgatgtgactttgagagttcctcgcatggctgcagggtcaaccaactttttgttgggaccccggagctgaatggctttcctctctgtcaaccctcagctcagcccggaagtataagaaaagcagaagctggtttcaagcaaaccaacgctctcaactccgaagagtcagggttgttaaagagccctttcccagaaagcctgacacccatgtctttagtctggcagccgcactagttgcttttaactggccaacaggtgcccggtgtttagcctctgaattctaaggaaaaataggacagaatagcaagctaaaggggtccaatggtactcaccgcttggtgatattagaactgttagtagttacaactgtagataacttatctcatggtagcctttgcttagggagtatattttgtgtccatgaaacagtatctctattctggagatgacaaatgcatacctcacattgactacatggctactaaaagataaaatgtaagtgttggtgagtttgtggagaaaagggaacccttgcatactttgttgggaatgtaaatcagtacaatcactatgaaaaacaatgtgaagtttccttaaaaaattacaaatagaactaccataagatccagcaagcccactactgggtatatattcaaaagaaatgtatcagtatgttaaagatatatctgtactctcatgtttattgcagcactattcacaaaggccaagacaaagaatcaacctaggtgtccatcaatggatggatggataaatacaatgtggtatatacacacaatggaatactattcagacacaaaaaagaatgaactcctgtcatttgagatagcatggatgaacttggagagtattatgttaggtgaaataagccaggcatagaaagataaataccatatgatctcagtgtatgtggaatctaaaatagttaactgcataggacagagtggaatgatggttaccagaggcttaggtagttaggcagaagagggaaatggggaaatgtaggttgaaagatacataattacagttaaagaggagagaaaagaatagtccagaataggcaaatacagaaattatttgcctaatacaaatattaggcaaaagtacaaccacaaaaagttggtaagtgattgcctggggccaggaggttggagaggggaaggagagaggatgagaagagagaagttggaaatggctgttaatggttgtagagtttttttcttgggtgatgaaaatgctataaaattgggtgatagttgcgtaactgtcaacatactaaaaaacattggactgtatactttaaaagatgaactgtataatatatgaattacatctccataaagctgtttttaaaagattccattcttactacatctacactagaggacatcctaactttatatcagtagtctattgctgtattccagctaagagaggatagtaatttagataatggtgatgatggcagatagggagcgaaagtaatgatattgatagatgtttagaaaacaacattgacaaataaaatgaagacttgatcataacttaagcataatgtttgacatagacattttagataattataaagactggcaaaccttccatcatttacaaattcacacattcacctggtgatccttttattcattcataaaggtaggaatcgaatctggtttatttgaatttcttaacagcatttttttccataacatatatattacattatcattgatttccttattagaaacttagctgtagattaactaaaattaaaatattaaaaaaagagttttattaattcaaacacaatgttgaatggcagaaaatggtttatgatcctcataaacaggtataattaacatgttcaacaagaaatatgtactaaaaggactcagtggataatgaagcaatcaggaagatgtgtgattgctgtttctgaacacaccagtttttcatatttttaccctgaaattaagacaaaaaagtaggcttagtggcagcaatataattatatagatcatttaaatgcactttctgctaaggggcaaatgaatttcatcaaaattattgtaaaccaaatcttattgtcacttaaaatggttctgagtgtttttacagagataattttctgtggacaacaatggtgattatcagaaaataaaagttttaaatcttttgtcatatttttaataataatacaaatattgctagtaaaagtcccagttcaatctgatacaataaatgtaattggatgattttctgcagagagtctttatttctccagggagcagaaacttagtctgagacacttcagggtcacttcaaccgcttttaccctgagattgggttgaggtgatatgttgcttacatggagtcagggctgtgcagggtgcagagactggcacaggcctaagtacttcttctcttggtagttatctcttcatactgacatctgctgatatctcactcagcctaggccactgtgagctatccatttgtcatctctggaatagatatactgtttcatggacacagaatgtactccctaagcaaaggctaccatgatataagttatctacagttctaagaccaggtacagaagagaataaaaatagataacttactgcaaaccagtcaactcaaagatgtaccctgctggtacgatgttaagaagacacacaagtgcagtgactttgactgaaatcaaagtcatacgtagtaatgaccatttgtattatatttttaaactttagggaaatataatgaacagatttaaaagttaattcaggaagaagcaagtcagagtaaaacaagcagtcaaataaaaaagaatagagcataaagctgaaagaatttatgaatatttgtagaagaggctcaattatgtttacattcaagtattaccaattgtagcttgagaaaaaaggcagggatttttttctggtcatttgtgtttacgttcaaatttagttttctgcaacataagcatacaagtctgccacacagaaggccaggtggtcttgtttccctggactattttttgtgcatgtgtgcattgcctcataacttcatatcacagtacgaagatggttgaagaggggaaaaaatgcctaaatctcttctatttaatggtgaaaataaatgtgtctacaaaacaaaagtctctccaggcatagtattttgaggttcttcaattttgctgatgtgaaaaggcattcctttttcttggttttcaaagttgtattgcatttatgttttatttgcaaggaagcatgaacaaaacaatttttgataaacacaaaaagctgttttgcctcattatattggatgacaagtgagatcttacagcttcacatcaaatcagtggaaaaacaattatctgtaaaaagtatgtgcaaacatttttcttataaagctaagattcaaggcaacgtgtctggaatttgtttctccctttaggctgcctccattccatgaaacatctgtctcaatttccgctcttcctggagcctcctttggtctctctacaaatccattccttctgaatctgcctcattctgacctacagatggaaaccgtatgtctttctgtttaagaaaatgtgcccaaacttctcagctggagctttctggtcaagctttattgtatcttcatgtattgctcctaaagtatcaaagacagtataatctgtttttgttttgatttcatgctttaaataatttaaagtaagtattagcacattcactgatttgtctcagaaaatctctaaacatagagctgtgaattagatatattttggacaagcaaagttggaaaaaattatacttcaataagtacttgctgattgcctattatgcttacagcctagaggtacacagataaaagacatgacatactttaccatccagcaggcttggaaatgcagaaaacaaatggaaccaatgtaatacagcacagaaaaggctgaaatagagagactctatggaagcacagaaggatgcacaattcagaaatataaactgataaaagaaagtttagtgttccttaaaaagaataattttcatttgtgatttgcaatgcttttaaatctattataagtgatattaaatcataagtgtattcctaaaattttttggttactcaaacacctagaaaatacctggtctgaaaatatacctgtgttatagatgaaaggaatagtttgcagatcacttggtattaagtaatccagaaataatttatgtgtttctttactttcttaatgaaagcaaataaagaagggtggaaaaaagcaaaaggccatattggtgtggttaagggaaagtctgggatttctggggataccacaaggacactgggccacaaaaagtgggtcctggatgtcgccatcccaattgcctggagcaaattttcagcccaagcttacgagaccgtcagagaagtagacatttactaagtaccacaaagaaatagacattcagacaagggaagaaatctgaaagagaagatttctcctaaatccaaacagtattcttaaaagcaatgattctattacttaaaatgtacaagttagataagagcaaagcagttgtaatctaaaatataatataaaaaataacctttgaataattttgtaattttataactgcctcctagtgtcaacgttctcaaagaagtccattttaacatacctagatatcattacaatatttgttattttaataatattgaaaacacatgagaaatggcatatcacaatcaaatcatagtttttatgtcactatatattttattttagtataaaggatacttttcagtaaaatgccattagagacagtataagtcattggtaaggaacagaatatttgaacctaggaaatcaaggattgaaaggacaagataatatgtatcaatttctgctcagttattaccttcaaggggagtagaatgagagctggatggtaaaggggagttttgaatttactctgtacacttctgaattaatgtgaagctttcacaacattgatgcattcttataatgctacttattattagaaaacaataaatgagcttttttttaaacctatgaaatgaacaaacatatacgatattaaagaacaagaagaccaaaaaaaaaaaggcattggaaacaacttctaagatttgagaaacaaaactaattaaaaacaacagttactagaaccatgtgtgttcctccaagcaagcaggatggtcaaactattgaactttagaacatgagtgtcctcttgtggcaaatatgggtacattttaaatttgtgtcactgccacacagagtgactgagaagttggcctgaagaaattctctttttttttttttttcagattgaaatagccacagtgatgccttcagggaacagagagctcctcactccacccccacagcctgagaaggcccaggaagaggaagaggaggaggaatctactcccaggctgattgatggctcttctccccaggagcctgaattcacaggggttctggggccacacacaaatgaaggtcaggtacctcaaagcagaattacaattgagtccactttgtcatcctcaaaactgcacagcttcaactctacagggaaaccacatgacatgacccaagaaaaaagttttggaataggctaggtttgaagcatatttatacatagattttatattcaaatataaagcagttttaataattcagcttcggtctcataaaaatgatcaaataaccaaagatttgggatgaaaatattgtgtatcattactcgaaacctggtggtggaatgtatttgtagaacagagagtaattgatgagcaggataaaatctttgcctctgagattaggccacagcagttcaaggggataagagatgatgaggatgaagatgatggtaatagtaataatattttgcactaattgagcatatactatctgtggcctatatgctcagcacttcacattatctcattggattattaaaacctccctgtcagagtgttaatattactcttctcattatcatggagaaaaccataattcaaaggggatagtaacttgccagacatcacaaagctgttacatagcaggtttgaagccagcctgttcagattcttggctgtttatttatttaaaaacaggcttcttctcactcaatcctaagaagcaccagagagaggaaaatattgcacaacatcagacaccatgttgcatggcctgcagatgaaaccagagccttttagttaatgagaaggaattcttagtgctacatgtaattctataatatgtccgtatttcttgttcaaatgtgtcactgtcaaccttgggggtactcaagaggactcacactggaatacttttatatacacagagaatggcatagttagggagtatagaaaaaaatagagagttccccctgcaaaggttgagtgaatgtagagtgtctctgtattccaagttctgtagacacaaaacttagtttcaaataactaccgttctcatgaatatttctgcctagcacaggaagatagacaaagaaacaaatttagaggcaatactgtatgtattaacccattttcatactgctgataaagacatacccaagattgggtaatttatagagaaaaaagaggtttaatggattcacagttccacatggctgaggaggcctcaaaatcatggtgaaaggcaaaaggcgtatcttacatggcagcaggaaagagagaaagagagccaagtgaaaggggaaacgccttataaaaccatcagatctcatgagacttattcactaccatgagaacagtatgagggaagccgcccccatgattcagttatctcccactaggtctctcccacaacatgtgggaattatgggagctacaattcaagatgagatttgagtggggacacagccaaacaatatcactgtattacaggtcttatgagaaaagtctgtccagaacacattgggagacaaaaagagagggaggagcaatattacctaaggcatgactaagagcaaagtacaggaatcaaaactgagagtttcttggacagacagaggaaccaaaacatatgtattcaaatcccagcactgtgacttgtggggtttttatagtcttgagtaaggcattcaatattactgtgccttagttttctcatctaaaaaaatgggataataaataatagaacttaccttatagaggtgttgtcaggattaaatgaatacatgtagttactggcccatagtaaacatagtgttagttatgaaaattctattgataaaggagttcatgcatttttttctctcaaaatttttagtgtacaatacagtattgttaactatgaatagtatgatatagcagacctctagaacttgttcatcctgtataactgaaattttataccccttgaacaactccccatttcctgaggctctgataaccaccattttactctttgcctctttgagtttttaactgttcttcaataagtaatatgaaaagttgccctttcatcccatgccttctatatgccagacacttgaattgttttatctacattaactttttgaagagtcaaaacactatgtactaggcactgattacccatttttaaaaataagaaaactaaaactctgacatactataaaatgtgtccagtaacacagaggtgatatgtggaatgcaacatagaccaataaatcctgtcagtgtcattaatgaatatattatattctttctgtgtagttaaatttctgtgtagcagaacactctacaagtagaaaaaggaagagacacaatgagaagaaaatgtaaatatccagcataaagcacccaaaataggaaaattaaatatccctagaacattacttatatttaaatgatttcagatccttcaaaagttgaccaatcttgtatcagtacctgtatgttggatctctcagcttagccagaaacaacagaaaagcagaatgcccaatcctttcaaaagcttgagtcaagtaatgcttcactaatgtcaatttagaaacataacaaaaactaagacttttaaagaaaatttttgtttctaaagtactctgaggataaaaaagttaaaaactcaaactcactttttaatttccaaagaagaggcacacattcatcaaaattagtttagaaatatttagaatattaaaaataaaaataccatatttttactactaaaacaaatttctaaagataacattctaaaaccgtgtaatatagccttgagttaggtgtagaaaaacttagaattaaaatataactactgcgaatatatataaattaccctaagcaatcattgcttaattatcaaggtgataaatatatagaagaatcaaatgccttaactcttaaaatttttatgagtagaaaatattaatttataatgattggagaaattagcacgtattaaatattttacagctcctgcttaaacattttttcctggctttccattcttaaaatggaaatgacttttgtatttaatgatagtaataagaccttaatgggtacattattagttcttgattacaaaccacaaacagacctttcaactaggttgatcaaatatcctggtttgtctgggtgtgatgagttcccaacacaagtgtctttcaatgttataaacatgaaagtctcaggtaaactaagacaaattgatcactgagaaatttcaggacatttcttccaccacttttctcttctagtttatgtcatagagatttcactttctccattcattccacagcttacaatccttatttacctcatccctagacccctcaaggctgtcagataacttaacttcctacttcacaaagaaaatgcaatttctcagtcagcagctccttggtcttcctgtttccagacaaataatctacctacatctatatcaatgtgctcttctatctccctctccttctagcacaacaaagacactctgtccttccacaagtgggatgaaaatctttccatgttctttgagttctatttcctactgtcctctcatgatcctttttatattcaaattcacctcctctggatctttttctccaaattccttccatgttaatcactcccttcatcaaacaaaccccaagcatattttattatagatatcactatgtctcatcccttgctcttcacaaacctctcagcattttcaacatttgtggcaacttttcccttacttccaacttctcccttaatggactgtaatctggctttcagctccctcactttgcaaatcttgtaaatgctctgataaccactgcaataactaatccaagaacatttttcagtccttaacttacctgacatctcaggaggcttaggttgttgattatttcctttcccttaaaactctctccccacatggcctccatgacattgccctatcctgattctcctcctttcctctgatcattaattctccatctcctttagaagtttactgtcctctccatgatcactaaacagaaaatgaagaaggggtggagaggtaggggtgtgtgtgtgtgtgtgtgtgtgtgtgtgtgtgtaagtgtgtgtaagacagaaaagaaaactcagtatgtcaagataaaacccagcctcagaaacatttttggttccattgcctcctctaattgttaccatcttttgtctacactatgattcacttccactttttccagttgccctgcttcagtcttccattacatcttccagcagacttaactcttaccatgcaaaccgcatcgtatgatacctctgcccatccttatgggaaggaataaaagctgtagcacagcctacaaggcccctgcatgttatgtcccatacattccaatgctctctgagttttaaccatatggactatccttcagtccctccaaagtgaaggcatatgctgcttcctctgcctggcataccattcctgtcctacctgcatagtcaattattcctcttctgctgatctcagctcagctttcacttcagagatgccttccatgacttccagactaggtcaaatccccctatgttatgttcagatgacacttcatgacatttatcacattcataatttcatttgtgtgattaacattcatttcacaaagcagatcataaaacacaactgtgttctttgtgctcaccactgtttcaccagctaccatggtgccatttacatagaaaggattcaataatatgtattgagcaactgaatattaataattattatcttttatttttcttgaagcaagtgttgttttagtgaaatgtttcattattaaaccaaagacttaatgaaaatattacatgtgatattttaactttatgaaaagcacaataataatgtttaaattttgaatatagaatttctaataaatagaaaagtactaattttaaattatttttaaaatgttacattgaatatactaattgttgagacaattttaattggtatgcttgacttgaatattctatttacagaaagcattacgagaaaatataaaatctacttggttagtgggagactctaatcttgtgtatcaaacattccacattatttcttagaaattgatttggtacttacatttaattttattttcctttatcttttagactttccaacctgtcttttgtgtacttgtataagtaccaccgtgtactgtgatgaccatgaacttgatgctattcctccgctgccaaagaacaccgcttatttctattcccgctttaacagaattaaaaagatcaacaaaaatgactttgcaagcctaagtatggatgacagcattaacggccttcaccgctttacacacttcctttaaatttttacattgttaaatgttagcactgagaatgaaacttgaatgccaaagcctggttcatgaatcaatagttttttgttatttaaaaatttgagagtttgctttaacaattataagaaaaacaacaaataagcaatggtcatttcaaaaccatataggtgatgttttcaaatgagcaatttaaactaaatatgcataataaataattatattgtacatgctggaatgttttatcatattatgacattatgagtaaaatattgtggtcatatttatgaggagttggctttttaaaaataaacttccactaaagcatagttgctttatgatggatgaatgtaagcctaaattctgactttaaagttgttgccaacttagaagaattttggtatgtgttgtcataaagtgttttaatcatttgaagatttctttctaatgcctgtatctttgactattagaaaacacaacagtctttatcattgagggaaacattttaaatgacaaaatccagacaaactttatgaagattatggagagaagaccagttattttaaacgtggtgtaccaatttctttgctaaagttatactcctaagtacataaatatgaatagtatttggaggaaataattttttataaaaagaaagataatcatctcattaactgtgcattgctaaatttatatttgcaaaataaaggaaaattacatttatatttttatgtgagcaaaacaagaatatttaattacttcctttatttttttctgctaggtgatttaaaaaggattgatctgacatcaaatttaatatctgagattgatgaagatgcattccgaaaactgcctcaacttcgagagcttgtcctgcgtgacaacaaaataaggcagctcccagaattgccaaccactttgacatttattgatattagcaacaatagacttggaaggaaagggataaagcaagaagcatttaaagtaagttttaagtttgatatgcagacttttatcttccaattttatttgctgtcattgactaccttttttattcgtgtagggaaaataaatttatttatttatttatttatttatttatttatttatttattgagatagggtctcactctgtcacccaggcttgagtgcagtggtgcgatcacagcccactgcagcttcgacctccctgggctcagatgatcctcctgcctcagcctcccaagtagctgggactacaagatgcgtgtcaccatgcctggctaaattttgtatatttttgtagagacatggtttcgccatatttcctaggctggtgtcgaactcctgggctccagtgatcctcccgcttcggcctcccaaagtactgggattataggtgtgagtcactatgctcaacttctataaggggatttaatttagtgagacttttaactttcaagataaacttcccaactgcatctgtcatgcttctgagaaacaccatattctggtacattgtgagggtgatcaagtaccaaaaacagaaagcagggccagaataagaagttggtggctacctgaagcaccatctacagaagcaccatctacaggagcacctggaagtgttacaagccagagaatctgtattgatcagaccctacactcagaaagactatctggctaaaaggatagctacttggcagggaatgggcagtgtcttgaagacagaaggctactaaatgaccttataaagaggatggattcagttagccttagagattttgttttctatgtgaagcaagcaggtttggggctagaggacttgctttgaaaaacagcatagggtctgagaacagtaaccaactggctttcttgcctcctcttatggcattcaagcagcccctctcagtgtacactgaacatgtaattgtaaaatactctttagagagacaccacagtattctcagggatggcacaggggatagtgtggcctcataaccactgggtggtggcaaatgccctgtctctctgctaggcctccagtgataccatcaatggtagctatgggagttagggcatctcactatagccaggcaagggtcatagtctagtctgcccactctgcctgtgttggcacaggtggtgatgagtcacagtttattctagggtgtttggctagagtagaacagctattgtctaaatgttttttgtcttgctaggctgcccttttctggtagttgggctaccaggccattgctggggaggaactctttgtttccatgcctataaaataaaggaaatgcttgctatgcctcatcaaaatcctcaaaatcccactgcagaatgcctttcataggaagaagcagccttgcttaaattgagaaagtcagactgaacaaaacatggttcttcctagagactgagaaacacattgtatttttatgaagaaatatttgcttgtagccaatttttccaaaactcatctgaattgtctagtaactcagaaaactaagctgcctcaactttacaaaacaagacctgaactggaacatgctattttacaaatatctgcatgtagagggaatgggaaatacagctgtgttttttatttcttattgagtttttattgagtttttattgagttcccacatttggaatgtttacaggacatgtatgatctccatcatctgtacctcactgataacaacttggaccacatccctctgccactcccagaaaatctacgagcccttcacctccaggtaggagtctaccagtaaggtgcgcccaagggcttcagagaaagcaaagccaaaaaggacatcaggacacaagaatttgtctgtaatggcatgttgacacactgtgataacttttcttctttttctcttttctcatttattctctctctttatctgagtacaaagctatctttatacattcatagctctatctattctaattgaattctgataactttactctttttcttattttccaaggcaaaatgcatccttttggtacacaaatcttctttagaaaaaaaaccactgaaagtttcacgtgttgaagaaaatgaaaagattagaagtggaaaagaaaagggagaaataaaaatctaacttgacatttagctgtcaggggaaaaaaaaaacatcagtttcagcctgtgattttaggttttatgtattgaattaaattcagtcctaaggcattcctatgtgctgagagatggcaagctccatctctctggataaacaaagtgcaggtttttttttttttaaacaccatatttgaaagttttggttattttaaagcccattaagctacatgttatctttgaagtattcagtttgattagtttaatgaatgaataatattttattttcacctatgtgattaaaaaattgttcaatcataatgaatatttttggttgttaaatataaattatttcttatttcagttgtaaattttagtttgtagctataatcaacattctctaatcaattgatctgttctatggaataaatatatagagaaaacacccatttcatgctcaaagaaacaacattatagtttaacattatcttttatggcagaaaatgtacaaaaagtgattttgctatttaagagctggacatgaattcctgtgtttccccttgtggattttgtgaatatttacctttgtgccttttctttttttcctattaatataaatattttcatatttttggtgtctacatatatataaatatatatctctatacatatatgtatatacacacactatatatatatatatgtatatatgtctgtgtcttggatatctgtctcttttgtaggtttgtctgatttgtttacttgcctattgtatatgtattttctagccatttggtttgatttctggatggctctctctttttttctgggggtgaatttctatgcatataaagatgtctttccttgtttatgactgaaggaaagatttccaagggagtacttagagattttagaatgtgttttccaattatgaattaaattttattactattatctggggtgatattgattctaccaataaaacaagtctttgatgttatatttaaacataattagtttgtatatataatatgagggaattttttaaagtaacagcttttacattcccattctaagctttgaaagtcaataagtgcaacttaaaatttttttctccgtcactgtcagctcacaacatccaatatatatatgtctgtttttagcttacattgtcttcaacttctgtatttttaatacataaataaatccccttttttattcatttggaaaatgtttgccaacatgtagtatagcagttaaaactgaaggctctggcaaaagcatatgccttgggctgaaattctagacccaaaactatctgaaactccctgcatttctgatttctcatgtggattaaaaggtgatcttctatacaggatggctgggaggatgaatgaaacaatgtttataaagcatttaatatagctactgatatatgataaatacttaaatgtaagtcacagttattaacaacacatatctatcacatatcaaagggaatagcagagttaataggcacaaaacatgtattattcctcattgacactttataatgataagagggttaatacatcagggtcaatacatacatgattataaacatatatgcatctaacaacagaggcccaaaatacatgaggcaaaaactatcagaaatgaaaggagaaataggcagttcaatagtaatgaagtattccatcttcttatttttattttttaattttaatttttttttatagaaagggtcttgctctgtcacccaggctagaatgcagtagtatgatcatagcttaccacagcctcaaacacctgggctcaagcaattttccaccctagtctcccaagtagctagaactttaggtgtgaaccatcatgcctggctactttttaaattttttagagaccaggtctcaccatgttgcccaggctggtcttgaactcctggcctcaagtgatcctcctgaattggcctcccaaagtgctgggattactggcatgagccaccgcacctggccttgcttcaataatggatagagcaactatctataagatcactaagtaaatagaaaacttggacaacactgaaaaccaatttggcataacagtcatcgacagaacattccacccaacaatttcaaaatacacatttttctcaagtgcacaaggaacatttcccaggtagaccacatactaggccacaaaacaagtattagtaaattgaaaataattaaaattatacaaagtatgttttctgattccaatgaaattgcattagaaatcaacaaaaaataaaatttaagaaattcacaaatacgtggatatgaaacaaaatttttcttaatcactaatgggccaaaatagaaatctcaagaaagttaaaaaaaatcagagataaataaaaacaaaaataaaacacattgaaatgtatgggatggagctaaagcagcacttaaagggaaattttcagctgtaaatacgtatattaaaaaagaagatctcaaatctataacctagccttctaccttaagataattgaaaaagtagaggaaactaacccaaagcaaacaggatagaaataataaaaattaaagcagaataagtaaaatatataatagaaaaataatggagaaacaaaactaacatttgtttctttaaaagatcaacaaattgacatatttttagctgacgtgatctaggaaagaagtcacaaattactaaaatcaggaataagaaaggggacattactaccaaacttacaggaataagaaggatcataaggattactataacaactgtaaaccaacaaattagattaaatgaacagatttctagaaaaatgcaagctattgaaattgactaaagaatggataatctgaatagagctataataagcaaatatattaacttagcaatttaatatcttccaaaaaagacaacccactcccacatggatttactcgttaactttatcaaacatttaaagaagaattcataacaatctttcacaaactatttcaaataacaacaaaaaagagaacatttccttcctaacccattctgtgaagccaatattacccaataacagtactcgacaaatatatcaccagaaaatgaaactacaggccaatatcctttataaatattgatgcaaatcgcctcaacaaaacacaacaaacggaattcaccaacatatagaaaagattacacatcacgaccaaatgggattgcagaaatataagaatagtttaacatttaaaaatcaaccaatgtaatatattaatagaataaagggcttaaaaccatatgattatttcaatagatgtcaagaaaagcatttgacaaaatccaacaccattttattataatattactaaaaaaataaaactaggaatagaaggaacttcttcaatccaataaagaacatctataaataactcaggctaacatcatcttcaatggagaaagactgaacgctttctttctaagaacagaaacaagactaaaattgtttgtctcaccacttctattcagtattgagcctggcagttatagctaggactattaggaaaaataaatacataaaatatagtaaataaatagtttccaaattggaaataaggtcattcttctattttcagatgacataatcttgcatataaaaaatattaaggaatccactaaaaactagttgaactaataaatgagttcagcaatgtggcaggttacaaaatcaatatacaaatatcaattgtatgcaggatatctatacactagcaaggaacaatctgaaaaaaaattaagaaaacaattctgtttataatagtcacaaaattttaaaggtatctaaaagaaatttaacaaaggcagtacaagctctgtatacttaaatctacaacacattgttgaaattaagatctaaataaagaaaacataattccatattcatgaatcagaagacttacgactaaggtggaaatggtccccaaattaatctataaatcttaggtatagaaaattctaaggaatccactaaagtatttgaactaataaataagttcagcaatgttataggttataaaatcaatataaactatcaattatgtttcaatacactaacaatgaacaaaaacacagtgagataccaactcatactcacttatttggctaaaataaaagagacaattagaagcattggttaagatgcagacaaaattgtaaccctcatacattgttggtagaagtgtaaaatggtgcacctactttggaaaacggtctgacagttcctcaaaataaaacatgaagttactatatgactcagcaattcaacatctaagtatatacccaaaagaactgaaagcgtatgtacatacaaaacttttacacaaatgttaacagaagtatattcataagaggcataatttggatttggaaataattcaaatttccattaattgatgaataaacaaaaatgtggtatatcaatacagtgaaatagtattggacaacaaaaaagaatgaagtaccaatacatcctacaacatgtatgaactttgaaaacacaatactaagcgaaagaactcagtaccaaaaaatttatatataattctacttacgtgaaatgtccagataggaaaatctatataaaaagaaaatagattagcagttgctggggtgggaggaggggaatgtgtggttttcttttgggggtgttgaaaatgctttaaaattagacagatggttgcaaagctctgttaatacactataaaacactgaactgtaccatttaagtgggtgaattttatggtatgtgagatacagtaaataaacctaggtttaaaaatccagtcctgggccctgcttatcttccggatatttgctccctccttccttcccctcacttcagccacattgacttgaatgtcgaatgttgagggaggagcattccatgttgattcctcaggactctaaacctgatgttctctgtgcctagaatgttcttcccttgttttttttccatgcctttttcttcttgtcaatccattctcagttcaattgttacctctaaagataacttttcatagtcatcctattttcttcacaatactcatcatttttggaaataacttgtttttctttcagtagttttctcacctcaaattgtatttctcttactgaagtataagctccttaaaaacaggagcatgtctatttcctaatttacccccactgcttagaaagtgcttggcatatacattaagtaattttgattgaggaaaataacaaaagaataaaaacaagggtgaagcacagtgggctgcgctatcaatcaatactaagaatgtgttatatcttgtcataatttattttcatcttttttagaataacaacattctggaaatgcacgaagatacgttctgcaatgttaaaaatttgacttatattcgtaaggcactagaggacattcgattggatggaaaccctattaatctcagcaaaactcctcaagcatacatgtgtctacctcgtctgcctgttgggagccttgtctaatttcagataatggttagcattacgatggctactataaataaaccattcttactgctctcttccaaaacaaaactcagcatgatactttgagattgtgttctgagagatgatatgactacataaaatacaattaaaaatgttataatataatgaaaatgtagtaatttaagaaaacaccagatgagttaggaataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccaagatttagatgtttttaattaaacttttctcttcctttttttttcactaaagcatgtttattcccctaatccattaaagagcatgaaaaaaagaataaatgtatttgaaaattataatggccttgtgaaatagtcattataatgacaccatgcaaataatcatatccaacaataatacacataacctgcagtttttgaattataactttttattattttaaagcgctgacaactcattttagatcttcgataaactgattagttatgtagtgtatttctgtgtgcctgtaagaaaaataaaatatagaaaatggaaagaagatgatatgataatcatattagggaagaagtaatactttctaaggagagttcgtctttctaaaatgtataatcataatacaggcacatacatggttcaaaactgaaagacaataaaagagtattcaatgaaaggtaagtttccttccagctgcaacacctccaggtctactcctcagaaataatgttttcttgcataattttataaagatttccacaagaaacaaaaacttgcatataagtaactttttcttttttacacaaatacatatgtgtacatgctacatgtgcatttcaccagaatgtgtgtatttatacataaaatatgcatttttaagtacagaagataaacactattctgaactttgcttgtttaatttaaaattattgctggatgatcattccatatcagcacatatagctgtactgattctgaaaaccacatatcagtccatcacatggatgtacatttttttcatttacaccaaactgcaaagaatacccttgcttgaacatgaataagtttgtatacatgtgagagtacatgtattgataaaatcatgcaagtagaattctgggtcaaagattattattttgaattttaataaacattactaaattgcccttcaaagacagtgtaaccacttaaactttcaccaacagtgtgggaaagtacataattctctagaactttactaagatggtttagtatcaaatcttttcatcacttcatagcctatttctgaattaacatattaaaaaagagacaattaattgttttgtagtatattaacagagctttgcaaccatctgtctaattttaatccaggtaacctccatatgatcttaaaaaaggccaactggtttggtgctttaatccgctttttttttttttttttttttttttttgagacagactctcgctctgtggccaggctggagtgcagtggcgtgatttcggctcactgcaacttatgcctcccgggttcaggcgattctcctgcctctgcctctcaagtaactgggactacaagtgcgtgccaccacacccagctatttttctgtatttttagtagagacagggtttcactacgttggccaggatggtctcaatctcctgaagtcgtgatctgcatgccttggcctcccaaagtgttgggattaaaggcatgagccactgcgccgtgacctgtaattgtattttaacagtacctagacgaatgtttgaataaccggaaggcaggaatctcagagacctatctttaaaattctacctaacacaatctccaaatcctagtagtataagcaagtggtgatgcaccatagataatgaccttctttctctactcttaaatcctcctagaaacacataaaaaaatagtgatgatagtagtgggaataataaggaaacagtaacatttaatgaaagccttttattattgtttctctgggatggaatagtcatcctttgatgatgtctctatgtggacaaagaaatatacaatgtcactgacttttcaatttctgctgtgccaatgaggtagacaagtggatgatttggttttgattctcttgttatagtttaagaaaaagaattgcaatgattctttgaaaaattaagttattttaaacatgtagacatatttttagccaaaactatcttctaatgttacttttgcttgcctttgtgggaaatataaatgaaagtaataagggcgaaagaaaaatcatttgctatatcttattgtgtacgcattttaatgaggttaaatgattaacactgtcagtggacaaacttg

SEQ ID NO: 13796 - DNA, 41743 bp, Human
agtttagtatagtttagtaatgaaaagtggattaggcatgagaagacctggatattagtttctgctttgtttcttgccagctctgtgaacttgggcaagtcactgggcttcaattttctcatttgtaaaacagaaatagtaaatatgacttatcttgtctaactcaaaggattgttttgaaatatgtcaagacataataaaagcttgcatttacagagattttcacttataaggattaagttctgagttaagtgttttatatatattgccttatttaatctccactccaacactatgagttaggtaagaatttgtatccatttttcagatatggaaactgaaattcagagaggttaagcaagttgcctgagttcatatagcttactatcggggggaaggaacaagatctaaatcttaaccataatggttctgcttttataaaagtaaaattatctacataaaaaggcattatgtctttttttctcctcctcctcatttttcttcttctactttttctttaatacttccttttctctctctctgtcttgtaatgatggccataatttgtcatatacactttagtagggttaagttttgataaacagtaagccaggattggggcaaaacaccagtccgggtacggtccatagccaatcatttgattgtctttactaatttagcaaatgtatcttggtaacttagtatataccatggctattctgggtgcagggattctacaaacatgaacacaatgtcattcctcccttggagtaagacacgtacataaataattataatatgaggcaggagtgattatatgtcatcaaaaagagataaatgccatataaggagagttcagaaaggaaattaataaattccaagtaaaggggatcatggacttttgcaccaatgtccagggacaatagtgcttgcctttgtctaaactatcagaataactagatatgtggttattaaatgttaaggagatgcagagtagggtaaattgtttatctgagaggctgggcttaggaaataaggcaaactataacgtggtaacacgcctccccctccttagataccacttgagaatttaatttctctaagtttttttgaggaaaaagaatatttactgtggaagaatatactttgatggctggaggagggaaggaaggaggctggaggatgggagggggatcatctcatgtttcaaactgttgatttccagtttccacctggtaacagcctaggggccagagcataatgatacaagtcaaaacacagagacctacacagagacaactaacagcatccagcaagggaattataaaagctcaaaaaagatttccagtggctaaataaatacctttccttgtagttgcacttgtttttcttttcatttactgaaatttggaaagacacatagactctattgccttttcaaagttctagtttacataaaagtataatctatgaaaatcaaatttttcatatatagaggatgaaactatgttgtgatcaactacaggttatctatgtattttatttaaaaactggtggacagggagaaagattttaaactatgattaatgaaagtgatagatgacatacttttcatataaaaccatgactttctttcaggacactttagaaatatgtccaaaatatacagaaaaactccacagcatagtgcttgaatttacacaaacattccaaggcaagtaggaatccgaatgagtagtttcacataaggctactcatttatttttgcagtccacatttaaaacaactacaagattaatttcattccatttttctggacttacacatcccaaaagcaagaaaaaaatgtcattttggaagtataataaatgctacttgtaaacaaggctagaaagggtggagaatgaaatgagatggggggtggggaaacaaaccctttagttacaatatcttagggaaatgaatctacaataagacaaatttcaaatcaagttgctccactatactgcataagcagtttagaatcttaagcagatgcaaaaagaataaagcaaatgggaggaaaaaaaaggccgataaagtttctggctacaatacaagagacatatcattaccatatgatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggtatggttttcaataattgtcctgaactctgctacagactaataaaacttcggtcaagttgcgagcaaaagggattatttggtgagaaaaagaaaaggaaaaaaaaaactgttaaacttttatagtttttatgcaacattttaaacaagtattatttgaaaacagaagttaaatatttgataaaatgattgaatgcattgttttatttctttctcttctgtttttgcaaagatgcttcttaaaaaactgtaacctaacaccatgactctctatattaatgtttttgtgtttgtattaatgaatgtttagctcttcaagagatggtaaccgaaaagtattctgaagtagcatatctgtaattgacctatatatttaaaaaatgtatttttctcctgaatttttgattgctttaaggacttttaaaagcccagaagaactgaactctggtgattagctgaaaatacctaatgtatatttcttcaaccccagaaatgaacagaaattatcaccagagaagtgaaaataaacattgaaaatatttatgttattaaatgcctaagatactaaaaacgctgtataatttcttaaatgtaaagtgtcccagtcagtatcttcactgcaagtgaaattttaagatacattcactataaaatgaggatgtgggttaattttctaattttaaaacagggtaacacagtgaccactgattaagtgggctcccagtgatgtaaatacctgtggcttttttttttcctgttgctgtttctaaccagaaaagagccaaatgcctcctatagtaacccttgtttgtggataaatgccgcctttattctttattttaaaattacatatattataattgaagtttttaatcatctagtgctgtaggattttaattttgttttgcatttatagcttcacttatctcttgagggttaaattttgactttgaaagtgacaccagaggcatagataacataatgcaaatgttgatctggatgacatacttcatttaatgggcttaactagttttaggaaccagaaattattatttttggtaaaacatttgtaaactatggcaactagcttcagtggagtagtgatattacattagtaattagcatcttggacattgtcatgcatttttagactacttaaaacagtttcagtataatttaaacagcatatcatctcaataacaatctctttggttactacttggacagctgctctttgctctttatatttctgattaattaaggaaagaaggaaatgacgaaaggaattatcagtattgacagcccacattaaatgttttaagatgctgggtcttgaagtaccatgacactaatttaaaacagatgattttatggaagattttgcacaaagtttctggacatgcaattattttttcacagtacagtcagggttaaatgcacacacacacatacactctctctctgtcacacacacatgaacacacacacatacattctctctctctcacacacacacacacacgagcaaatgaaaatgaaataaaggtcggtgattgaagttataagctgcctgtctatattcagcttcaatcaaaaagaatattgtttggagaatttgtaccattttaacaggagtaaacaaacataaattataatactatttctctcagctaatactcaacattttctttttgtgggttgttagtgaaacaaccaggcatgttctgctctggagaaaagatttcaaagtgacatctgcattaactgtcgttgctatttattaaatctgcaatgactttgcttcatttttcttttaaacttgtaagacattaaatatgcaaggctagcaagcttgtggtaaaccataaacattgcatttttaatgggaaacagatacaaaaccactccctcagatacaatccaaaggaacaggctgccaaaacaaaagtcttctcttaaagggatactcagtaactgaatgagagtgggctgctagaagaagcttaatgttgaacttaaagtggcagtgtgaataataatctttatgatattttgttaaatgaaaagccacaagcctgtattcaacatgtgctgccttagacacatatcagtagtaaatataaactaagaacaaacatgtaagaaactgaaaaacatttgtttcttctctagagaatctaggcaaaaattcccagaagataccttaaggttagatcatacaaagatctttcttttctcttctcttctttctttctctctctctctctctttctttcactttcttcctttctttctttttctctttctttctttccttttctttcttccttctttctttctttcttccttccttctttctttcttcttttttttaatatgctacaattggataatgactcaaaacagctgtaagattctacttacgaacgtacagctttaatatggattcgtctaagtgtacaattcaaggtagagatgatgggactaaatatctgctatgatgggactaaatatctactatgttttggagatatcagaatggtttcaatgcaatttaaaaaatatttcatctcccaaatgactttgctgctatataatcaagtacttttgttattcagatttattacgattttgtcactcagatttatttagtgcacttcagttgatttaacaacatagattcgtgcttgtggaatgaatggataaatatggaatacatttatcaaaacaatacttgtttttttacaaaatgccctgttagcaaaatgagatcatatatacatcacataaaaatcagaattttccatatgtgtttattagcttattaaacataatgtttgagaaactaggaaattgatttattttttaaagccgatcttgcttataccaagttgaggttttcaatctgctttttttatatcagaaattcgatactgaaaaaaagctaattttgtgttttaaaaaatcagactgattgcttggaacaaatggaataaatcgtcttgtcaataaagtgatggtcaattgagtcatttgtgtgcaaaatattgtgcaaggcccgggtacagaacaaggaataataagacacgccctgaaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggtcggtattctacatggcaagtagctttgattgtcagggttcaggtgaggactgggaatggagtgacaatgaaaaggaatgtggctagagctattaattcataccaatttatgagtggtctgacatacagcacagggactgtggacagtattgataagccataggaagttaataaatggtttatagtagaaattaataagacaaaattgaatttttagacgatgactcaggcagcaaaatggaagatggactgaaatagaggaaatatgcaaggcagagatgaattagaagctcttgtagtagtttagggagagatgagaagggcctggatcaaaataattgtggtaggatggagagatgtgactggcttccagagatatttctgaagcagaaattggagatctcctatgtggatagagataattttatctgaccatgtgttaagtgagcattgaaaagcccaacatgatttattaccatgacaattttgcaaatgatttggatatatagtatatcatcttagtttagacccaaaattcaaacaagcagatttaaataatactcagatttctcatcctaagtaaatagctgtgcaaatgatactataatgtacctgattgtctttcaatacatttttaatgctctgcttcctgataacaaatgaaatattattttgcatcttttctctgtgctcactgtattgtggcatattatataagaaacgacacacagattaggcagtgctactcttcttaaatctctcatttgtttcctaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtgagtgggatgcagtttctctttacctaccttacttgttttattcttgggaatggcaactctgagagtttagcattttcagttttaatctctctaaatttgagagacagtgccacctaatgaggagtaaaggaagcagaacaggatagaaagaaaagtagcgttgttgttctctctttctctctctctctccctctctgtccctcttccttttttcctccattactttgcaatcttggacaaatcatttttaaaaatatttctgagctttatatcccttcttctacaaaataaaattttgaattaaaaaagtcttatgttctaaaatttcagagtaatggtttaatcttaattctataatatgcttttataaaatattagatattaagaaaatcaggtcagtctctctactattcacttagcccagacaacagagtttcaacattactaaattgtaaaataatcagttatcaaaagcaaaacacatcaaattttatgacaaaatcttatctttcaagtatcaaaatactcccttaatctctgagtcttagttttgtctttacttttgacattttgtaatccagctgcttatattctttagaaagtttcaaaggaaatatttatcactaaggtatggtgtaaatattcaatataattgtgttacatatatctttagcctaacaccctaaagacagtttgatttatcatcttttcagaaaaatttggtctggaaattccaagagcattacacttagaagataaatctccagaaagattgaagctcagtggatgggccaaaggggaatgaactcagtttacatggcagctcattcacattcctccttttgaaggggtgtattttcttactggagatgaaaagaaaaaaaaatctttatatcatgattccgccatgtgtacttccttctggaagaaattccatactatgatcaggcacttctttcagaagtcctatatttactcagaacatgctttctagcagtagtttgcagaagaaaaatgcaacttctacaattggaataaactgcctataggaacccagaaaaaatataaagtatattcagtagtaacgactgaaaaacacttgaaatagcttcttcaacacatatattgtatagctatttaaaacccaaatacaaatgttatatgaagactttcaaaaggccgcaggataattccaatggatctatttgttcagtcattcagaagctatatcgggaacccatcatggatgagctctgctctaggcatggggagaaaggatgaggaagacaaatatggccctagttcttgtggatcttatgttctagtggtggtgactattactttttgaattgtgtatttgccacaggggagattggattactcttcagaaattttataagcatctagagatgacctgcattattgccttgggcaggaaaataacagggttgaaaaaaatctgaacaaagaaatcaccatttgatggatatacacaggataatcttttctgaagttactaaaatggcgaagttcccaaaaaatgtaatgcgaattaaatttcactttgcctctgagaaaaagttaaaagaatttattattactctcgctacatgtattatcaaaaatgaagggttgatatttttaaggaaagaagagttggccagtcactttagtgaagttttattttttcgtaaatatagtttgcctttgcttccatgaaaaaatagctcataaaccttgaccctgatgaaagcactgggccagttttccaattctctgttatgtaaaaaggcataagtcaattgttcaaagtgaaacaacaacaacaacaacaaaatgtagtcttaggaagcagcaagttcactgacttgggatctttatgacagttttgttgttgccattgatattgttttgtttattttttgttttcagatgagaaagttttctacatgttatcttttttctaggagctcaaagtgtacatcattcctttattatagctaggtttactgactcatatactaaggaagtagctaaaattataaaaataatttgtttttaaaaccatatttaactaagggaactaagtaagttccaatgagcagtggtctcatgcaaggtattttcaatattttaaaatttacagatgaatatttaaatatattataaaagttttaatcagctatctctaagaaaatacatttcttaaagggaaatgaaattcacttgactttaaataaaacaaatgaactcatttcatgtttttaactattatctaactcttccttactttatgatgctggcaagctgttgagagccttgacatctccatctgcagaaaaatcacagtcttagaaatcctattaatcgtgtgaggtacctgggtcatagtagcagcttcatgcagtgttaaaattatatgatgattatatgcagtaacagatgaagaaaaaaagaaagaaagcaggagaaatgcaccacctcattcattgtaaatgcagtatagttgattttttaatttgttttatgtcctctagtgatctaagcatgaagcttgaattattataataaagaaaataaatgcaatgcagttggggatggcaaatgttaatgcttatctgtatcaaagactaacactgtcttcaggattatccttggtggattatccttggcagacacttaatgagcagagagaagctacaatgttgaaggacaaaagtcctttgtcatcttattatcgaaataatgtttaatacaaataaactttttaaattaaaatgtttgactactttttaccactaagaaatattcttggcaaagttaaacaacatcaaaattttaaacaattctttcaaagctaagaagtaaaaacctatgaaattaaaattatgtaattactctgcaggataatttgatgcctctggaaaaatgcatggactgttttagtccctaattctaatttatcacagtagtattaacacgtgcttttttttttttttaagaggatgagggattgagacagtaaacatgaattcctcatagatattggccaagttgtttcattgaacttgttgcaacttaccttgtaattggaaccacaattttatgagacccatatcttgtcttcttttatctatcatgttaagaaataaaccagttccctcttaattatagcatttatttcaaaaagcaatgttaaaaataaatgtagagttagcaaattcagaagtctttcagttactttataataataaatccacaatgtaactcattcttctaaaaatcaaaaaaatttaaaacgttctgattttgatgggattttctattttatatgcttggcatcctgaagaagacagcttcccttacttaggtactctttggcttagccattcatctttggatcaagtgtcaccaggtagtataatttggtatggacttaacacctcattactgaaatgcaaatcagtcctgacaagtcaaataagaacaagtattgtcttttgactagtctccaaaattaaaataataattcttgatgtatttcttataaacaaatttcagaagagttaaaatgcctcttaaaactatttaatagtggaaagaacttgggctgtgcagttaaacacctctgatctcaaattctgctttgctgtttactacctgtaaccttgaaactttcaaaactttgtttcctcatttgataaatggaaatatatcttatttcactgggtaagaatagaaaaatatatgcacaaatgtttattatagtaacttacatttcacttaccatttcaggcaaagttggctaagaacatgaggctgtttctgatatttccttttatttttatgtattaatgagaataataggtataggccatatacttattagagactctcaatgacttatacttattattctcaattcatattatatcatattatactcattgaaaataagccatatacttattagagacttatttagagtcttattagagacttattaagagtctctaataagtatatgggttgtcaagctagacacaaaatagtaccatctctctccacctctctaaagaggaccacatcatctccaaatgtaaatagacaagaacaaaaaaaattgtgcatttactaggcaattgaatgttctccaaaccaatattcctttgaacaaaatgagtttgtttgatttgagaacaatgaagtatttggctattttataatcataagtgattcatacccccacacacttagccctctagaaatggtgccagaagatgaaacacatttaattttgccatatagaagcattgcaaataactactggtttctaataatgtaccttataatgcaaataatgttttaatttttaaaaatatcagaaaaagtacaaccttttaaattatgtagttgcttcttcttcataatcatttttcttgaactggtgaaaaattttgtcagaagttaccacttgggacatattgtactacagcttctcgcttggctggagaaactggttttccagaagcagaccttatacaagaggtaaatgaaccattagacttctcccatgaaatcaacccagaaaaataaattaggactattttgtagaggaacagacagaatgctagaggctcagttgcctttatcatttatgtctggctctgcagcagcaggggtgtgaggtgctcctcattcagagtttcgaatgcaccaaaagggtgtttccaaaacatgatatgggaaggaggctgtgcacagagtatgaccactggattgcctaaattgacattgggtaggagtggagtatgggtgatcttcagatgaagcaagagtaatgctcaatgtgacctggttaaacaagtctcctgaatccaggggttaaagatggagaggaggaagagagggagtcaagaaggtcaaagggagcgtctgtctccctgacctgaatgacaactaacatagcccttgtttccttcttggtccccaggagggagagagaggcagctgtgtgggatcaaggcattttgtgagattgcagctgtgattcattttcctttggaagaacatccctagctccaggggatatggtgggaattggttagctaaaatatcaattccctgggtaaaagaggaaaaccatgagaccctctaatcttaacttttctccttcaaaagagtggaaaaagattacatagttcctcaaaaattaaaaaaaaaatgagtctgcaattcagtcttaataaaaagagaaagcccttagcatatatactgtaacagtaaagactcagttactcttgacttagtctgtggactgctttaacttctgtagcttgcctacttctgccttttttactgtaatctacatttgctttgattattctataataatcaattatatatacatatctgtgattatacaatatcttttatctttttatatatctattttattttttttcactagaaaagaagtattgcaataatttatcttcgtacaacctctacacaacaaactgccttatactttgtagactctttacacatcactgaacgattgatgaatgaatacacgaacatatgcatggcttggttcttgaattaatgcttggatgaatattctacaatattcttgactctagcaagctgcaaagagaagggaacatgcctgattgagaaacaaaagtgatttctcagtgcatccttgctccttccctttaaggacaactgtaaaaccaggaagcttagaaattccttgagtttgactggaaagagaatagaattaaagagaagaatcatctatgtatgaagcctggtctaactgataacgcagtcagattgccatttttaagatggaaaaaggggaacatgcttgccttgagcagaaaagtttttggtggggctggagctcctaaatattattttggtcatttgcccaaaaactgaagtacaccaccaatgtcccaattatgaagttgaatacagaattataaaaaaaaattgttgaaagtcaataagaataaatcttagaatttggactcctgccacatggcagaaaaaaagcatgatgttttaagacaacctggcctttgtccaacatgatgtttaccagattgctgacattttctagcataacaatactattcatcattgggataaccaaaagaagggaaataaaaaaaaaaagaagtctatttcttactagtctttattcagaaatgatttttttggtaatatcttaagtagtatcttatttgctttaataaataacttgattttaaagaagataaacctccttacaaaaactgggagagcaaatgtctaatccaggctaccttgaaaatagtgtgttttagtggaaaatttagaattatgttaaataaggctgctcaatgaaaaataaatgtaggaaaccactatgctcctgttactacagctgagtgaattttaccccaaaacatggtggcttaaaaaaaaatttaatttgctcacaacttgaggtatggaaaatttgggaagggctctgaagggctgttctcacttggggtcactcttgcatttgtagtcaaatgttacccgggatttataatcttaagaaggctagcctgggctggacacctgttcactctcataactgacagttgctgctgctgtcgcccacaagcttggctgttgtatcctctggattgcctcagacagcctctcttttttcctatggcccctggctgtcccagagcaagcatcccagaattgggtagcagctgtacaaccttttctgacctagtctcaaatgttatggtgtttcaggctattgattcctagaggcatcacaaggccatcctgaattcaaagggaagagagaggaattagatgctacctcctaatggtattgggataaatgcatattgtagaagagcatgcaggatagaaaatttaatgtatgccatctttgaaaaatataatcatctacatatttacttacatttatatacatttctaatgagaagtttgagcataattatgtattatgtagagaaagcccacagatattacatgtcccccatgaaggtcattatttaatgattacaaactacattaagatgttaaataattataattaaattaatttacaaattaacttcatagttacttaattcttctacttaagattgtgagaaaagtattaagtcgtaccttaatgactttgttttcattatggaacattttttggacataaattgaacctggctaattgatacatataatttaaaatgctaacattttactttttatatcattttatgaataaccataaaattcatcagtatcaataggaattatttagttaaaaatcacatacaattaatacaatcataggcttaaaggcagaatttaaatttgtttatttaaaagttaaaaaaattaaggtaggataactgtttcatagaatactatctgtttttatattttttgaagattaggtttagttcaaataagctttttgcaattatcaaaaataatctctggtcctcgtgtatttctaccacaatttacttccggcttggtgttttcagatgaggaaatggagcctgaggaatgctaacttacagattccggtcatctctccttaacagccaagttgattttaacccgagccattctgactctaatgatgtacaaacaaagagtaatattttatagatttgcaaaagagtgtagcatttgctaccattaaaatagggttaaattgaccaggagcagtttttgaggagtctaattactcattggggatcatgtgcttcctaaactgaaggcttatccaaaagccctgaacttggtagacaagcaccccaaaggccctgaacttcatgggaacaatgatgaatgcagaaagaccaggaaataactgtcaagacaaaaacatttcaggaccaagatctttagatgaacaccttgtgcttgacatacctgaaaaacagatttcagcctctaggataatatgcatagtaattgtacagaaaagaaagagttacagatgaataatcagaaagattattcagaaggataatgagagcaacaccctctattttgcttattaataataatcataggtagcaatacttgagacgctgctatgcactatggtaggagattattttgtagcatagcttattgaattctcacaaaaattctgtgaaagacttaagaaaactgaggacagagggtttaaacaatatgtcttctaattttctttttcttttttttttttttttagacagagtcttgctctgtcacccaggctggagtgcagtggcgcgatctcggctcactgcaagctccgcctcccgggttcacgccattctcctgcctcagcctcctgagtagctgggactacaggcacccaccaccacgcccggctaattttttgtatttttcagtagagacggggtttcaccgtgttagccaggatggtctcgatctcctgatctcgtgatccacccgcctcggcttcccaaagtgctgggattacaggcgtgagtcaccgcgcccggcctcaatatgtcttctaatcttaaagataaagaagaggaaccagaattgaaattcacataacagtcttataaaaaaatgttattataggagcatgtttaaatatgaaaattctgcagaataaaatgaccccattgggtacccaccacagagcttcaaccagtgtcaactaatgccgttatttttctatctccacccacttccatatcattttgaagcaaattccagatatatgattttatctaacaatacacttaccagtatgtttctctgaaaaataaagctctcaaataaaatagccatagtttatagcttatttatatgagtcaggatccagatgaagtacatacattgctttttttaaaaatagcttctgttttttggtttttttttttttttttttttttgacaggatctccccctgttgcctaggctggagtgcagtggcatgatcacagctcactgtagcctcaacctccccaggctcaggggatcctccttcccgagtagatgggactacaggcttgtgccaccatgctcagctaattttttgtaaagatggggtcttgctatgttgcccaggctggtcttgaactcagaggctcaagcaatccacctgtctgagattccaaaagttctggaattagaggcaagagccacagcacccagctaaaacatctcttaactctcctttacactacagattcacaatttcttcattttcttttggaatttagaggattaatcagattcaggattaattgtttgtttttgaaaatacaaatctatgaatggggatttgtttcttcatttagaagcttctaactgatgcttttccaggagaaatatatgccatgtagagaaactcttactgctggagtagtcactctattagacagaaaaatcagtcttcttgagatatgtatgtgacaaaaggtgcttcacaaatatggcaaagacactgaagaaagtaagagcaattttcaggtgcagataatgggaatgacatatttgatagtaagtagcattcatttataaaatattcctggaaacaggaaaaaatataattattataaccagttgtatcctaatacttctgaggaaaataaaaactcctatgatagcaggttatagggagatggttataacagaacatggcagaaatgatctcaaagccatactcataaacttttcatcatgggacagcaaggcagatagactttaaaattaattaatcagaaaggcacttcttgttttcaaagcagccagagcaaaatgctgatgagaaacagtaattagtcctccttactcaggaaaaaaataaataaactaacaaaacaaacaaagaccctgaaatgcaggacagtatagtttaaacttatacatctatggcctgtaagaagtttagaggtgcaagattactgttatacaggggtggtcagcatgaatattacagaggagagggataacggatatgcttcaagggattgttagaatggaaatagaaataaatgaataagtggagttttacataaaatatgcattgcatgaacaaaaattgagtagctaggaatgagtgtaatatgctcacggaatagctgtagatcagcattagaaaatatgcacaatgatcacatgcataaatggcacaccacggctaggcacggtggctcacacctgtaatcccagcactttgggaggccgaggctggtggatcatgaggtcaggagatcgagaccatcctggctaacacggtgaaactccatctttactaaaaatacaaaaaattagccaggcactggtggcaaacgcctgtagtcccagctactgaggcaggagaatcgcttgaatcgggaggcggaggttaaagtgagctgagatgatgccattgcattccaggctgagcgacagagcaagactcttgtctcaaacaaaaaaacaaaaacaaaaacaaaaacaaaaaacatagttctggagtgaggactcaaactatcctggttcttgatctactttagccatgaggcaccttagataagctatttaacttctttgggtttctgtttccttacctatgaaatgagaagattagactgccttaaaattctctgatttctgggataagtaaaattttgaatgttgaacgagttaatttctcattaaagtcaataccaaacctaacaaaagaagagcctgccatctgctatcataatcattttttaaagaaggtgtatttaaaagtagaaatggaagtgaaggcaggaaatggtctcagatggtctcagaaattgtgtgtgtgtgtgtgtgtgtgtgtgtctgtctgtctgtgtgtgtgtgtctgagataatttacattaaaactaaccacactgcttttattgttttttttttattttgatatggattgctaaaaacctcatcatagagtctacctaatcagcatttgggaaccatagattagctgatatttaaggacccttccctttgtgacattcagagaactcataataactagagtaaattcttcattatactctgtctcttgtctttgagcaagctagttaacactccaatgccttatctaccccttacaggtacagcatattactgggtctgatgtcagaacaattatttcaggggatacagataggtatgccagaaaaaaaagtcatgctggaagccaggagagttgtcatctaatccacattttgtcattcctaactagataagcttgttcatgttatgaaactttttaaaataattgaaagtatgagattaccatactgccttacctatctcattgggttattgtaaggtaaataataacatattttcatttttaaaaataaactctaaaactaaattattaataaaaaatatgtgaaatccccccaataaacataaatttactaattcagagcaggttgtagaactataattttaatcattgaaatgactctccaagaactaaactacaagaattagaatcctgaggatggtattccttttttctgaatctctagaaataagatgtatataaattaccttaagtagttcctagtgttataaaattttaggatgacaacataagtgaaagtgtcagccatccagacacatcattctttccctacacatttgaaattttatctgcagtttcgcattgacaaaatgttgagagtcactagaatttaagttcgccaatgaataaaagcaagcgtaagtggaaattaggactgtgatgaaggtgcccaagaaggaatgataaaatgtagtaactacgttccaaatgaaaagaagtttgtcttttctgggttggagaacaccaattaacaaagatttggcagaaatctaccattcctaattgcatgaaattagcaaattgacatttccgaaaatggcagtgattacaactgtacagtgtcattaagcaacctcctacaaggtagctgttctggtgttttaccgttcatcactgaaaacacttaactcttgttatttctatgggaactgtgtctataagagttacacatttatgtaacatatttatgtaagttcagaattacttgtattttgatacttaaacttataaagataggtggtcactgaattaagaacaagattccacctgcaaccccaactatcaatggagcagtgatattataaataaaaaaatatttggaaaagactcagaaataggtagcttcaggtacgttttctgtaactttcatggaagaaatgaagacagtcaaagtatggctaccatggtggtttacaagtatgtttacataaaactcaaaattgaaaagtgattttctcgacatagcggttattataccctgttgtaattttattttaattgaaaacagtaaactgaattatatttttatgaagtcacgggcaatatctgccttggtcctgctatattcccaggatctaataaattcatggtgcccaagaggtattcaataaaggcttgttgaatttatgaaaaaataatcttcagtacttcaagtttcagatatgatggagagattgcttctaccaaaggctaaaaaatatttctgatttgtgttatgcagtcttaaaatacagaaatgatcacattaatttgagttaatagaatatcaaatttttacttgatgtcctacttcaatatgaaacaatgaaaaaaagaaaggcaaaaggccttatttaataattttctctattatgattcatgatgatttattcaaaaataactgccttttgtataattctggttcatccttatatgactagctgaatgactactaaaatattttttaataccaggaccatttggtaattcaatgaatttacatttacaaactaaaaacaataatacactcagctagaccaaaatctaaagtccaaaagtaatgcttcataaaattaatttcagatatgtcatactacccaatttatttcattctaactagccatatatctattggtcataaaatatcaactgaaatggatattgttttggcattccaatgaaaactaaaagaaccgttatcccaaaatgttggataaattttcaagatcctgccacaagttgattatatgtttatatgattttaactgtagatctgtgacagggttaggtgtatcaaaaagatctttattactgatgatttggctagagtaattattgacacggtatttatgtaaaaatgtataaatttgccaatcactcgtgctgactacttatcaaaataactacttttcaatacaacaacaaagaggtaaaacatatagatttgagccacaccctaatgcaacacaaatgttcccctaatgcagaggaataattccatgaggaaaatatcatgttgagtttattattaaatacaaaaagtcatttgacttggttgcaaaagataaagcaaaaattttaccctacaatgaatgtaattcttagaagaagaaaaatatgttgttactgttaagatgatcatcataacattaatttcttggtaaatatatgctgtgtgattctgtagccacatgtcctttctactcacagcacactcctattactcttatgctaggtctggacaaagtgccaaaggatcttccccctgacacaactctgctagacctgcaaaacaacaaaataaccgaaatcaaagatggagactttaagaacctgaagaaccttcacgtaagaactatttttttttaactcacaataagataagactcaaggtatttttcaaaacactacctagataaggccaagagtactatgtaccaacaaagaagcacattagtgtttattaacttcaccttttttttttttttttactttttttttattaattctgccccaaacactgtttttctttttctttttttttttttttttgaattatgcttcttttttttttaattttttttttattatactctaagttttagggtacatgtgcacattgtgcaggttagttacatatgtatacatgtgccatgctggtgcgctgcacccactaacgtgtcatctagcattaggtatatctcccaatgctatcccttccccttcccccgaccccaccacagtccccagagtgtgatattccccttcctgtgtccatgtgatctcattgttcaattcccacgtatgagtgagaatatgcggtgtttggttttttgttcttgcgatagtttacctttttagcagtggtagggaagcaaagcatcatatttattaaccactaacaatttacctgacttttttaatacatataccccatatatcttaggtattttcttcataaaaatactttagatcttaattctctctcacgttttcaggaataaaaattgtctttcaaattaaattgtattttaatagtggaacaaaacacaaaatggattgatcctagtattattttatttctttgtttcttttgtttgttttcatgcattttctaagagaggtgtgaatgatgttctaaagtctcaaagattggaatcaagtgaaaaaaagataattattcatatttcatttagcgaaatataattctatcttcatatatatgtttcttgctttatctttaggattatgcatgctgtgtccttatctgtatgtttattttgattttctcttatctctctactctatcataatgttcagtctatcagtcaggatttcatcagaaaagagatgccactcacaaaggggtttcatggaggagactttattgaaacctctatttgcaaaggggcatgggaacccaacaaggcactgtgaagcacccagtcccacaaaggtctagaagaatttgagggtctcagagccatgggagagctgggtagttccacctcttaatttcctgcctgtgtcttgtgtggttgcatctacttcagaccaaaagacaagggcatttgattaatgcattccccagaggtcagcttcccaggacttgaagaagggccaaaaaagggcaaagaatgaatattgtggtagttgggagagaatatgctatacaagggaaatgaccaacccaataaaatagaggtaagccttgctaagagaaccttctgtaacagtaaatgcattgtttgttcacacagaacaccagaatcactataaaatgcattttctcacccagttctctatctgtagaatgagtgtgatgtggtcttccatcaaaatatgagtgcacattaaatataaataaggcagacttcaatgtccaaaatatatactctggaaatctcactgtgtctacttccattctggtagaccactctgaagcattgagtctggttcttggcattttaagaaaggcattcaagaacatctagagaaggatgaccatggagataaagaatctggaaattaggtctcataggcaccgtggatggagaggtggatgtctaaactcagtgttgagggtcactagtggcacatttgaagggccatgttgaagaaaaagaatggtatttacttgtttcaactacaagatgacagaatcctcctagtgagtagaagttttacagaagcagatttttattcaatattaaaaataaaaattaaagaatcagaattttcagacaatacagagacttacctagtgatttgttacctgcctgtggagattagagttcacagcttcgtataatgaatgtcataggaatacattcttaatgttgggagcataaacataccaaactctaatttcatatctacttatttattctagtcattatagaaaataattgaggaagatatgtcatgagaataggcactacttactaaagtataaatataaatcatctgatatacattagaataaaaatatagatacaaaggaaataatataaaatagaataaactggtcataattattacagagttactataatgaagataccatttagttataaactttacaatagccaagatgggaaaagcagtaaacatttagccattagaagaaaatataccagatttttttaaaggaagaaaaatttttttctaaaattttaagactctacaaggaaccattttaaaaaatgcagaaaggccgggtgcagtggctcatgcctgtaatcccaggactttgggaggtcaaggcgggtggatcacaaggttaagagatcaagaccatcctggccaacatggtgaaaccctgtctctactgaaaataaaaaaattagctgggcatggtggcgcgctcctgtagtcccagctactcgggagtctgaggcaggagaatcgcttgaacccaggatggggaggttgcagtgagtcgagatcacgccactgcactgcagccctggtgacagagtgagactccatctcaaaaaaaaaaaaaaattggtagataaaacagtgccatgatcaatttattgacgtgtccaacaatataagcacaatatgatatgagtagtgagtgttatggacttaaagtaaaagaaaaaattaggcatcattatttatccaattaccagacacagttttgagagaatatgcgaggaaggagttttagacgatcagcagaagtttgaaggactttctgtacaagaagaaagcaaaggcagaagaaaataagaaacagacaaataaaaatacgagttggctagagtgaaagaaacagctgaagcaatggaggataaggacaagctggaggttccgacctttgggtctctttccgctgatgagaaccttattcaccaactccccctcacttcaccttaaggtttcaccgggaatgagctgatggggaaaccagcaaggttttcagtgactatttaagctactgttggcataagtttaaaaaggagaccataaaaaatgaatattattaaatttagattactaaaatatttttaaaacttttatttggataagtttgccttatagctactgttttaaaggatgaaacattcttactgtcatctcaacttcctgtacatttaagtatacttggaatattttttaaaaaaaccctttatatccttaagtaagtgacatctagtgtccatgacattctcattaaatctggcatttgtaataatgtgttgtttcttttcctaagactccttctgtttttaggcagccatcatcttgacaatctctttctttctacttcaaagtatacatcagatgaataaagagagttcattagagccttcaaccattcagaggatgttaagcagctatttttctcttactgtttcattcatgatcctttctatccttgttattttgcaaataaacatcataatttcacctagcaaagccacacttaaggaaggagagaaatgaaaatttagcaaggattaaaatagaaagaatttaacagaatcatgttccctgtatgtgcttcattatgagtggtgtgtgttacataagagtaattttatacctatatatagtgggaaaaactatataattgttctataaaataatggaaaattaagtgtggtaatgacaacatttaatatattttctttgaattgaagcttaataagttgagtaaggaaaatttttttaattaaaaatcagcaaaaattgtcaaagactgaacaaaagcaaacacttgtttagcaattactatatatactaggcactattcttagtaccttatatacattaacttatttaattcttataactattcttatgaggtagtcacacttgatatctcctttaaatgggcacagaaaggttaagttacatgctcatagtcacaggccaaataagacccagagcttgagattctaaactcagaattctggcttgagtatgtgcactaataattgcctataaatgtaacagtcaccaaaaaagcctttagaacaatatttggtacagtgtaagacctacataaatggctttggagaaaaaaatcatattaaaagtcaggttttaaaaacatttaacataatacagatttttcagatcatgtttaatacatctaattatatcacactttcaaaatggtcttctatggataggaattgaatatctcctttgcgattttcattaggcatccacaattttggatgtcttgtaatgatatatgtcacctcactccactcagctggctctggcttttccctgattttttgtttgttaatgtcaatttttttatgaccttaactcccacaagtttttgaacttttgattattaatcgcagtgtgttagaattgtgtatcaatcaaccaatgcatctttcaggattagttaaatgattatgttacttaataagaagttttaattcatcgagtaatgtgaactatatgaggatatacatatattaattaatcagctattacctttagaaaacattcttgcatttctgagactaaaaatactcgctttcctattataggtccccttttgcccctccacattttcatatatgcgaaacatatactataattgaaaatgcaaaattagaccttaataagttattttaagttccttataattagttaataaagtggcttgaaataataaaaccatgtggttttgttagacatacagataattgaaaaagaataaaatagtccaaaaataggcctagcaattgttataagcataataataatgaattagaggtaatttcttatataaggagaactcagaaataaaaatcaaataattacccaaaatattaacgtatttgtcatataaaacctttacacataaaaaaaggcaaaaaaaaatcaggagaaaaatatgttaaggctctctgtgtcatattgaccatatctttattttctaaatcaattattaacctatattaaaatttaataaacatgagaagtattggtgatcaagcaatctcctctctccaaaaaatacaataaatggtaggaaaataaaaaaaaaatagtttaacctttttaaatgacaaggaaatacaaagaaaagcaatgagctacaacatgatattattttggccatactcttaagaaacataatatcaaatattgcaaggctacgggaaaattttagttccttgcattgctggtgatagcataaattggtatcatccttttgtagcggaatccatgttcatgatcaatgaagatggacttttaagttaaaaagctgactgcgggatggatgtctgtggcattgattattttcaggtatctagggtcatttcaattgttagcagtatttattatttaaaaattacatagatatatacacgtacatatacatacatacatgtctgtgtgtgtagagtgcatgtatgtttatgtatatattatatatcttattacatttcccttctcttcattcctgattttcaggtcctcatattataactttttttttttttgagacaatctttcccagtcaccaaggctggagtgcagtcgtgtgatctcagctcactgcaacctctgcctcccaggttcaagtgatcctcctgtctcagcctcccaagtagccgggactaccggcacccaccaccacgcccagctaatttttgtatttttgatacagacgggatttcgccatgctggccaggcttgtctcgaactcctggcctcaagtgatcctcccacctcagcctcccaaagtgctgggattacaggcatgagccaccgcacctggcctatacacttcttaagtaaagaaataatacttacttaatttttttctgatttcttgcaattttttagatttctctgctatccctatgaatggaatgaacaaacatgcccttgttttacatgtatgtggaaggttttggatttaaagagatgtttttcttcactatctacaggcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcataggtacagacatttttataactttaagaccaaaactcaagtttttatcttaagagatttcaactgggttttaagtgcaggaaggtaaattagctacaagctacatgcctggagcctatgtgatttataagaacagggccaagagaaattgggattttgaatctggaccttacagtgatgtttttatgtatgtccttgagtatctgagaatatggagaaaaccctagggctgaagttaccctaccacacacacaatatgcaaagatgagtttaaatagtgcttaactacagatattttgagatacctttccgttttggggacctgttgtattctaaacactcataaatcatttgctttaaaaatatgttatggctgggcgcggtggctcatgcctgtaatcccagcactttgggaggccgaagcaggcggatcacgaggtcaggagatcgagaccatcctggctaacatggtgaaaccccatctctactaaaaatacaaaaaattagccgggcgtggtggtgggggcctgtagtaccagctactcgggaggctgaggcaggagaatggcgtgaacccgggaggcggagcttgcagtgagccgagatggccccactgcactccagcctgggtgacagagtgagactacgtctcaaaaaaaaaaaaatttctctaaacatatagtaaaaattgtaattttattattggcttataaaatgctagattgaaattctttaacaaaattttaaaataccttaggaaaataataaataacgtaagatgggaattgtaaacttgctttagttgatttctgggcaaacctgtgtatgcatcttaaataattttattggtattgctttcactaatagtctttttcataagtcattattattcataagtcattgtctgtttggcttttgttttaataagggaaatttttatcctattttgctattctcctgaggagcatgctctttaacttcacttttgttttttagtcaagttgatattaatccctatttctttataggttgcttgctgaaacagatactacagtgactagtaatatcctaaaatttcctctaaaagccttgcacttattacatttgtagaactgggcaccaatccgctgaagagctcaggaattgaaaatggggctttccagggaatgaagaagctctcctacatccgcattgctgataccaatatcaccagcattcctcaaggtgatagaagattctccaaaacattttgaaaaatttaaattcaaaggctttaattaaaaaaaaaaaatcttgtggaaactggaattgtcacctaagaggccaaccttatttccagcaaattctctattactgctagtgtttcatccagtgtttatatttccagcaaattctctattactgctagtgttatatccagtgattcagtctggatgaccacggggccatccaggctcactgtagagatgggtagactcctgttaatgtctagtttaagacacaacttaatgcacagtgattttataatattgtaaaatcacaaagaaaaagtacatttatttaaaaaatagcatgccttggtgtttgtaaaaaaaaaaaaaaagatatatgggagtacctctgaaattgatccaatttttaccttgagtctgcaatagcttagggaatttttttttcctttttaagacactccagttattaatatctgaatgatagtggtagttgtgtgttgtgaagagtgtagattttggagtcagtttgcttgagcccaaattaccataaagtggttcaaagactttgaaaaagttattcatttgtcctctatctctttatctgtcaagtggaaataatactgctatccacttcattgagttgttttaaagttaaataaataattagagaaatatttagcatatagataagtagggaattaatataactctctattatgcattaaaaatgttctgaacaatcagtatgtgtaggcgatgtaccaaacacttaagacagggcagggaacaggatatgctacatgcctttaggagcttactctctaaaaccaagccagacaaatacacagcaatgaccacatagccacaagggtaagttcattgttccaagggattcccaggagaggcacaaaagccagtctttgtgaattacaaaaggcatcaaaccaccaataataaattcctctaacttgcacatcgtccctactctgggtttttcagtctcacagaagccctctatattatctagttttcccctcagtctgtccctttctcaacttagatgccttgttcttgagtgcgtacaaaatgtagacatttggccacagaaaacaccagttgtcctttattgttcttttacagaaatttcaactcctgagagtacatattccataggatgctttcttaccaccccttgccctcctcctagtcttttgaatacagagcatgcttttgacttccttagtagcaactactggcatagatagatacatagatgataaagactgatttataattcataaagcactttcatgttgagtctccaattttttgcatgtaacaagtaatcttttgctatccccagtgcaggaatgaaatatttatatctcagatagatataaattggggattgatatagatagatagatagatagatagatagatagatagatcttattaaaattcttgctgaaatttatttcatgcagccagatgacttacatttagcacaatctcagactttgctgtccctcttaatgcatgctccaaaatatccttcactgataccttttatcatttcatgatctcttttcctttactttgctatgtcttctatctatcccaggtattctttcctcatcatttatagcttgcttttatttactaccgcttaatagaaaagttaagtaactacaatttattaagcatgtatttagttccgggtatcatgccaaatgcttgtcatggagtcttctatatgattcttacaacgtccctatatagtagggttataattcctgtttcataaaagtggaaaatgaggcttaaacaggtaaagaaaattgtaattaagttcttagagctaggaagcggcagagatggaattgtgtggtgctgatgtcagaactcgtgtgtttaactatttcactctgttggcatattaagtcctcctttctattcatcgttatgcttatctaatacatgattccaccttgcttaggctgggatacctatgcctgaatatcagcaacctcctggtgatattttctcccatcactcatggaaatggaaaggcagtagaaagtagtgtagagactataaaaatcatacacttagatcaacctgggtgagagacctaactcagtcatttagttgtactgtgactttaggataattattctgcatttctataacctcaggtttgttagatgttacatggagctattaataaccctgtctactaggattattgtgaggattactctatagaagtaaggcttgtattgtacacgcaagtacttggcccaatgtaaacctcaatatattttatcttaaaaaaggaaaagaaaaaagaaaatttaaaataaatgaacaaacaaataaataaaataactggagtatgggttctttaactcaatgccacagttgcagaagctaatgatgcactttacaaatttgtctatctcaaacctattgcaaggttttctcccatagtcaaacttcttcttagctataactttacatttgggaaactgacatcccaaaaagggagacactttgaaactaagtaaggccgatggttgtgatagcaattggtgtactggaggcactgcattaaaaaatatacattttgcattactttgtaattactttgtaactttgagtcttatttatttaactgtgaaaagggattagtgaccaataatttatgttttgagaggcttaaaggatttgaagtaggaaaagtgccaaggtcaatgttcggtgcgtaacagacatacaataaatagatgttccttttcctagcagctctaacacaaaatatgctaccataggaaactaagaatcattttcaagtcaaatatggactaaactattttattaaatggacaatattgacagaattcagtgtgatgtgataaaaattttagacaaaatgaaacctgtggtttttcaattctgtgtctttatagacaaatagccaagactttctgccaatcagatgttctttctacacttaaccaatttgctattttctctgtatctattgctattaagtggaacaatatgttattttaaaagctgtataaaatataatacagcctcagatgctaggaggaaatgaaaataaaatatttaaacttttatatttataatactcgatctttggaaatcacagccatgcaagtactatctagaggtttagtgggtactttggatgtaaaattattaccccaggtgctccacatatggcagatcacttgattatagacctctccactccttctgcataaacattctggatttaataggcataagtaaatgttagctgtttctacacagacattttgcagaggtatttgatgcttttatggaaaagtcaattaaggctaagaccagcacagtatatcagtgttaatttttaatgatgctcattaatgaaatagacaattaagtttgtacatgggtttaatttatacgtaatctcttcattatggttcgaatagtgactttcccactttataattactatcttttatcaacgtcagttttagcccattaacaaaggtggaagagaataatgagactcagcgttgacttcagttcttctattccaagaacaaaaattgactacatgatagaaatcatccaggtttttgttaaagtcaacctaagagaaaaatagcaagggcttccactacttccaaaagcacacattattataaaagggatgaaaaaaaaagataaaagtaaagctgattctttgaaactgtgtgtcttttagaaaattgatggcatatgtcttctttaagtttgtccacattctgtacttataatgtttatctgctaatttaacatctttaattccacattccaggtcttcctccttcccttacggaattacatcttgatggcaacaaaatcagcagagttgatgcagctagcctgaaaggactgaataatttggctaagtaataatattctttcatgacattctatcagaacaatggctaggtatattagtgcttatatgataagaattataaacatgatgattgatttttgagtgtactacatttcactgctgttgttgtttctataatctcaaacttcagcatatccaattatttcttgagaagaagccaatgaaatagtgcccttactaaaaccaccaagatcagcttcatattttattaatactatactgtttatagattagttatattttatacacaaagtgtgtgattaaatcaatatgtgcatttaatatgttctaacttatttgcatcaaacagaaagttaagtaaattataacacagttgctagaatttgaaaatccattaaaatgaaatctaccaagacagagaaatattgagcatcacacaaattactattttaataattatgagattctctaaccccctcttctctgaaaagtttaaaataaaatatctctgggcatttaatgtagatcaacaaaagaaaagcttttgttgttgttgtttttgctggcccttcttaatgattttttttaaaataagtgatactagtacttgtcctggtttcaaacataacttcaatctggcaaacgttttcacttgtcttcaaggaacactatgttctttttgatctgtacatattgctgactgtccctacagagaagcacactatcatgccagatttactcattcctgttgttatatataaatttcatggtggataaataaatataaaatatatctttgaatgtgtatatatatatatatgcatgtgtgtgtgtataatcaactcctttactaggtaaaatattctttgatgggaaaagtggtttttgatccatgagacctctgtccctcacaatgcctagcataatatcatgcacataagttttcaagaatatttgtttattaaatatacaaataaatgtttgaataagtgaacagtttttaaaaataaactattaggaatattatgttccaatattatggttgaccataatttgatgttggaacttaggatattataaggaataggagactatgtccaatcacgttctgtcagatgaatctcaaagacagtaactttgagccgagaccttaacaataaatggactttgtccaggctcagagaggttggagaaagcactccaagaactgggaagagtaagtgcaaaaacaaaaaatgtcctttcctatagacttgattaactacacaatgcttgtaagaaaggcatccatgtgtggtgtttgctttcatttctgctttctgttgcaggttgggattgagtttcaacagcatctctgctgttgacaatggctctctggccaacacgcctcatctgagggagcttcacttggacaacaacaagcttaccagagtacctggtgggctggcagagcataagtacatccaggtaatgcaaagccactgcttatgtgaggaatatccaaaaagcaagacccccaccctgcttatgggatgctgggaagcaggaagctcttcttagaagttttttttccagagtgtcttagttagaatttctatgacaaaataccataaaaaaaattaaatcatgaagcacaatttacattagctagatttcaataaagtttttgatttagaagtatggagatgaaacttaaagtcttctgtaatgctgatatttttttcagtaggggtggtgatgttggtgccatagtgagtagggggagtttgaagccacaagtaaaataaaaattctttttttttactgtcactaattttaattttcaaattattcaagaattgactggaaagagcttctttggtctagctcctgattctttttgacatggcctcatcatttttctttatttcctctaaaaaaaaaatgagatacgtttgcagaatgtgcaggtttgttatataggtatacgtgtgccatggtggtttgctggccctactgacccatcctctaagttcgcccgctcaccccctaccccctgttgtgtgttttgttaccctctctgtgtccgtgtgttctcagcattcaacttccatttatgcgtgagaacatgcagtatttggttttctgttcctgtgttagtttgctgaggatgatggcttctagtttcatccatgtccttgtaaaggacatgatcccattcctttttatggctgcatagtattccacggtgtatatgtaccacatttcctttatccagtctatcattgatgtgcatttggattggttccatgtttttgctattgtaaaatagtgctgcaataaacattatgtgtgcatatgtctttatagtagaatgatttatatttctttgggtatatacccagtaatgggattgctgggtcaaatggtatttctggttctacatccttgaggaattgctacactgtctttcacaatggttgaactaatttatgctctcaccaacaatgtaaaagcactcctatttctccacagcctcatcagcatctactgtttcctgactttttaataatcaccatactgactggcatgagataatatctcatctccagccacagggaatcattaatctattttatcatttttgtttgtttcatagaccatagttttgtgtagattccaggaatactttaacatctagaaattttataattttaactcctgtatttggttttataatctaattttgagataatcctagtatatgatatgagtctaattcattttctgtatgtgatagcaattgtcccaatgtcatttgttggaaataatattctttctccaatgaattgtcttgtcactgttgaaaatcactcgatcataaatgtaagggtttatttctggactttcaattctattacatttatctatatgtctagtcatatgacagtattatacccttcaattactgtagcttttgattacgttttgaaattagaaaatgtaggttctccaactttgttcttttttttcaaagttattttggctattctggttcctttgcattccatatcaattttaggatctactttttcatttctggaaaaatattcttgtaaggctttgaaaggtattgttttgaatctacagatcattgggaagaattactatcttaataatattgagccttccaagtcacaaacaagggttatttatatcttcttttctttttctcaacagtttttgtcatttttagcatacatgccttgcaattcttttactacattcattgtttttcattctttttgatgctgttttgaattgttaatttttttatttgtttgctgctaatgtataaacatacaattgatgtttatatattgagctatcctggtactatgccaaatttgtttttagttgcagtaatttttgtgagttcctttggatattctatattcaggatatattatttaaaaatagacagctttagttattttatttggattcttttaggtctccccctcccccacaacccaccctttgcattggctggaatcgccagtgcaatgttgaacaaaggtgatgaaattagacatctttgccttatttgctagtttaggaggagggagcattcattttaccattagttacgatgttagccacaggtcttctatagatgctctttatcaagttgaggaagttcccttctatttctgatttactgaaaacatttattatgaatttttttcttacatgtttttcctgcttctattgagataatcatgcgagttttggcctttatatttttgatatagtgtattacattgatattactttgattgattttcataagttaaaccaattttacaaccctgagataaatcatgtttggtcctatagcatgaaatcattttatatgttgtgaaatgtagcttcctaacattttgtgaaagattttttgtccatattcataagaggtatttgattacatttttttttcttatgatgaattttgtctggctttggtcttagaaaatattgaccccatagaatgagtttggaatctacttttattttgttctacacagactaatacttacgtcttgatattttgttctctcactttcaatattaaccataaattgctcaccaaacaccccttcctttacttgctaatcactactggaatatagaggatggtaaatgacaacaagaaacttccaaaatatgagaaccataaaccatacatataagtgttgctttcactttaatattccttgtttctgtttttatatgacatctactaattcgcttttcagcccttacaaaaacaaagccgttttcaccagcacatgaatgtgaatgtcctagtgggtagaacaatatttcaaattttttttttttttttttttttttttttgagtcggagcgtctcgctctgtcacctaggctggactgcatacaatggcacaatctcggctcactgcaacctccgcctctcgggttcaagaaattctcctgcctcagcctcccgagtagctgggattacaggcacgtgccgccatgccatgctaatttttgtatttttagtagaaacggggtttcatcatgttggtgaggctggtcttgaacacctgacctcatgatccatccgcctcggcctcccaaagtgctgagattacagacataagccaccacgcccaggctttcaagttatgttttaagggagtacttcataggttttatagctcacttaagatcttgttggtggcaggacgcagtggctcatgccagtaatcccagcactttgggaggctgaggtgggcggatcacgatgtcaggagatcgagaccatcctggctaacatggtgaaaccccctctctactaaaaatacaaaaaattagccgggcgtggtggtgggcgcctgtagtcccagctactcgggaggctgaggcaggagaatggcgtgaacccgggaggcggagcttgcagtgagccgagattgcgacaccgcacttcagcctggataacagcgcgagactccgtctcagaaaaaaaaaaaaaaaagaccttgttgtcttagtgttatattctaaccttgcttgtatgatttcagagaagttgcttcttgacctacagaactcatatcctcaaagtgaactgtaaactcatttctaacattctttgtataattccggtttttagggaccctaagaaaatctatggccaaattaccattatcttaaacatgattgtaaaacataattcagaaaaaaaactctgattaattatattgcactgtattcaagtaaaacgtattacgtaaaatatgtatttgttaaaacttcctaggtctattctaaatgctgtgatgtttaaatatttaagaatttcttggagtttgtgattctttatttcaattccagtactttatgctctctttttctttttcactacacagcactttctcattctatatcattttgttaaaaggtgtatatattttttgtcctgaaaacataatatttcatgtagacccaatatagtcatgtagacctgatatatgaaataacatttattcattcaacacatatttattgaacacctggtctgttctagtactggagatacagccataaacaagcagaaccattcttgtctcatggagcttttactctagaggagagaaacaaacaatatcaaataagcataatatgctacatattgataatgctatgaagaaaaacatgtaacgtaattctgccccagagaatggcagaatgggatggtcagggaaggtctctctggtaagaaaaaacgacttacatgaggcaacaagccttgaagacaccttagagattattccaggttgagtaaacggtgttgataacttaagaagagatcatgctttgtgcattagaagagcagcaagtagaccagatgactggcttttacagtaagagaaaaggaggtcagagtagaaggatgtcagatcatgtaggatttgtaggcccctttgagaactttagattttattattctgcatgagattggaaaccactggagttctgaggcaaagaacatataatttggtttactttctaaagcaattgctctgagagcttaaaaaaagaataaaatttaggaaggcaaaaggggaagcaggaataataatcagggcaacttcaatcatttggaaggaaacaatggtgacttggacaaggttgtcggagtagaggtggagagaactagattaagtgtacattttgaaggctgagctagcaagatttgttgttgattatgtagagagcataagagaattggagctcaaggataatgacaatgtatatagcctgagcatctgaaatgattggcatgcaatttactgagatggggaagacaagactaaagaagggaaaagcaaattttcaaaaggaagggagaaatcaaaagtttaatctgagaagtagtcagttattcaaagtggggcctgtcgtggtggcttacgcctgtaatccaagcacttcaggaggctgaggtggccggatcacttgaggtcagaagttctagaccagcctggccaacatggtgaaaacccaactctactaaaaacaaaaattagccgggcatggtgtgtgtgcctgtagtcccggctactcagtaggctgaggcaggagaatagcttcaacctgtgaggcagaggctgcaatgcactgaggtcatgccactgcactccagcctgggtgacaaagcaagattccatctcaaaaaaaaaaaaaaaaaaaaaaagtgaaggattaaaaaataataaaaaaaataaaatgtttacctgaagggcctcaacatatttagagaataataattattttctatcgtttcatgttgtaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgtaatcaggctgaacatttctacaattactagatgtattagacgtaagtattttctttagttaaaccacccatgttagaaatgttttctgtagaatttataaacaactatcaatgcagacaatttaataagcctggggatgatttacttacagtaaacatttatcaaattgtacatttgtgctatcaacaattaataagcaaatatgtgaaaatagtttctgtcttctatgaagttagatatttgatggttaaaacccctataaatcatagtttcatatgggaaaaaataattgaaatacagtgtaaatttaaataatttattaagtatagcaaataattgaaatatggtggactaaattttgtcatagaaatatgtgcaagttatagtagtggctcacatgagaggtaatcaattctgctaatagtagcagaatgagtgcagtggaacatgaaaaacttgaggagataacagttgaggtgggtttccatagatgcataatagttcaagagcaagatttggtggggaggcactattcaagacagggactaagttcaaaatccaagacgtatgctgggacacacctctgacaggttggcataaaggaggcttaatcaaactatttttcttcttctgaaacagaagcaataattttcatttacatttgacatatcccgaggtaatattaacattagggaaagttactcttttccatctttccacattcttgcaggaccataaaatctgaattttccagtatttttaataagagggaagaaacctctctttttcttctctttttcatctcccaagagatcctcctctcatgactacagttgaataggtggtttctattggaagacattcaggaattcaaggtgcatgtccataaatggactttttttgttgttgttcagagctggaccttgaatgatgcatccttctctctgttgtaaccatgaataatgcacccttcatgctatagcctttaacgattcacccttcttattgtaaccttgaatgattcaccctttatggtgtagccttgagtgacgcacccttcatgttgtagccttcaatgatgcacactccatgttatagccttgaatgatataccctttatgctgcagcctttctcttatggggaaaagcctgcagatatcctgctgcttaactgacaagtgtggtgagaaataagtagaaatctaaagaggggaagaccattttggacacttatctgcaaggcagatccaacacacttttccagtagtcaagctacttctaattttgttcagtatcaaaatgagaaacaggcctgattctccagcactcttgtcaacacaacttccccccatatttatatatatacacacacatatatatctttatatatatacacacatatatatctttatatatatatatttatatatatatctttttgcatatatacatatatatgtatctttatttcctttgaaataaagataaatatagctgatttctttggcttcgacacttactatttgcatgactaagggaagctagttaacctttctgtgactcatttccttgtccataaaatgggaatattaattgtacatgtcttatggattggtgtgtgaattcagttagcgagtgtagaatataacttatagatcaaagtagagtaaatggaaagggctcaactatggtgttgctactgccattgttattacaggcacacagttcgagctataatcatttcaagggaaattcttatgtgtcagttctggatcgaggtctgagattctgcatttcaaacaaacttccaggaatgctgctgcttcttggtccacacttggagaaataagtcagcagagagtcctctcgtttcctattgtaccatgtctgtcttttgtctcctgcttattggcctctgtaaggaactcacagctgctataataaagtaccaaaaactgggtggcttaaaacaacagaaacttactttctcacaattctggag

SEQ ID NO: 13797 - DNA, 6938 bp, Human; identical to SEQ ID NO: 12058

SEQ ID NO: 13798 - DNA, 39318 bp, Human
ttgggcagaggtgaaaatcatacatatttacagacgtaagacacaaaaccttaataatgaagtgggtgggtatcctacaatagagagaagtagattctggtgaattggaatgtattgccatgtaagaatgatggtctgcagatgataacaggtcattttttttcctcccaagaagagactttagaaattatttttgtgaaatttctcaattttagcaactaattcaaaagctctttaaatactatgaaccaaacaaaagaaatttgtgggctgaattcagcctcttgactacctgtttgcaacctctggtgtagacagaaagacattaatcaaataaggaacaagcaaaagtaaaatttgtgtccaggaaggggagagcagggtgctctctgagcctataagagtatttgacctagtcaggaagtcttcccaggtgaagtggctgttgagttctgaaggataagtagatgttaactaagtgaagaggggattgaagatggttctaggtagaaggaacagcacatggaaaggccagtggtgaggagcatggtgacaagaaaaggccaagcagctcagtgtggctgtggcatggatgagccaggcagaatatcttgtgaaataagcccagtgaagcagacgtgggtggaagccagaccttacagaccaccttaaggattctggtttttgttctgagatctatgggaaaccactgaagaatttttaagtaggagagtgacatgattagatgtgtgttgacactgactgctatttggagaataggcagtagggcaatctgattagattcaggagtatagttaggaggcagtaatccagggccaagatgatggtgatttagactagggtgatgaatagatgagaggaataggatgagagatagatagaagtgtattgtactgatataatctgttacttgtcagtgacaatgtcagagtcaatgacaatgactcatatttgtttctcttcaatgcttagaagagaatctgaaacagtaggaatttaacaagtatctgttcaactaaactgtccttttcacttcaataataggattgtgtttcattatattttcttaatcataaaatttcagaaatgacggggtgcggtggcacatgcctgtaatctcagcactttgggaggccgaggtgggtggatcacttgcggtcaggagttcgagaccagcctggccaacatgatgaaattccgtctctactaaaaatacaaaaattagctgggcatggtgatggacgcctgtaatcctagctgctggggaggctgaggcagcagaatcgcttgagcctgggaggcagaggttgcagtgagctgagatcacgccactgcactccagcctgggtgacagggtgagactgtgcctcataaataagaaaaaaaaaattcagaaatggaaactttacatatacaaatgcttataaggttaggtaatactaaggcatttttctttgccattagactttcatttctgtctttatcttattattgttttctgtagagaagataagccatatatggatatattacatgataaaaaccattttacagatgcgtgataggaaataaaactaaagtctcaggggaaacaaaggacctactattttcttgagttaaagttgttaaccatgttcacatgtgttttcctacaggcaggaaacgctgggtcagagacttttgtgcaaaaagatgatctataatatactggttcagtttctgcttgtacagcctttgccacaaatgtgaactagctcttctctcccttttacattttaaaagaaacgattttcctttttgtatcttttaataaacttttcagctatatgtaagatctttaattgcatttaacaaatacctgtgaagtgtttaatgtgtgcaaggcactgagttggaaaagtagccttttaaaatttataaatttaatctgatgagggtaaaaattaatgttcttttcattatttgtaaatattatctccaacagatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatggtaagtgaatctttactttttaaaaaactcccttattgagacataattactgtgccataaattcacatattgcagctgtgcagtttgatgagtgtagtaaatatatacagttgtgaaaccatcatcacaatccagctttagaacacccttgtcatcctcaaaatttcctttatgcccatttgcagacccacccccaagcaactattgatctgctttctgtcactataattttgccttttcttgaaatgtcatataaatgatgtcatataatatgtcaccttttttatctgttttctttcacatcaaataatgtttttgaagtttatcctgctaggattttcatagggattgtgttgaattgtcattctgacaatattgagtcttcagtccatgaacatgatacttctcttcatttaaaacgttgaaacattaatgaattatggacagggtcttgctctgttgcccaggctggagtgcagtggtgcagtcatagcttactgcagccttgaacctgggctgaagctatcctctcacttctgcctcctgagtaatgagaactacagctgtgcgccaccacacctggctcatttttttgtttttgtaaagactgggtcttgctgtgttgctcagtcaggtcttgaactcctaggctcaagcaatctcctactgaggcctttcaaagccctgggatttcccatgtcagctaccatgtccagcttctctccatttatttatatcttaatttctctcatctgtattttgtagcttttagtgtacaagtattgcacttgttttgattaatttattcctaagtatttttttgatgctattgtgaataggattgctttcataatttcaattttggattgtgtgttactaatatatagagatgaaattgatttctttaggtagcttttgtgataaaattcaaatatcaaatttatgattttaaccattttacactttatagttcataggtacatttacaatgtcgtacagctgtcaccgctgtctgtttccagaacatttctatcactccaaaaagaaaccctgtatccattagcagtcagtcactcccaatccattaccacctcccttcccccaacccagcaactactaatttactgtctatatctattctatgagtttgcctattctggacattttctataaatggaattatatgctatgtggccttttgtgaataacttctttcacttacagtgttttcaagcttcatccctattgtaacatataaacatatatcagcaattcattactttttttttttttttggagacggagtcttgctctgtcgcccaggctggattgcagtggcgtgatcttggctcactgcaacttctgcctcctgggttcaagcgattctcctgcctcagcctcctgagtagctgggactacaggcgcccgccaacacacccagctaattttttgtgtttttagtagagacggggtttcaccgtgttagccaggatggtcttgatctcctgaccttgtgatccgcctgtctcagcctctgaaagtgctgggattacaggcgtgagccactgcacctggctgatttttgtatttttagtagagacggggtttcaccatattggccaggctggttttgaactcctgatcttgtgatccacccgcctcggcctcccaaagtgctgagattacaggcgtgagccattgcactaggccagcaattcattattttttatgtctgaataatattgtatagatatatcatattttgtttatccatttattagttggtgaacatttgttgtttctactttttagctattacagataatgttactttgaacattcttttacagatttttgtgtgaacatatgtttagtttctcttgggtatatacctaagagtggaattactaggtcacatggtaactttgtttaatgttttgaggagctgccaaacttttctacagtagctacaccattttatattcccatcagcaatgtgtgaggtttctgatttcttcacatctttgccagcacttgttactgtctttttgatgactgccctcttagtacccacagttgatttttgtatattgaccttgtatcctgaaactttgctaaacttattaattctagtagtttttttatgttttgggttttttgtaaattttgtaggattttctacttgtaagaatatgttggccaggcacagtggctcacgcctgtaatcccagcacattggaggccgaggcaggcagatcacgaggtcgggagttcgagactagcctgaccaacatggtgaaaccctgtctctactaaaaataaaaaaattagccaggcatggtggcacgtgcctgtaatcccagctactcgggaggctggggcaggagaatcgcctgaacctcggaggcggaggttgcagtgaaccaagatcgtgccattgcactccagcctgggtgacagggcaagactctgtctcaaaaaaaaaaaaaaatgttgtttgcaagtaaagacagtttttactttgtcctttccaatctcctttaatttatttttgttacctgatagcacctggaggctagaacctccagtaaattagaagtggtgagagtggacattttggtcttgttcctgatcttagggaaaatgcattcattctttcaccagtatgatgatgtctgtaaattttaacagatatcctttgtaggtttgaggaagttcccttctattcttagttcgctgagagtttttggattgtatattggattttgtcaaatgtaattttttttctgcacctattgaaataatctttttttttaaggtttgttaatatggtcaattacattgattgatttttgaatgtgaaactagctttgccacttggtcatgatgcattattctgttcatatattgttagatttatttgctaaattaaaaaaattttggcatccatgttcatgagggatgtaagtatatagttttcttctaatgcatttttctggtttgggtattgtgataatgctagtttcatagaatgggttagaaagtatccccttcttttcagttttctagaagaatttgtctagaattggtattatttcttaaatgtttggtagaattcatcagtgaagccatctgggcttgaagttttctttgtgggaaggttttcaactattgattcaatttctttaatagacataagactattcagattatgtattttttctttttctctttaaatcagggtctcactctgttacccaggctggagtacagtggcacaatcacagctcactgcagcctcgacttcctggccttaagcaatcctcccacctcagcctccccagtagctgaggctacaggtgtgtgctaccacgcctggctaattttttctattattattatttttttcttgaaacagggtctcactctgtcgaccaggctggagtgcagtggtgtgatcatggctcacttagcgtctacctcccgggctcaagcgatcctcccacttcagccccctgagtaggtgggactatatgtgtgtgccaccgcaccatgcccagctaattttaatttttttttggtagagataagggtctcactatgttttctaagctggtcttgaactcctggactcaaccagtcctcccacctcagccttgcaaagcactgggattacagacatgagctaccgtgcccggccaggttatctattttttctttttttttttttctttttttgagacagagtcttgctctgttgcccaggctggagtgcagtggcgcgatctcggctcactgtctcctctgcttccccgggttccagcgattctctcgcctcagccacctgggtagctgggattacaggcacacgccaccatgcctggctcatttttgtagttttagtagggacgggtttcaccgtattggccaggctggtctcaaactactgacctcaggtgatccgcctgccttggcctcccggagtgctgggattacaggcgtgagccaccgtgcccagccagttttttcttaagtgaggtttggtagcttgtctttcacggaattagtccgtttcatctaagttgtcaaattcattggcaaaaggttgtttatactattcccttattattcttttagtatgttgaatgtagtggtataacttttctcatttttgatattggtaacttacgtcttttctttttttcctgattagtctgactagaggtttatcttatcgatcttctcagagaaccagcttttggttttattaatttttctttctgtttttatgtttcctatttcatctatttctgctctgatctttatttttttttcttacttactttgggcttaatttcctcttttctttctacttaaagtggaagctgaggccatggtttgagaccttttttcctttctaatatgggagtttaatgctataaattgccactgagtactgttttagtgtcatcccacagattttgacatactatgttttcattttcatgtagttcaaaatactattttacctcctgatttattctttgatcctgggttatttagaaatgtgttatttagtttccaaatatttttaaattctctagagatttttggttattggtttctaatttaatctcaatttagagaacatattttttatggcttgaatgtttttaaatttattaagacttgttttatgacccagaatatagttttgttgttgttgttgttttctgtttgttttgtttttttcaagacaaggtctcaccctgtcacccaggctggggtgcagtggcactataacggctcattgcagcctcagcctcctggactcaagtgattctctcgcttcagccttcccagtagctgagactacaggagcatcccaccatgtctggctaatttttttttaaatttagttttaatttcaataagtttttggggaacaggtggtgtttagttacatgaataagttcttcagtggtgatttctgagattttggtgcacccatcacccaagcagtgtacactgtacccaatgtgtagtcttttatctctcactcgcctcccactctttcccctgagttcccaaagtccgctgtatcgttcttacgcctttgcaccctcctagcttagctcctacttgtaagtgagaacatacgatgtttgattttctgttcctgagttacttctcttagaataatagtctctagttccatccaggttgctgccagtgccattattttgttcctttttatgcatgcctggctaatttttaaaattttttgtagagatggggtctcactgtgttgcctaggtgttgcctagctggtcttgaactcctgggctcaggtgattctcccacctcagcctctcaaagtgctgggactatagcaggagccacggcacccagcccagaatatagtttattatatttatttatttatttatttatttattgtattttttgagacagagtctcactctgtcaccctggctggagtgcaatggtgcgatcttggctcactgcagccttcgcctcccaggttcaagcaattcttgtgcttcaccttcccgagtagctgggactacaggcatgtgccaccacacccagctaatttttgtatttttagtagaggtggagattcaccatgttggccaggctggactcaaactcctgacctcaagtgatctgccctccttggcctccccaaagttctgggattacaggcatgagccaccccgcctggccatagtttattatctttaaataatagtaataataataaatagtgcctattttttaggattggggtgaaagttaaataagaatgcaaacatagctgggaggtgcacctgtaatcccagctatttacaggtggattacaggcaggaggattctcctgagcccaggagtttgaggctgcagtgagctatgatcgtgccactgctctctagtctgagtgacagggcaagacctcatctcttaaaaaaaaagcatgtaaagtacatgacctagcacatagcaaatgatcagtaagtgacagctgatgtccttataaagcttattttttatttaataatttaatgtgtctattctgaaatgcagtctatgagctcatgatattttctgcttcaagtgcagtgttatattcctaatagcagagtttgaaatacttagtcagtttgaaaaaattaagacttttttattcccatgtgtaaaaaatggcttctggtatgattcatttattttcacggaaaagtctgaaaagtgtgttatgattattttcacaaaaaaaagtctgagaaaagttgaggttaactgaatagagtagtattagttgaggaaccgttttcatatatgccatcacatccaaggctatcttttcttactacactgtgtcctgaccaactactccagccctctgtttccccacatcgacccttggttttctccaattcttcatccacaatatagccatagtgatcatgatgtcactcctctgattgaaaaatcattctatggcttcatgttgcttttaggataaggtctaaaaagtttaataccgtccttattatactgtgtgattatggcattgtcagtttctctagctctgcctgcatccatcttccctttccatctctgtttcttccattctggtctcatttcagtcctcaaaatttccattctttttcttggctcttgctgtccacactgttcctatctgattcttacttgtatttcagatctaaaccttacctcttctggaaagtcctccctgaccccctctcctttttcccattacaattcctgtgcctagttgatgtccctgactcccatctagaactccctgtttctcattctgaatactcatcatcatgataaacccaagattatacacatcataagattagggattgtgtttgtcttgtcactgtgtctctagtgcctagcacaatgccaaactcaggtgtgtggtaaatgtttgttgaatgaatgaatttgggtatttagaaagttgagattttatctttagttacctgtaataattgtattgtcatctttttgttaactctgtttcttacagctgttactttaaaacaattgtttaaaaacacacttattttaggattaagaaaaaagctatcattttactgatactttctatgaggtgttgtgttggtcacttgaaggaaattgtctcatttggttcttactatcaatggcgaattttcttatccccattttacggttgaggagacagtctctaggtagataacttgtccaaggtcagtggctaaaaagtggcagatgtggtttgagacaggtcttcctgctctagagcctgtattctttttctgtgcttatactgccttctccagtttaatgtccacaataagtactttatatacacatgacaagaaatgtctcataattagatatactggaagatttttgcatttagggcttgggatgctttttattaattcttagggatatctctcattgactgctgtaacagtgctttgtgcttgtggtacagagtacgcattgtaattgttgataataaaggtgaaacttgtgctagaataaattttgaatccaggggagaaattacatcacagtgtcaaaggaattaattttaagagctattgttctgtagcattagactttaagaagtaactgattctcttcatcattttcagggactatttttgcatatggacaaaccggaacaggcaaaacttttaccatggaaggtgttcgagctattcctgaacttagaggaataattcccaattcatttgctcacatatttggtcatattgcaaaagcggagggtgatacaaggtaaaagggaattcttttattttctgatattgagaagtacaaacactggaaaggcacataggtataaattttataaacatattttaaaaccgttcttatgaatatttcactctttgactttttaaaaatgatgttttatagatttttggttcgagtgtcttatttggaaatatataatgaagaagttcgtgaccttttgggcaaggatcagacacaaaggttagaggtaaggataattgaaattggtggagtactttttccaaagcaatagaatatttgctaaattaaggtcccccttctttttttaaacaaaagttgctttttatattttaaataatctcgtacatatataatgtcgtacatctgcagacatatctggggataaattactgaagcaggattgctgagtcaggtggtaaattattggtaaatttgatattgctgcatattttaatattttaagatgtgagacatacagcaaggaaaaggttaatactggaattttagttggattgcatcaccagtaaaatagaggagaataatgtatgtagagtaacatgtagaacagcagtagctgccattgtagaataatatagagcatttgtagaacagcagccagcattactgagctcttgcaatgtgatataggcattcagtgcagtaattgatggttgttggtagtagtaaataatttatttcatttaatcttcccagcagttcgattttactgatgtgggaactgaaatttagaggggtttcttgacttgctcaaggtcatatagcaagtgaatggcagtatcatctaggattaagaaggtggttctagcagtctaccatcttagcttgaattctggctctgatcttgagcaagttacttaatctctgtgagtcttgatttggtcataaaaatggaaataataatggtatccacttcgtaggattattaccaatactaacagatgaaagtgtttaaatcaatgcctgacataataaatattagcttttttttctttttaagtttactgcataaactgagtttttggagcagtgtattacagtgttaaggattgtttgtgcttgttggacctcatgaagccttattctctgataccatttatatagcaaatatagaaacaaatttctttgttgctggttttcaactttagttctgattaattctgtgctttcatgtcctaaaaaatttgttgtgttatgcaaattctaggaaaaaatcatttggaaagaacatttccatttttgtaccagtaattatagatcagatttattctcaggaacattcttgtcaatggttctcaactctgttagacccagtgctccttttttttttattttaggaaagttttttttattgttgttatagtttttaggatttcttatgttccattgctttaattttaatttaggggattcctgttatgccagggagttttgaacctccattgaagattgtaatccctttcttagaatgattttttaatatatatatatatatatatatatatatatatatatatatatatatatatttttttttttttttattatactttaagttctagggtacatgtgcacgacgtgcaggtttgttacatatgtatacatgtgccatgttggtgtgctgcacccattaactcgtcatttacattaggtatatctcctaatgctatccctccccactcctcccaccccacaacaggccccggtgtgtgatgttctccttcctgtgtccaagtgttctcattgttcagttctcacctataagtgagaacatgtggtgtttggttttttgtccttgtgatagtttgctgagaatgctggtttccagcttcatccatgtccctacaaaggacatgaactcatcattttttatggctgcatagtattccatggtgtatatgtgccacattttcttaatccagtctatcattgttggacatttgggttggttccaagtctttgctattgtgagtagtgccacagtaaatgtgtgcatgtgtctttatagcagcatgatttatattcctttggatatatacccagtaatgggatggctgggtcaaatggtatttctagttctagatccctgaggaatcgccacactgacttccacaatggttgaactagtttacactcccaccaatggtgtaaaagtgttcctgtttctccacatcctctccaacacctgtttcctgactttttaatgatcgccattctaattggtgtgagatgatatctcattgtggttttgatttgcatttctctgatgaccagtgatgatgagcattttttcatgtgtctgttggctgcataaatgtcttcttttgagaagtgtctgttcatatccttcacccactttttgatggggttgtttgtttttttcttgtaaatttgtttgagttctttgtagattctggatattagccttttgtcagatgagtagattgcaaaaatgttctcccattctgtaggttgcctgttcactctgatggtagtttcttttgctgtgcagaagctctttagtttaattagatcccatttgtcaattttggcttttgttgccattgcttttggtgttttagacatgaagttcttgccattcctatgtcctgaatggtattgcctaggttttcttctagggttttcatggttttaggtctaacatttaagtctttaatccatcttgaattaatttttgtataaggtgtaaggaaggaatcccagtttcagctttctacatatggctagccagttttcccagcaccatttgttaaatagggaatcctttccccatttcttgtttttgtcaggtttgtcaaagatcagatagttgtaaatgtgtggcattatttctgagagctctgttctgttgcattgatctatatctctgttttggtaccagtaccatgctgttttggttactgtagccttgtagtatagtttgaagtcaggtagtgtgatgcctccagctttgttgttttggcttagaattgacttggcaatgcgggctcttttttggttccatatgaactttaaagtagttttttccaattctgtgacgaaagtcattggtagcttgatggggatggtattgaatctataaattaccttgggcagtatggccattttcacgatattgattcttcctatccgtgagcatggaatgttcttccatttgtttgtgtcctcttttatttcattgagcagtggtttgtagttctccttgaagaggtccttcacatcccaactcctttctaaataacatacgtttttgtcctgaaataaaactcatatgtgacattaataaaatctacctatacacatacttttaaaaaaattcgtatactaccctactgtaatataaaggagaatacaagtaattaaatataaatgctagtatttagatatgtaaacacttagatatgaccacacttaatgacataataaaatagaggcatatagaatcatcaaaattgtaacagctacaaatgcagtgtcaacaggtatgttgtattgttgatctaaaccccttgattggtgttattgccagtgacatggtcttctacaatagtgactagctcttggtagagtttggagcgaaataaagcacaattcttccctcagtttttctgtgttctcatattattgctatatggaaaagcactttgtctttatatgtgaaataaagttacatatgacagactcagatataattatctgggtctagactcaaataattataagtagtttttttaccatgtgaatatctggtaggacattcaaaattctgtgggacagttcttcattgggtgagactgtcccacttatttcaggatgtttagtattcctggtccctgcctgtcaataactacagtgtcctcaagtgaaccagaaactcttgcgcaaatttctaaaatattctaggacaagagggtaactgcttccattgagatccattgttataaactgtgtttgtcatagatattgaattcctgtgttttttttgataaaaattctttggtagcatttccatccagttttttaactttcacacatttggaattatattttctttcttcatctttcatatctagtcagttattagttgaatacacttattaattgaattttgaattaatagcatattgtgattggaagaccactagtttgcagacagatgtcagtttgaaaaatgtccattttcagtctgcggtgagaatgaacacaaaaactgagagtaggtgcttaaaaacttccatagcaatttgacattgccaaggcatccaagtgcatgatttttgtattttacaaaattatcatattacaaatatgtacatcctttatcagagattttttgagaagcattgatatagaccagtaattttcaaaccttttaaaaggtgtaaagcatttcaacactttcatcaaaccaaaccttatgtggaagctcaatgtgtaaaattcatgaaagcgcccttctctttagaacttctctgggcctgaagacccctaaactcctacagtggccgcctcagtgccaccatggaccctctagggcttttcagagcaaggtctgaaatccactggcttatagagatcatcatactttttttttttttactactaatagaattagggcttaatttatatcccatgacagataaaggatttttcctaatttgtaaatttatcttatcaattgttataaaaggcgcatgcacacacacacaacattgaaaatcaacgactggaatgttgagtgtctacctttataacgttttcccctggaattgtttatcagattttcatttgtcttcgatgtctatgaggtcttcctacccgtggaatggcttttcccactggcaaccacaggcctctgcctcagtttcactttttattcttttggtttgtagagatgactctgagccttccaaagtgaattttgtttatacagtgccacttgtattttaggtaaatccatcctaaatacatttttcaaatttggttaaaatttctcataaggtaattcacagaaagatcatattttaacattgatactatagatctgattatttccctcagttgcttgaaattctccaaattattcttaccataaagaccaaaaactattctaaacttgtctctgtcttcctagataaccagatatctcacctatttttccctgtttcctgctctctccagccacattgtctttttcggtttgttaattttttgtaagtgcctagttttttcttatttcaggattcttgcacattttcttcttctcctacctcaactgactaactgcctcctttttatttaaagaaattttagcttaaacatcatcttggggaattttatcctatctccttcactagcttagtagtgttctgtactttttctgtatttttcttcatgtcatcacaattgaaataaaataatttttatgtgtaattcttcatttgtatgttcttcctatagacatctccatgcgtgtaggaacagtgtctatcttatcagtatattccctctgtctagtagagtgtccaacacataggagatactcaataaataattgtggaagagttattgatatagtataaagtcttaatttttttttaggttaaagaaagacctgatgtgggagtttatatcaaagatttatcagcttatgtggtaaataatgctgatgatatggatagaattatgacgctaggccacaaaaatcgtaagtatagtgtgtaattgtgattaagcatctgtgtgttgagtaggctggtttagaagcaaatttggtatggcactttaccctgtagagactggattttttaggtttcttgaaaaccattccactttgattatttaccatgtagagagcatatatgaatgaaagataccacaaatcattttccatgccgagcaaaattttgtttctttttagtagcgccaatctatgcaactctcatacggctgtctcttggtagctataatagtaaaattggtaatgtttattgagctcttagtggagagtgcttgtgctaagtgcttcataaagatgctctcttagtcctcacaggagactatgaagacattaaattcttactttatgaatgaagaaagtgagacttagtttaagtaacttgtctaagtactataactactaagtggtagagtgagtgatcacacctaagccatagccacgcacagtggctcatgcctgtaatcccagcaactcgggaggctgaactgggaggatcatttgaggccaggagtttgagaccagcctggacaatagggagcccctgtcctaaagaaacccacctggaagaaacccaaaaaacctaggccagtagtctgcattaactaggcactgtaatgcttcccttttgttgacaagaaaagcaaaacaaaatttaaattaaaaaattgtattctttttagtaattgtgtcacatttttagtctaaagagtaggaagcttcagcgatattatacagatgcctcaaacctagtactggtgatgcaactaatagcaattagaaattagaggtgaaaagtctggtcgcggtggctcacacctgtaatcccagcactttgggaggctgaggtgggtggatcacttgtttgagaccagcctggccaacatggtgaaaccccgtctctactaaaaatacaaaaattagctgggagtggtggtgggtgcctgtaatcccagttactcgggaggctgtggcaggagaatcgttttaaccaggaaggcagaagttgcagtgagccgagatcgcgccactgcactccaacttgggcaacacagcaaccaaaaaaaaaagaaaaaaagagggattagaggtaaaagatgagaaataggaaatgaaaaatttttataagtttctgtgacttgatgatagatatatcaaacccaaggaaatcaaacaacaaaacttcaaaaatcaattacattcttatgaaccaattaatagaaaaagaccaaatcttaatagaaaaattagcaaaaaatatgtatgttattcgtagaagaactaagcacagcaataagtatgtgaaaggctgtttaacttcacaactaatcaggaaaatgctaaaacaagatagagagagatgtttcacccatcagattagatgaaggatatgtaggttggtgagactttgaagaaatgggcactgaggatggaatataaattggtgcagcctatttgaagggcattgttaacagtatctgttgacattttaaaatacattccttttgactctgtttctaattttagacattctggaaaatatttttagatgtaacaatctaaataaccttcaataaaaccctgattatgtaaatgatgacacaaaaataccatagactgtaataaagctgttaaaaacaatgagttaggctgggtgtggtggctcatgcctgtaatcccaacactctgggaggccaaggtgggcagatttcctgaactcaggagttagagaccagcctgtgcaacatggcgaaaccccatctcaactaaaaatacaaaaaaatcagccagacgtggtggcttacgcctataatcccagctacttgggatgctgaggcagcagaattgcttgaacctgggaggcagaggttgcagtgagccaagatagcaccactgaactccagcctgggcaatagaggaagactctgtctcaaaaacaaaacaaaacaacaacaaaaaaaacaacaagctgagtgtggtggctcatgcatataatcccagcactctgggtggctgaggcggatggatcacttgaggccaggagtttgagaccagcctggccaacctggtgaaacctcgtctctgctaaaaatacaaaaattagctgggcgtggtggtgcgcacctgtgatctcagctactcaggaggttgaggccggaggatcacttgaacctgggaggtggaggttgcagtgagccgagattgtgccactgccctccagcctgggtgacagagggagaccctgtctcaaacaaaacaacaaaaaaacccagtcaggtaaatgtgcctacacagagctggaagattttcaaagtatgtttgtcagtggggggataaaagcaaattgtagaacagtatgtatgtactgccttaccccatttatttatatgtgaaaaattgttaaaccatatatttatttgggcagtgtgtgtgtgtttgtgtctacacgtatgtatataaaatacagaatgaaaggacagattgtagtggttacctttagagaaggagaaataaaattggggaaaaggaatgtcaggagctttcactttatgctttctgtatgcttttattaaaaaaacaaataccagaaatatgttaattattggttatttaattaaaaattttaacacaagatttcattcatagaatgaaattaatttaattctcaggtagttaattggagcttttggtcacttcattaaagattacccttttaatgtttcaattataaaatcaaagcttgcacagaaaaatgctgcatgaatgtatagtaggaagataattttggcattgagtaaaattaactttaaaatactttggaatttaagaaaaaaactaatacaggtctattgtaaaaaaatgttttttgtttacacaatatattcatatatttacacatatgcaaatactttgcatattttgaatggattttttttttttacagaagtaggattatgttatgtatttctttctaacttgcttttatttttaatttatatgttatggacatttttccacgtttttagatctaccttattttttttaatgctgcactgaatattgttgtattgtctaacatatgtgtgcaagtattcctgtggtttatatgttcaagctggagtgcagtggcgcaatctcagctcactgcaacctccacctctcggattcaagtgattcttgtgcctcagcctcccaagtagctaaaattctctttattattattgttttttacttcctgcagtacaccagcatgcatacttctctttagatagctaaatcagcaataatttttccaattaatgtggttttttggtgtaaattagttattttttaggcagtattactagggattgaaattattttttgctaaagttatgtctttaatatgagaaaccttacaaatttgttatcaacaaagtataagagaaatttcatgtagtggctaagtacacacccatgcctttatggtttagccatgctctctggcttttgattgtgataaaattaagtgttttaaactgttcaggatgtttaattatttttaaaggcactctctgttacacttttaaaggatttcgtttatttattaaaggttctgttggtgcaactaatatgaacgaacatagttcccgttcccatgccatctttacaattactatagaatgcagtgaaaaaggcattgatggtaacatgcatgtcaggatggggaagctccatcttgtagatcttgctgtaagtaacaggacactgcttaaggaataactctttcttgtgatccatttattttataaatgaatgaaaattaaagtgaaaaggtatgatttacatatgatttttaaggtgttacttgtgtatgtttattatttattatggaacatttcaaatgtatatgaaagtagatagaatagtatagtgatcccccatacactgatcacccaactcccaacaatcagctcatggctaatcttgtttcatgtactctcccccacttcttcctttcctatattattttgaagtgaattcaggcatcatatcaggttttttactgttacattactttttaataaaaccttgggaagaatattctatttttaaaaaaattttagctttactttcatctctgtttattgctagggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatggtaagacttaattggtgatatagttaacatcaggcaaatttaagattgtaatttatgccaataattgatacgtatcacattttttaaacttgattattttactttttttgacttgtggttgtcctttttgtggtacactcgtgtattagcccataatagtgtcctttggaaactcatgtggttgacactctcattttcgagaaggccaagggtgcatatgtgctttaaatgtttttgatgtatttgtaatggtagtattaattttaactctgtcaagtgtaaaatgatttgtttcatatttctaattcaatagtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggtagcttttcctcaaaatattaatctttatgttggctaaaaatacattgttgaaccactaactgttctaacaaaagccctctattaaaccttttttgagcctctaacattggtagttaaatgaatatttctagaaagtgacttggtacttacatactttcgcattttcatattaagcttaagtaaaattacataatatttgtgtatgtggttttttaaaaacatttgcatgatgttttgtagatttcatatgaccactttttaaggaatgaatgtttatttgtctctgtataagagcaaattctgcaatgtatgtatttaggtgaaaatgaccagaattctggcattgcaatcaatatcaactaactattgtttgaagtaaagcaagatattagacagtcatgagtaaaccaagtttgctataaggaaaaatgcattgcatgacctttaaaatatcctttcatacctaaatttgaacatgagattgtattttggaaattcttttctaacaatatcatgctagaaagttggaaaatttgaagatcttatttatgagagtgagacgcttcccagtcattaagtgctgagtgagtccttgcaccttaatgcgagaaacagatcctttctgattggtacagagctccttcgcgaaccacgtaaacagggctttggtttcaaagcacctttgtagtctgtgagaagactgactagatcagaggtgaaattcagagacgccagcatcacaaatgtttagagagggtacttatttagtaaacaagtagttattgaggaaaagcagtaagagaactgttagataatgaaatttggtgttttaaatgtgaccactaggtggtatttatagccagtatgttttaaagatttttaatttcttagcgatgttaacggtgagtgcatacttttattttgctgactttatgttttacatttttttgttgtggtaaaatatacatgacataaaatttatcattgtaaccattgttagttaagtgtacagttagtggcatcaagtatattcgcattgttgtgcaactgtcaccactattcatttctagaaatttttcatcatcccaaacagaaatgctgtgcccatttaagtagtaacttcctattcttttctcccccagtctctggtaaccactattctactttcggtctctatgaatttgactattctaggtacctcatataagtaaaatcatggagtatctacttgtgactggcttatttcacttaacagaacgttgaaggttcatccatattgtagcaagtgcctgaattttattcctttttaaaaaattgtggttaaacttgcataacataaagtttaccattttaatcacatttaagtctacatttctgtggcattacattcacattgttctgcagttatccgtcttcagttttcttcttgcaaaattgaaactttgtactcattaaaaacagtatgtacccattcctcccttcccctagttcctggccaacaaccattctgctttgtctatgaatttgactgctctgggtatcttacgaaagcggaattggtggggcgcagtggctcacgcttgtaatcccagcactttgtgaggccgaggcgggtggatcagttgaggtcaggagttcgagaccagcctggccaacatggtgaaaccccatctttactgaaaatacaaaaattagctgggcatggtggctctcgcctgtaatcccagctacttgggaggctgaggcaggaggatcacttgaacctggaaggtggaggtggcaatgagccgagattatgccactgcactccagcctgggtggcagagtgagactcccatctcaaaaaaaaaaaaaaaaaaaaaaaaagaaagtgaaatacagcatttgtctttttgtgactggcttatttcatttagtataatgccttcaagggtcatccgtgttgtagaatgtatcaggacttctttttaattctgaataacattccattgtgtatatactacattttgttatccattcatccaccaatggacagttggttctttccaccttttggctattgtgaataatgctgctatgaacgtgggtatactaatacctgtttgaattcttgttttaccatttttggggtatgtacccagcaatggaattgctggattctatgataatactgttgttaatacatttcagtttatttttgctcttatgacatttctttttataatctagttaatggagttgatcatatcaacaataaaaaagtaggcaatagcattaaaataataatttttaaacttaaaaattattgtaggctatatgcaacttgcaaacatgatatggagagttcctatctacccttcacccagcttcacctcatgttaacatcttttataagcatacaacagttattgaaaccaggaaatttacattgatatagtcttattaactaatctgtggactttattcaaatttggccagttttccttccagtgcctctttttcctggtccaggatacaatccaggatcacacactgcatttatttgtcatgctttctttgttttgttgttgttgttgttgttgttgtttgttttttgttttgagacagagtctcgctctgttgccaggctggaattcagtggcacagtctcagcttactgcaacctctgcctccctgttcaagcgattctcctgcctcaacctcctgagtagctgggactacaggcacatgccacctcgcccagctaattttcgtatttttagtagagacagggtttcaccatgtttgccaggatggtctttatcctctgacctcgtgatctgcccgcctcggcatctcaaagtgctgggactacaggcgtgagccaccatgcccggccatgtcatgcctttttaatgacgatgtctagcacacttgttcttcagtctaattccccagtctttcttgatcttgacatttttgaagagtactggtcatatatttgttgaatgttcattaatttgggtttgtctacttttcttttataatgaccctgcaaagtttctccactgcaaatctattgttttatgtttccattcgtaattaacatgtatcttgtgggggatactttgagactgcaaaggtcctgtttcttgtcatactttcttctactatttttagtattcatcaatagttcttgtctgcaacaataatcctgtggcatttgctcaatgttattttctattctcatcatttcttccttgtttagtgtttaggattctattgtatggaagaacagccccttcattcccatttgtttatttattcaagtatttatcttatttagatcatggattataatccagtgttatcattatttattttgttcattgaattgttccagctttggctattatgagatccttcagagtagttcctgtattctttcagcatgtgctcatcagtttttttgagcatttgattactttttggcactataaaaggttttaggtttatcttgtgtcttccttgcccaatcttagaatcattcacttctctctggtcccttctgtaggagaatggtatttagaaacgcagttttgggcactagctgtgctcattactaccaagatgtcattgtttctaagcccgaagaaaaaaatatttttcagaaatttcttctcccaagactctgtgttcctttccatcttgtacttacaggtacaattattacctggttgtgattagagtatattttacttttttctcctctattttattttgttagacatttcatatgtaaacagtggcatttaaaaatagctaatttgaagatgatatagtgctgatctgttttattggcttcatcattccttttttgttttttatctttaagttaatgtgtagttaacactgtctttgtacaaataagcacttctttttttgaaaatatcttgtgatacagtcctaaaagtgggatcattgttacatgacagttctgtgtctcttaaaaatacagattgaatgaattatttgaaatcttaaacaggaagctgttttagaagaaattgttcctcaaaagtgatcacatttttaaaagactgaattagtaactctaccacataatttatatatatatttaaaattatacataaagaaatgatttgaatatttttattttttttttgagacagagtcactctgttgttgaggctggagtgcagtggtgccatctcggctcactgcaacctctgcctcctgggttcaagtgattctcctgcctcagcctcccaagtagctgggattacaggtgcatgccaccaagcccagctaatttttgtatttttagtagagatggggttttgccatgttggccaggctggtctcaaactcttggcctcaagtgatctgcctgcctcagcctcttaaagtgctgggattacaggcgtgcgccaccttgcctagccagaatggtttgaaattttaagtgggtcagaatttaacttctctttagagactttaaaaataaagtctttttggatatctcatctgtgtctgagattggcatatctgttatactttctaggagcatttaaatagtatttaaatttgttgtttgcagtaacaaaaatctgaggaagaaagctgatataggtatttcctaaatagctaatgacttcgtacaggataaaaaacattgtattaaatttctgtccaaggagaagaaatatcaggctctgatatcagtgggtcagaggaagatgatgatgaagagggtgaggttggagaagatggagagaaaaggaaaaaaagaaggggtaagttctgtttagtaatctgatttgtagaaattaggtggtttcacaaggtggtagagtgcatgacttttattttgccgttatctgtttaatatattagataacaattagaacagaagatgtatgccatttacctggttaactttgcattttttctcctgtattgatccgtttatagctgactttgaatatatgttctgtttttttagaatttagaattgtaagactctataatactgggtatgccattttaaaatttcctgtgtgttttaattttatgtagggacttacatctgtgttaggaacctaagtttttttgtttgtttgtttgtttgtttgttttgagacggagtctcattctgtcgcccaggctggagtgcagtggcgcgatctcggctcactgcaacctccacctcccaggttgaagcgattctcctgcctcagcctcccgagtagctgggactataggcaaatgccacctcgcctggctaattttttgtatttttagtagagacggggtttcaccctgttagccaggctggtcttgatctcctgacctcatgatccatctgcctcggcctcccaaagtgctgggactacaggcgtgagccaccatgcctggctggaacctaagtattttaaggaaattaggataatgtggagtttttccacaaacaagattagtctttaaaagtcattgaatttttaaatagtaaatttgtatgaggaattccatttttaaatttagttctttttctttataaaatgtattctcattctcactctgttgtgggggatttgttgccacgtgtgaattaagactgtttattatgataagaatatagataatatgcaaatgaaatggacatattataatggcctacatttcaaacctttttaccataaatatttatttcagaactctcttccattaatgtggtcattgttttcaagctggtgcatattttgtttgtcttattaaaatgattgtgctaaaaataaacccatcactgcttgattaggagtcccaaatttaaaaactataaagattttgtaacttcaaaagacagaaaaataatgatttatggcaaaaattggcaaaatgtctgctggctaaatccagctcaccacctgtttttgtaaataaaattttattaaaacagccatgctcatttatttacatatgctctatggctgctttcacatgaagccgtatggcctgcaaagtctcaaacacttatctgtccttttgcagaaaacgtttgcctgatttagagaaattttttttgttcacacctagtttttcacagagtagattattattttcaaagctaaagctgataacagatttgttaaaaataaaattttaaatagaaaaatgccagtaatatgttaaaatatttaacaataatgtatcttccttccaggcttagaaatttaaaaattttcagtgagccttttgaaagttttgctatcaaaccttaaacatatttgatagtttgatattttgggggagggagagactgaaagtggagatagactaacctattatgaagggtaatttatcactcctataatatttattgtgtatgactttgagttttaaaactccattcctttaacttatcaacctaaatagtttcagtagactaaaatctcaccaaatgacttctttattttttattcttgtcatttcaaccctttgaatgattaggctttaggtgaccagtaggatctgcccacagtagttgcttaaagcagtacactttctaattcctctgtatggctttgtaaagtagagaatattggataaactaccaagattggtttttaggaaagtaaattttggttctttaatacaaagcttgattgtcctttaaaatttttttctctgaaaactgaatttttctctgtgtgtgtgttcattttcttgtttcctctttctttggttcctgttgggctcatttctttgttttccaggcagtagcagcagcagtagttcagactccacatgttctgtcatagagaaacctctggataagttcttgcctagtgagtggtagctcttacattctctaacagagctttggcttttccataacccatgggcttcatttgagcaatgctgcaccactccctgtcattacctaaagaatacatgttggattcctcagtagaacaaagcatgtgatgattcctccaccccctttcattgcttccagttaatcataattgttaaaacataggctttagcttatgtttgagacaatggaagagagattcatgcttttgcaattgagataatgtaaagagagctagtaagctgtataaaagaataattcttatgcttattttttaggtttcatgacacatttctaatcctgctcagaataagggacacgtaacatcaaatcttgtatttctaaaagtacaaattatatttgaagtacaccagtgcccattataacatgtcgtacaattacaaattttttacactttggtgtcctattcttagtggtagcttaagattaaaggctcccaaataaagaaaaacataaagcttgaagcaagtaaagatgaattgaatagtgttttatttcaaatggacatttatccatatttctgtattacctgatagattttaagaaaagttctttctttttttttttttttttttgagacggagtcttgctcttttgcctaggctggagtgcagtggcgcagtcttggcttactgcaagctccgcctcccgggttcacgccattctcctgcctcagcttcccgagtagctaggactacaggtgcccgccaccactcctggctaatttttgtatttttagtagagacggggtttcaccgtgttagccaggatggtcccgatctcctgacctcatgatctgcccgcctcggcctcccaaagtgctgggattataggcgtgagccactgcgcccggctgattttaagagattttctaaggtatgattagagaatgcagaatcacgtggattttatgcaggatccatctagacttatttcaaacttaaaggcttttgttaaaacaatttaattaagttgaaaagtgttatttaatttaatttatttatattttattttcagaagaaaggggagtagtgttgctttcttgtaccagcctgcagcttactgtcttttaaagcattatctatatacttaccctttcaaaactaatgacaaaaataattgcttattgttcttatgcttttagctttctagaagaataattccaagaatattagaaatctccttctctattgacaatttgtaggcaagttaccaaaacaattcatttcaaaggataatttgtaaaatacttggaattgcattagaaaccacatagaggtattactttgtataataaactgtgaaatatgcgaaaatatttgagtgggaggcgttgcaatttagttttctgttttaaaacaattcttaaagagtagttatatgaaagtatgttatgaaatgagttgtactttgttcaattcaagaagttttaattcctatttgcgtacctagcacataatttttttcttgtaatgtgggcgtgttggtgaagtggagagatggttgtcctagcatgtggttgctgtgtgtaccttcccttttaaatatctcaatggcctttttaaaaggtgtttcttgcttgagtccttaattggcagtgactcctgtagaatcattgtttataattacccttaaaaatctactaatagaaggaatgtaagtttgttactgtacaggtatacttcattttatgtaataattttattttctggaaaaaaaaaaaagcccttaatacggttgggaaatcggatgtattgggagaacttgtgtctttaaaaattcttcattagacctttctgttaatcaaataatcagtggaaattactgtaatctaatttatctgttggattggttcaggtttttgtgttagattttcttaaagtgaagcatgcctataatagatccatatactaaaagaaatattgaattgggacatttttgatatggacagtgtgaattttgtcactttaaatgtactagttgttaaaattgccttaattttctgttttgcccttttagattacttcccagatcttagcaggttcctaattccatgtcttctgttagcataaccacatggtgttgaactgtgacctttgcaggacttggggaatcagtgtgagatcttgagattgacttgagttataatctaagactaagttaactttaatattcttgcttaaatgacatctctcgttgtgttgaatatgctttctttttacatgggctctatttcagttttgataacggtttgatttttatttctacacttaaatgaatgctattatatatttttctttgtttcacaagagaaataatgttttcctttttttcctcctcatctctgtgcgtattgcttcctgtctgcgatttgcttactacttcttattgcaagatcaagcaggttggtgtgattgatttgcactccacatggtacaattatttatcctataaagaactatgttatttaaatacattaaatttttaaaatttagtagtttttttaccaggtaagtatctatcttttgtatttttaacaatctttcaactttagcttttaaaaagaacttcatttttttccctaaattcttaaagactcattaagccaaagtttggaaatacaagtgtaaattatttcacattcaaacatttttctccttttttcttaaagccaagaatcaaatacctggttatgccgtggttgcttatgtaataaaaatgaaattaattcaattaggactgccctgaagttcttcccctttgacttaccctggccggttaacgttcacaatattggttagagcacatggcaaagggcaataaaaaaatgttgctacttatgtctggtttagttaaatactgtttatggcattaacttttaaaaatatttatttacctgaaattttgtgctgaattttatcatgcattgttagaaatagatttcttttttgtttgattggtttaagaaggtttttttaaaaaaaagtcctttgaaaaatacatataaaagtgacttttactgatgtcacatttttaaatacctggttaggagagttagcacatattcacatttagcttaaaatattatttgtggagaaatataatgatttgtcagagtgattctggctaaagtaatatgttacttaaatattaggcttttgaaactaaccctggctatatatctttgattgtcttcatgaaagtgttacaagaccacaataagatttttgctgctaaagtatcagtttggaaacatacctgaatggttttaaattactaatgtaatgcattaatgcatgaacagttatgtgtctttgtatttccacatgtaaaatctttttatttaaaaaactttttattttactgcttcttaatgggttttgaaactgtttttaactattgaaacaattagaacccttgaagcctgtacatactactgttcatatgttgattagatcatttcctctatactgttagcatcagtgtcttcatgcatttattatttttgtcttaacatatgtcccattttgtctttaaatatttataattctcaggtggaaaggaagttacacttttttaaatgcgtatacttactatatacctgaactgatacttttctccttcaaatttctaagacatagtatgactgatgggataagtagtttgggaatagtagttaaattattttaaagttattttttaacagctaattcaaaagattcaatacagatgactgtgccaaacaagccagtaaatagaatcagtctacatcctgacttttggaatgcaatgaatcacaccacaccaaagcatgaatttggatcagtgcttttatttactcttttatttcatttgtctcgtgtcttaggtttgctctggacttacagttctatacaaataatgtattttaaaccctagagttttttacataattttgtcataaagagttaaagcctattaatgattcttcatttcatagttcctgaaaaaatatactcagttatatatctccatcataattatttttcagttctttttccttgttaggtggtgggggttagcttttgggtggagacattaacaatttatacactcttatgatttacactcttcttctgtagttctttgggaaggaagttaagaatgacggaaaggttctaggagagcctcagtccaattctgtgaaaagtgttattggttttctgaaggaatgtatgtttctaagaaactgtatgaccagaaatgaattgtctttgattcagtttcatcaccagtttaataagctagttttattttctctttttcatttggattttgttattttgaaattcattaataaactttctttgagcacctattacatgtatgtaaaatactttattagacattattagcaaaaataatcaattggaagccatattccagctttattatttggtagtatttctacttatatttgacacttggcatgtttactctgacttagggagccttcgggtcctgagtttgacataataacaagctattttagttgttcctttagtgtatgatgatatatcttgacagctcagcaactgtgaaatgcttggttaattactgtgtatgtaactgttacataattacatagtatagaattttttcctttaaaagtatgctgtgaaataaaatactttaatgttattaaacaaaaattttagaaaaactctgaaaaatatattaaaactacttgatgtaaattctgcctgatattttcatctgtgcattttatacctatatatgacttttattcacttgttttatgtgaacttggggaagatattttaaggagtcgcttgattttatacttggttatcaggaaaaagtaactgaagaatcatgttgctttttttttaacctatatttgttatctggggacatatatattttttaatttggctttcctgttaatctttcttttcctattatttagctcatctattttgcttctctttcgcttttgttcttagttatcattgtacaattggacaacagtttgaatttagcaatgagttataaagttctaggagcataataaatggaaatgcatgatattattggtttgatttccttaaaatattgataattggttttgtattattgaggagtgtaggcatttctatattgaaggaggtaatttatataagtctgaaacattgattcattttagtgattgttgcaattaaatgattcaaataggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccagtgagtattattgaattgagattaattcatgatttaaatttctgttttttcctaggatatataaaataggaaaattgaatagtaattaaaagcttggatttttgtctccagtgtagctattttggatagaagggtccattgtatatagtgtatttctaaaaactagatctattttggttattttatttccgtgtgataggaaaacatatcaatgaattagaatgagttataaattaagttagaaatcgatactacacagtggtgtaatttggcagagatgttacataattatatttctattttgaaattgtatatccaaattttaaattttgggaaatgatattagtagaataatagatcatcagtgaatatagagtattctcattctaatcaacagacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagaggtaatgtgactttctgtttttagtttggtattttgccagagagatttaacttttctagtggaaagctaaatatctataatcgtattgaaattttaaagcatatttatggattgctttgaagatcagatttgctaaacatttatgtcatttgttaaagaattagatatttgattttacaaagaaatttattctgaagtttactaatttttgtcatagcaagaacgcttggatattgaagaaaaatataccagtttgcaagaggaagcacagggaaagaccaagaagttaaagaaagtttggactatgctgatggctgcaaagtcagaggttggttctcttagaaattacctactaatgcagttctggattttttaaaagggagttctttgattaagaatttataaataatcataatgtgagcttataatttaaaagaaataaaatatttctttatgtgcaatttttaattttatctattagtctaaattgtttcttttcaaccttaacaaatagtgtagaatagatgctgatagtgtcacgctgtttatcatttttataaaagaactaggtaagctctcacaaggtttcttagacaagcatcctatgtgagatggtgctgttttgtagttaaagtcttgtttgttcataatatttttatggattttctggtagatggctgatctccaacaagaacatcagagggaaattgaaggcctactggagaacattcggcaacttagccgggagcttcgacttcagatgcttattattgataactttatacctcgggattatcaggtaaaaaggaagttctctgaccgagatagtcgcttgactgggattaaggaacaaagatttctaatttaactgatgataaatacttaatacttcagttattgaatgtacaattttttgaacaaatgccatcacatttcactttagttgttaacttttaatacataatctctgtttgagtatctagccttttagacgaactcagattcatgtatatgtgatcagaatcaaggtgtaggtcccattccttcattcagcgcccattatcatacaagtagaataaatggaacctctgtgctgcctttttctccctgctgtgggtgctgattctttgtgtgtgtgtgtgtatatggtaaaatatagataacatgaaatttaccatcttagctattttaagtgtgcagttcaatggcatttaggacattcacattgttgtgcaacctgtaccatcattcatctccagatggatgctaattcttagtactagtataattttaaaatctcagcctctattttttttaatccaaaatttgtctttccagtgcattttggtaaactttaacatgatttttttttttttttttttgtcagggagacagagtcactttgttgcccaggctggagtgcagtggtgcaatctcggctccctgcaaccttcacttcccgggttcaagtgattctcatgcctctgcctcccgagtagctgggattacaggcgtgtaccaccacacccagctaatttttgtatatttagtagagatggggtttagccatgttggccaggctggtcttgagttcctgagctcaggttgatctgcccgttttggcctcccaaaatgatgggattacaggtgttaaccaccatgcctggccaattttttaaaaatctgttttgaatctcaatacagttttaagaaatttgtctgaaaataagtcttagtcattttttttttttggacctcaggtacatggaattagtcctgggttcatggtacattctccttattggtccttggatggcctgcttttatttagttattttgtaatgaactcatcacccaaaacaatatctaggaccctgataataactacttctaaccagtttccccttcccttatttcattcctttgcctcttccaacccaaggtaatcattatcttgattcccaagtttctcattctgttgttttttcattttcatttagttttattgcatctgcatgcattcctaagaaatatgtattttagaatttataaaaaggttatatcagtatataatgttttgagactattattactcaatgttattaagattttagttttatgacttcaatattttagatgttattaaatattaaaaataggctatctttcacccttttaaaaggaaatgattgaaaactatgtccattggaatgaagacataggagaatggcagctagtgagtattaccttcattctttcacgtaataattaaagagtacttcctatggtctagaaattgtgctggctacagtggggaggaacgtggtccagtagatgaatcagatgagaatccagtagggcagataaaatatttttctaattccatgtaattaattgtaacatacagatcatggtctgggtggaaatggtcagagttaggggctatgtgggactaagtgacctctggggccctttctgctctagcattcaaatcatgttttactagtgtaatgttaggatttctcagttatttgcctaactcacagtattgattactaattaagacatttctctgtctctcccttttctttttttgagaaatgtgttgcttatacaggaaataacatgaggaagcaaaccccagtacctgataaaaaggagaaagatgtaagagtacttaaaaaaaaacaaaacaaaacacaaaactactgttgtttctttataggaatatgagtcattaaattgtattatcaacttgatatctgttaatcagctctgctgaaaaatgggctgatacttttgggaataaaggctctaggatggggtgatgaggaggacagttctgcttaccatcagtcttgatgtcaggcttattcccaccacaagaggggcatggactcactctttggagtcctcttttcactaccactctgggtcgtaggattatgggtggagactagaatgtgtctttctttctcttcaaagctagttctagtcctaggacaagaagaagagggagcgggccgggcgtggtggctcacgcctgtaatcccagcactttgggaggccgaggcgggtggatcacgaggtcaggagatcaagaccatcctggctaacacagtgaaaccccgtctctactaaaaaaatacaaaaaaaattagccgggcgtggtggctggtgcctgtagtcccagctactcaggaggctgaggcaggagaatggcgtgaacccaggaggtggagcttgcagtgagcccagatcgcgctactgcactccagcctgggcgacagagtgagactccgtctcaaaaaaaaaaaaaaaagaagaagaagagggggcagctttaagaaaaacagcaacagtttttatgtccaaggaaatttatagtgtgtcagggcttcttactcaccaacctttattaagtacattttagatactgggattagaagatgatgtcattagacatttctttggttttagcttctgtgggtttgatcaaggagtttattcagtattttaaatcttcccccaaatctggctttaactctttgccttaagagtgctttgtgtttgtttcttttacttagccctttgaggtggacctttctcacgtgtatcttgcctatactgaggagagtctgcgtcagtctttgatgaaactagaaagaccacgaacttcaaaggggaaagcaaggccaaagacagggagaaggtaaggactgtccttgaatctggtaaaacgaaggcattgaggtattctaattagatacatgtacaggaagttaaaatttatttagttaaaacatgatacatattttggctgatttattaaaaatcaaattcctggctgggcacagtggctcacgcctgtaatcccagcattttgggaggccgaggcaggtggatcatttgaggtcaggagtttgagaccagcctggctaacatagtgaaacgctgtctctactaaaaatacaaaagttaaccaggcatggtggcgcatgcctgtaatcccagctactggggaggctgaggcatgagaatcgcttgaacccaggagccggaggttgcagttagccgagatcatgccactgaacttcagcctgggtgacagaccaagacttggtctcaaaaaaaaaaaaaaaaaaatcaaattccttatgtattagaatttgagtaaataaaatctggccaaagaattaaggtcttccaacttcttaggctcctgagtaatagaatttatttttaattcactctgttatttccaaatgtataatgggtttaattccttaattcttagactaattcttcttatgaaatgctaattaatttgcctgtttggtctcccaaggtattgtattcagctggttagtttttctgtcaggtgccccaagaaccttgatttcctcagtcaccagctaaggagaacttccttggacatttccccctctcctttgggcactggttttgactgttgggtagtctgcgtgtatcatcacataagctcagggaaatcgggatatgggagtcctgggctggagcttatttttttttcctttccctttcctacatcaaggactgttcagtttatttaagctgattttaagactctggggctcctaaaatgtaggaaataataagctgcttttttccctactttgagtgcatggactttcaagttacatgtgggatgaagttgtacggttttgatatctttgtgttacataatctcatagacatgacttaacacttataaatttgggatggttgaactcagggttgggcaaacagttgaatattaaaaatgtacaaatttttacattctttagcatttaggtgaggggttaaaaactttcctataccaacacatgccaagcatattgtagtgaagcaaatcagttctaagaaacatgagtccctttagatgtatctttttttccatttttaataaaatgacagtgcaagtgtgatgataaatggtaagacatttgtccccagcgtaggagaaaaattggcagtggtgagcagtcctgtctaaagtgagtggctgctattctcttcctagttatctatggaaatagagggctcattgtttctggatcttctgttttcttttcttttcttttttttgagatggagtctcactctgttgcccaggctggagtgccctgagtagctgggattactggcacctgccaccatgcccagttaattttagtatttttactagagatggggttttgccctgttggccaggctggtctcgaacccctgacttcaggtgatctgcccacctcagcctcccagagtgttatgattacaggcatgagccaccgtgcctggcctggatcttctcttttctaaggaaaagccagaaattcgaattatttacttgagatctgtcaattttactttttttttttttaactatatggaccctaaagcaaatgaataaataatatgatatttgaatacgttttccagaacatccattttaagatacgtcatttttttagtttaacattaaaaaaatcgtgtggcccaacattatatgagccaaactcaccatctctgtatactggaattggcctgctataaccatggaaaccctaagaaaatggtagccataaacatggacaaatacatgcattaaatggtttattgatgctatgttacattatatgatatgttcaatgtgatgttccttgttagaaacacatagttag

SEQ ID NO: 13799 - DNA, 12690 bp, Human
gccgggcatggtggttcacgcctataatcccagcactttgggaggctgaggtgggtggatcattttgaggccaggagttcgacaccagcctagccaacatggtgaaaccccatctctactaaaaaaaaaaaaaaaatacagaaattagccaggcgtggtggcatgtgcctgtaatcccagctactcgggaagctgaggctggagaatgccttgagcccaggagatcaaggctacagtaagctatgatcaccactgcactccagcctgggtgacagagtatgggggcagggggtggtgaggggggggcggggaagtggaacagaggcaaaaccttagcaacacacatttttagatgatcttccagaataaattcatagggaggcccaggcacagtggctcacgcctgtaatcccagcactttgggaggccgaggcaggcggatcacgaggtcaggagatggagaccatcctggctaacacggtgaaaccccgtctctactaaaaatacaaaaaattagccgggcgtggtggcaggtgcctgtagtcccagctactcggggaggctgaggcaggagaacggcatgaacccaggaggcggagcttgcagtgaactaagatcacgccactgcactccagcctgggtgacagagcaagattccatctcaaaaaaaaaaaaaaaaaaaagaaattcatagggaaaagaaggtcagagaccaagggaagggaaggttctgggagaaaagcagggggcaggcagggcccaagaatcctgctgcccatgagcccttactgggaggtggggtggccttgcacagggcccaggcacctgagtgagtggtggggtccttacgttcactgctggggtgaggcaatgagcaccttattgtgtccacatgaattcaataaaaaacaagcagggcgggtggtggggcactgactaggagggctgatttgtaagttggtaagactgtagctctttttcctaattagctgaggatgtgtttaggttccattcaaaaagtgggcattcctggccaggcatggtggctcacacctgtaatctcagagctttgggagactgaggtaggaggatcacttgagcccaggaatttgagatgagcctaggcaacatagtgagactcttatctctatcaaaaaataaaaataaaaatgagccaggcatggtgcggtggcacgcacctactgctaggggggctgaggtgggaggatcacttgagcctgggaggttgaggctgcagtgatccctgatcacaacattgcatttcagcctgggtgacagagtgagaccctgtctcagaaaaaaaaaaaaaaagtcattcctgaaacctcagaatagacctaccttgccaagggcttccttatgggtaaggaccttatggacctgctgggacccaaactaggcctcacctgatacgacctgtccttctcaaaacacctaaacttgggagaacattgtcccccagtgctggggtaggagagtctgcctgttattctgcctctatgcagagaaggagccccagatcagcttttccatgacaggacagtttccaagatgccacctgtacttggaagaagccaggttaaaatacttttcaagtaaaactttcttgatattactctatctttccccaggaggactgcattacaacaaattcggacacctgtggcctctcccttctatgcaaagcaaaaagccagcagcagccccaagctgataagattaatctaaagagcaaattatggtgtaatttcctatgctgaaactttgtagttaattttttaaaaaggtttcattttcctattggtctgatttcacaggaacattttacctgtttgtgaggcattttttctcctggaagagaggtgctgattggccccaagtgactgacaatctggtgtaacgaaaatttccaatgtaaactcattttccctcggtttcagcaattttaaatctatatatagagatatctttgtcagcattgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaaggtgagtacctatctggcaccatctctccagatgttctggtgatgctctcagtatttctaggcatgaaaacgttaacagctgctagagaagttggaactggtggttggtggcagtccagggcacacagcgaggcttctcccctgccactcttttttctgagggtttgtaggaagtttcctcagttggagggagtgagagctgctcatcaaggacttctctgtccggttggaggttaactctgtctcttgctctctcatttctgcctggaccaagactctgtgcaccgagttgaccgtaacagacatctttgctgcctccaaggtaagaagccgtcccacggtctgttttagcaaatggggagatccatccccaaatgtctgaacaagaaacttgtctaatggaaaacgagcgggcccaaattaactctaaggtgttagatgttttcaaagaacgagaagtctgatctttactcttaagcatgttttggtctttctggtttcacttgatttagaagacatgtaatagaaagcttacatgctgtagtcctgactcagatcctggtcaaagaaaagccctcttgggttttacttagctttggcatagtgcctggaacgtaggaggcactcaataaatgcctgttgaatgagagaatttttctggcccatacatttctgaaaaaccaaatactctcacagaaacagatattgagatgacaggttgagggagctttcattttgtctaagagacttcctatggcaacagaaaaggtatcgccagagcccctcctcttccacagcctggccacctaacagccctctgggttccggggctggccgtccagagctcctcagcttgctctggccggccgaactcccctccagctcggtctggaaccatcctgctgggcagcgtccagcacatccctgcttcgggctgcctgggcacctcgcctctctgcctcctgtgctgcctcacccccacccctctatctgtagtgggaggagatagatttgacagctgatagtgcattttctctgacaaacacatgactacagccgtatcaatagttttgtgcatttcagttcctgttttcatggaaacacacggctgagaatgaaagccccaaagcctcaatttcacagtggtctcctaactacctgctttccatgcaaactagggagatgatatggccaggagtgaagccctgtgtgttgggcagggtcacactccagcacccagaccatagaacagggcccatcctgcttcatgagggaaactgctcttcgggcctttagctggactatctcatttcattagttatcccgggagtccgatacaggatgagattctgaagggcaaatacacactttttttttttttttgagatagggtcttgttctgtcacccaggctggagtgcagtggtgcgatttcagctcatagcagcctccacctcccaggctcaagctatcttcctacctcagcctcccaagtagccgggacgacaggtgtgcaccaccacgcctggctaatttttgtatttttttgtagagatggagtcttgccattttgcccaggcttgtctcgaacttctgggctcaagcaatccgtccacctcggcctctcaaagtgctgggattagccactgcacctgggcaacagtttatgtgtgtgtgtgtgtgtgtgtgtgtatatgtgtgtgtgtgtatatatatgtgtgtatgtatatatgtgtatgtatatgtgtgtgtgtgtgtgtgtgtgtgtgtataaaatctccaagtccatccaaccgagatggctcctactagaagccaagagtccaccgggttgagcactgggtctctggaggcctgtggcactgctgagaaggctctaacaaagccaagggaagggccacctcactagaagccaggcctggaggaagggtgagggctgagggcctggaggtaagactgcctgtggttttagacccagctctgccactgactagctgtgtggctggccttcagcacatcttcacacctctctgcacctcagtttccacatgtgaagatatgaaagtgattctgaaggtgattgcaaggttgattggaatccagctcttgagttagtgcaaagtgttattgtgagatgatataaccacgattaaaagcaagaacaggtgcagagaagcgatgattctaagaaggaggggaccgggttggaaaggatcaaaccatccaggatgccgagtctggggcaatccatctgggctgtttctggaagacccccgggtgcaggccaggacactgctgccctcccgtccttaactcccctcttcactcagtcctcactcacctccctctcacacacacaaacatctcctagaataatccccactgcctgccttcactcttacccgtctcatttgcctcccctgaacttcatcctcctggagttcacgatctcactcttcactcttttcttcccctcgaagattcagcactgcttacttacatgttaagatatttcagaacagtgaaatgttgctattttcaaaaacctacaaaggtggtatgcagaggaaaaggtacttctttgtgttcccaaagaaaacatctttccaaaatccagcctattgattttatttcttcgggggaacaagaattttagtatctctaagttgggtagcattctactcttggcagttgctggaaagaaggcactggtctaggtcctgggcttcacaggtaacacctgtcagggtgtctatgaagtcaaggctgtctgaggaacagcaaagtgggaagaagcaagctggctggctgatgaagggtttcttgggtggacaagtagttggagcgatttcctatttaccaaagagagctaaagttcataattctacagagagttccataatgaacctcaaatacctctgttttttgaaggagtttctcatatacagcactagctgactatcctgggcaggatgggagataatgaatgcagtgccaatcgggctggatttatatggtcctcagtgaggctggtcaagaaccgagttagaactctcacagagtcactgccacagaagaaatctcccaagtggctgtttcctgacattcccgggagggacaggcctccttctgagtcactccctaagcagttctgaactgtgaggtcagccaggctgtccaagtgcactccctgagccactggcagacacactcagcagccagagctagacaggcaggtggtaggagtccagggccacggcagggatggagtgtcgccccctcgctgcgataccagagcaagtaaaacgttaaggccttgcactaaagctgcccttaggatgcattcttttaaagtttttccatttaatgcagactcttttcaattcttattttatccttgtttcctttagaaagtcctttgaaaaatatctttagagggttttttcctatactatgtggccatatacgggtcaaaattaagtttaatttccaggctccaagccagcgtttcagaaaaatctcaccaaggtttgtggtaaaagaagcaaagggctgactttttggttttcttgaatctcactgttccctctgcagcagcatgcatgtctgcccacctccagacacacaggcaccatctgccgccccccatcagcccgtgtcccttccacctcgactcgcctacaaagcccagagaggtctgtttcttggcccccagagcccaaagatactgacacactcttacatttccaactagaatcaggaacgaggagtgactctcagtcagttcattaagtaaatgtctttctaaccgctctgcccatgggacatcacgccccacaggggaaaggggaagcttctgtagcctgggattctggtgcctcagtctgggtctagactttcctgaaaaaacgttaaaatatgaactgcattcctagaatttagcctacataaataagagatgaacacaaagatttctatagtttactcactgccgcttatttacagaagcaaaaatctgccacgataggggcctgacaaatgacagtaccactgtgcaatgcgtttctacgcagctctcaatcccatgttctctaataccaccgaagggcttaggaaatgcttatggtatatgtaaagagtaaagaagttacaaaacagtatcaacagttgacccctattttaaaaagtatttttaaaagtgtgacgatatttaccaaaatattaacagcaatagttacctctggctggtgggatgagtgaatgtatttttgttgaatatatgttacctttatagtaaatatatgttatcttgatcatcagaaaaaaaaatatgtaagaacttgaaagctgcttggacagcgctgctgatagaaacccctgagcatcttgtcactgttcttctgattcagagggtctgggtggggcaggggtggtctgagattctgtatttctaagaagctcccagtgatgtccatgctgctggtccatggaccacactttgagtatcaagggaccagagcatgtcgggggagaggctggggatagctttctttatctgaactggataaaggaactgggctcaagctaagaaccctctccaggttctgcatctttgttcttcagtgaaaaatgagaggacacaccaggccaggttcagactgagacacaatccctctcctgggttcccaatgacttgtctcttgtccattcccttctctaaggctaagggcccccaggaagagccatgtggccagaccctcacagttgctggcattccaaggagattctcactccgcatcatttggggccaaaaggccccttacagaagctctgcccaaggctcagatcaatggcacctgctcccagagcctcctctgatctcccaggacacctttccctgatctgtgcacttatctcttgctgcctggcaaaatgtcttagctcctcacttgggccatgtgctgctctcctctcccatggggagagccacacggagagtgctggccaaagcagcagagttcaggccaaaggatgtgcactcatttattcaacaggcatgcaggatttccagggaaagctggattttaaaacctctgggaacaagagcagaacctgactgagagctcatgtgggcacttttcatagcagaatagctcatgaggtatagagacacggacgcagaacgtgggctgtagcgacagatggtcctgcattctagtccccactgtgccttttcctcatgggatgactttattcaggtaccctttcggcaaaatcctccaagagaaaggaaactgggaggttctggggagaaggctgctgcgtttgcaattgggagaggttgttgacagaggtttatgtctgtggcaagcagccttccttcagtggaatacttgaagacaggtctgtagttgagcaaactcacctccatttgtcctcctggaaagaagaaatcaagaggaaaaatctctctcccatcctccaaatggagctggcacattgctatctgtggcatttgtctttccagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttggtaagctgcactgtattcctggcaagccggccgcgtggctcctggtggacagcagcctcacttctaaacactccttaggagctgcagcacccttggtcaacccattcattcattcactcattcaataagtatttgctgaagttccacaagtgctgggtgtggttctaggtgctgaggacgtgtcactaaagacacgcaggccgagtccctgttctcatggaatgttctaatgggagagttagaaaaacaaacatgtaaaatgatggccagcagtgatacgtgctacaaagaaaaacatagaaataaagaacataagagtcatgggggagggggctgacttaggagctggtgacattatctgagcagatatttgaattgagggagcaggccacatgactaactagggagaccattccaggcagaaggaggaggtatgcaaaggccttaggatggaaatgaactaacttcctgtatttaaagaccagtaggaaggccagtgtggctggatcagagtgagtgaggggtagtttccaggacagcagatcacacaaggcctttagattccaccacgagtatggcagggaacacctgcagagctttgggcaggacaaagactgtacaatctgatttacgtgatttaaaagggtcagtctggctactgtgtggtaaataggctgaaagggggaaagcatagaagcaagatggcctgttgggaggctaccacagtaaaccaggctagagatgatggtggcgtggacagaatgaagcaagatggcctgttgggaggctaccacagtaaaccaggctagagatgatggtggcgtggacagaatgaagcaagatggcctgttgggaggctaccacagtaaaccaggctagagatgatggtggcgtggacagaatgggagcagttgaggtgaacagatttgggatatgactaaaaataaaaccagaaggatttgctgacagatcggttgtagggggtaagatacaggggaggaaaagatgacctctttgttcctgcccaaacccctctggcgatggtcagtactgtttacagagagatgaaagactggcggcaaggcagggctggaggttcagcagaagatcaagagttcaattttgtacatcgtacatgtaaggtggctcttggatagccaagtgaaggtgttgagaagatggttagaaaagtctggaacttaggggagaggtcagaacttgcaatacaaaaaggagagtccttagatagatactgctgaaaatctgaatgacagaaagggagagatcaaaggactgagcctgagatcaacacatggaggtcaggagaggaggatccagccaaggggcctgaggaggagtgaccagtgaggcaggagaacactggagagtgggcggtaccccaggaagccggtgaggacactcaaggagggagggttgactgtgtcaaatgtactgaaaggacaggtcaggtgaggaccaagaaaggcccctgggtttggctgatggaggccatgggtgaggctgatgtaaatggagaggcaggaaggaaagcccagctggagtgggctcaccgaggatagggtggcgagaggagacaaagaaggaacagtgagggcagaacactctttgaagatgtttagctataaggctgcagagaaactgacccacagctgcagggtggttatggagtgagggaagctcttttaaggttgggggtatacccagcatgttaatgcacctgggggaatggtccagtggagcaggaagaactgaagagagcagaaagaggaagaatcattagggggcagaagtccttgtagcccagagtggatgttatctaatatcgagtggaggaattaattggctttagaggagaacaaggacatgtatcccctctctgggcctatcaccttgtagacaatgggataggtcatgggataggaacttggcacaacacatgttctctcttttaattctctccattatcttatgaagcaggcaagtaggcaaacaattgtcccaactttacaaaagaaactgaagcttttataaattaagtagtacatcctaagcaatacaattaataaatggtagagctgagattcaaactgaagcagtggcctgggggtagcatctggaatccttcccacctttagggctgctgtgctgcggtgctgctgtttaatggcacaggagggccacatgactgaatctctctcagcagtccaggcagtcatgcagaaggcccagtagagcaccgggcaggtctgagccagcatcttcaagttccaccctctgagcaagcacctagctgtgacacacctctccagagactgcactcccccccgcgccacccaccccaaaagcagataggtaatggtatacagtaaccatttctagaagtgtaagtagtatgcacccaaaataggcaaaacctgctggcctagtgatagagacaactcccagtcaggctagactggaggccttggttttataagtgttcaggtgacaagtgccacagtaggcttgatcaagtagacaggcaggcaagacaaatgcttaccaatgcaagctaatgaaatgtttcttttgcagaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatctaacagcaatggcatttaatgtattggctatgtttacttgacaaatgaaattatggtttgcaacttttagggaaatcaatttagtttaccaagagactataaatgctatgggagcaaaacaggaaagaccacttccccctcgaggggttccctctcgagttagggacataacacacaagataattaaagaacacaaggccatacaagatgtaaataagacaccttgggtccaagagtgctatggattaccatatatttctgaacagaaaaggtatcaactggatgtctaaaacgttcttcccccattggcacaaggattgttatactgagtctacagaaaaaagaagtaatcctcagtacaccatatggctctacagtgaacgatatttaaagtcataataatgtaaattctcttgattctcaagtcttagaaccaaccaatagacaaagcacagaagacttgatgatggttggagaacagactataaattgctatccactgaataatataagagctatagctggaaatggctgggaggtgaaagcagaagaaaagagaggtgggcattgctatctccagcttgcatggacaagagggcagttaaataacactgtgcacagtggatggaacaagaacacaaggtttagggatttatcaaaatcacaaaggtaatagaagaactaaaaataatttactataaaaatttggaagtgatagaattaggtaaattctctttcttcaatagggaaatcaatgtatgacatctaacactgataaagcaaaaaacagtgggtaaaagtggtcatgggttgacagttgttgcagctggggatgtgtacagggggttggttatactattctccttttatacataattgaaagttttcataataaaaagagaagaaaaaataatgaatcaagcaatctttggaattataatgatagtcactggaaaaactaaaaataaaaatggaagatggtttgctgggaatgggacttggactaaggaggggtgaaacagggctggagactttcggctttccattataagtctgtgtgtgtgtgtgtgtgtgtgtgtgtgtgtgtgtgtgtgtgtgtgtgtgtgtgtgtgtgtgtgtgtgtgtgtgtgtgtgttatgtgcataaatgaagttttttcattaaagaaataacatttaaaagacaataactgttggtgaagatgtagaaaaattggaaccctcctacattgctggagtgattgaaaaatggtgtagtcactttggaaaacaattggcagttcctcaaaaggataaaatagtttacgatccagcaattccaatcctaggtatatacccaagggaactaggaacacatgtccacacaaaaacctctacacaaatgttcatagcaacattattcataatagcaaaaaagtagaagtggctgggagcagtggttcacacctgtaatcccagcactttgggaggccgaggcaggaggatcacttgaggccaggagttcaagaccagcctgggcaacaaggcaaaaccctgtctctacaaaaaactagctgagcatggtggcacatgcctgtagtcccagctactggagaggctgaggtgggaggatggctcaagcctgggaggttgaggctacaatgagctatgactgcgctgctgtactccagcctgagcgacagaataagaccctgtctcaaagaaaaaaaaaaaaaagtagaagcaaccaaaatgtcaatcaactgatggataaacaaaaagtggcatatccatacaatggcatattatttgtcaataaaaagaaatgaagtactgacagaggccacaacccggatgaaccttggaaacagtatgtgacgggaaagaagccaaatgcagaagaccacatatggtatgattctactgatatgaattattcagaacaggagaatccacagaggcaaaaatagaatattgattgctacaggctgtgggtgggaggcgggtgtggaggcatggggagtg

SEQ ID NO: 13800 - DNA, 29876 bp, Human
agcacacaaaaaaggagtttattttcaagaagctttgctttctttttcagttagttctagataagaactataacttcacataagatgttagaaggatttaagtacattgctgaaggtataaccatccatcttcaggaagtaagaatagtgaatagtaagtataaagaaacaaacaagtcctgtgataacatctttatcataatttttttaagtctattatgctttatgcaaatgtttagatttccttgttaaaaatctgctggccaggttaggttccctttctgtagctttattttcaactcataatatagtgactattaaatattctttacccaacacattatattgtaaaaatatacacttagttctgtttctatcactaagccactactattttaaaaaggaatatcttgcattgttaagtttagcagcccaaattcttaaaggccttaggaatggtgctgtccaataagataaccaatagctacatgtggctactgagcacttaaaaaatgagtctggccaggcatagtggctcacgtctgtaattcagcattttgggaggctgaggtgggaggattgcttaaacccaggagtctgagaccagcctgggcaacacagggatgccttgtctctgtaaaataaaaaaaataaaaaaattagctgggcacggtggcatgtgcctgtagtcctagctactcagcaggctgaggcaggaggcccacttaagcttaggagttcagggctgcggtgagctatgattgtgccactgcactctagcctgggtgacacagtgggaccgtgtctccaataaataaatgaataaataaatattaaaaaataaaaagtgtggctagtccaaattgaaatgtgctgtaaaatacacactggattcctttttttttttttttcaaatcctgagaacctgtgaaacacactgaattcttaagatttagtatgaggaggggaaaaaaagatcaatgatttacatataacaatgtaaaatatcaataatttctatattgattatatgatgaaatgatcatgttctggatatacttgattaaatataccactaaagttaatttcatcttttatttttactttttaaatatgcagcattgcccaataaaatacaggacaaccagttacatttttattttatatattcctgcttgggacataatatttaaaaattattcattctatatctgaaattcaaatttaactaggagtcctatatttttatttgctaaatctggcaattttattaatatggctactagaaaagttaacataacaaatgtagctccttatcctatggaacattgctgctttagaatcacctcgctgctttttttttttttccagttagcttctgaataaactctgcacggaaataactaatctgtggggaatatttaaccctaggctaggatcgttaatcgtgaagttaaatttttacatctgcatgaacaaaatggcttgttacagacgaaaatgtggaaagggcatctggactagaatgaaaagtcatagctcccagcctctctactagggtagttaacagtcccaggttcaaaataatccccgtccctcttataagattaggcggtgtcaagagcaactatctgtgagaccctgggccagtgactttctccttacctccgcccccaagtaggccttgcaaaaagctgggaggggtgcgttttcaacactggagcttcgcggccgctctcccactcgctccccgcccggcgctagaggagcgagttcggactcggaccccaaggcctcgagtcccgctgccttcctaagccgagcccgggctacctcggtcgtccccagcaggcttggctggcagaggccgggcctcgccaggtccccaggacaggccccgcccgggcctcaggtgcactcccggcccgccccgcgccctcgcgtcccgccccagctccgccttcgccggcgccgctctgcctgccagcggggcgcgccttgcggcccaggcccggaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgctcgggctggagccggggcgcgacgtggacctggggcagctggagcaggagagctgtctggatggctgggagttcagtcaggacgtctacctgtccaccattgtgaccgaggtgggtgccggcccctgctggggctgagaccagggctcggaggacctgtcgcggtccttgaacccgagctcctctctcccagatgcgcactggacgctgtcactccccctcccccaacggtcaacaccctagcgatggagaccctccagccaggtggcttgggaacgcttcacgaggtgacctccagccacagtgtgctcctccctgcacaggtggtcagtctggcctcccgtcctgatggccactttgaagagggtaccaggaaggtcctggcggtccctgggcgatgctctatggccctgtgtgtccaggacttactctagttggggttgggggtggtaagtagcagagccaggacttgggccaggggctatcccgtttttcctctagtctcttgatttctttttagaagagaagaaatacttctctttcctgaacttttaaaagttaaataaagcatgtgtatacaactgcctcttccctttttcctctagttactccttcccctaccgtccacaacccaaaaacgacaatctggtcatgccctgtaagtaattgtttgccttttcccatggtcagttgtcagtcttttttttttttttttttttttgagacagagtctccctctgtcaccaggctggagcgcagtcgtgtgttcttggctcactgcaaccttcgcagtcgtgcgttcttggctcactgcaatcttcgccttccgggctcaagtgattctcctgcctcagcctccgagtagctgtgagccacgacgcccagctaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcatagggtgtaggggagcctttctcatttctcatccccttggattttccctctgggtggttttgtctgtcccctccgaacctgttggagcagttgttggagctggatgtaggaacatgatgttaatgatgtatgtgttttgtgtcttttttagacactggcactctagctccctgaagtttcagcagcattgagtaagtagccagtgaatagccctcattgatagataggctcactaaatgtgcagatgaccaattcgcaggttagagaaggcttcccagaagaggaggcctctcagtgagcctagggtgttcagctcagcataatagtgagctgaaggccccaatgcagcagcaagaaaccacccagcaggacggcggagttcacagagaggggagagttcatagagagggagagtgccacaggccctggcacagcttcaagccctgctggatgttggtgctgagcctcccctcctggagcctcagaggggcttacaggggctctggagatcccaactgtgttgcttcttggcgtcatcacccttcaatggagtctgagagctaccctgggagatccaagtgtgtgtgcatgtgtgtgttttttctttttggaaatttgatgtccccagcatttggacctgctttctccacatatatgtagtgggagtgtgaccggagccccactgggatttcttagctagtgacatagcttcagtgtccagaggcatcatggcttgacaaaagaggcactccttggaggtagccaactgtgctttctggcccatgaatccacaggaaattggaactttcagttgccacaaatcctgggtcctagcctcacaggtgggtgtgttaccttcccggaagccagtgagtactatgaaagcagaggctgtccctgaggttgcaggcagaggccacagaggggaacatgacacaggaatccctacaaattctacttggggctgcctaaagaagagggaagtagtgaagcaagaagaagcacatggcatctcttggagttttacattgacccctgagggttccccggcttactctagtcacttgttcctgctttgctgcctccatcccacattgggctgagtgatggtggcattgatgagctcccaaaggccagctgtgccagggggtctgaccttatcttgctgccaatgtcagccttttgttttttaatatttagactatttatttagctgtcttagcagtttcaaaggagttatgtgccctttcacctacttatatgttgtcagtctttgcagggaggccagattaatgcttagatctttgttttgggctactggaatgcttgacttgaagttcagagctgcttgttcccaggtgaacagctactgctggaagttgctgcatcaacattctaatggctttttctatggcctgttgtctttcaacccaaacctggcctgctgaccactgcatctagtcccatgcctgctaaatgtctctaagcctgccctctgccccaaatcatacataaaggtgtttgtaagtacactggtattgaattactagtcatattttttccactgaagactggaacctcaggtgtcctgtttggatttttttaatttgttcaagttaaagtacatacatgtagtaccaaactttgtggtggatttagatctttgcgtcttcctcaatttctgacacaattctggatgcagagggaggttctcaggaaaatttttattgaatgagttaatgaataatttaagaaatcatctctaaagtttgagaactaaagaaaaatagttcagttcttagaagggaaacttgagggtggctgaaaaggattgactggaattttttaaaggaaatgtgactccccctgcccactgactggggctttgatgccacatggatgtggaatgaggtgttgggattggcagagggaatctgctagcaattaataaataaataaatattggcagggcgtggtggctcacgcctgtaatcccagcactttgggaagccaaggcagcaggtcacttgaggtcgggagttcaagaccagtctggccaacatggtgaaactccatctctactaaaaatacaaaaattagctgggtgtggtggcacatgcctgtattcccagctacttgggagactgaagcaggagaatcgcttgaacccaggaggcgggctttgcagtgaaccgagatcgagcctctgcactctagcctgggcgacaaagcgagactccatctcaaaagaataataataatattaataaataaaaatgatttatgaggtaaaagagttttatgcccccatgttccaggaatagtttggtggtccacatggttctcggctggcctctcctctggcccctcagtcatccctggggtactggggaattagccaacccatcatgcagtgcttcttggccatggactgccccatctgctggaaacctgggttgtttctgaggttgtctgggctgtccgctctttggtttcaccatagctctgtccagcctatggacagacaggttccttgagaaacttccggctgggtgtggtggctcatgcctgtaaacccagcactttgggaggctgaggcaggtggatcacaaggcaggagttcgagaccagcctggccaacatggtgaaacctcgtctccgctaaaaatacaaaaattagccctgcgtggtggcgggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagacagatagtcttagaagatgagagagccctcactgttatccccaaagctgcctggaggaaaagccagagcaacctgggagctgggaccggggctgactctgggcagcagagacccgagagacctggagcttgaacctcactgttacgcctttgttgatttctctcactcaggggacacacagaccctcatccagccttttgcagctatatggcaaggcagagaagccacttgcggggtcccgtggcccactatgcacgtacatagtagacacatctggccatgagtggtcagattgagccactctctagctagctgacacctgtcatcctgggtcaaatttctgacagttgacacaaagcagggggtcagggagccaaaaaaaaaaaaaatggccaggtgtggtggctcttgcctgtaatcccagggctttgggaggccaaggtgggcagataacctgaggtcagagttcaagaccagcctggtcaacatggcaaaaccccgtctctactaaaaatacaaaaattagccaggctggtggtgcatccctgtagtcccagccactcaggaggctgaggcatgagaatcacttgaacccgggaggtggaggttgcagtgagccgagattgtgccactgcactccagcctgggagacagagcaagactctgtttcaaaagaaaaaaaagagtattctggagattgaagttcaggagttcagggttcatctcgactttgggcagccaagcaagaactaaagtataccaagatgttgaaggttgatacctttttatttatcgattcattcactcacctatgtaccaaagagctcctgagcctctcttctatacagggggcactgccaggagttgtagaggatgtgatagcaaagataggaaataccttttctctttgctctgacaacggtggggcaaggattcatcattgatttcagcaggaggcaggataaaatgtgtgtaggaatataggaatacatggcaatcagtaacatgtggtacctagcagcatgtctgactgttgatacggtcaggctaggtacatcccctcagggaagaacttctgtcttaggggcacacaccctatcttttttcccttcctgccaattcacaggtaagaacatttagtcccagggaactatgtcatctctctacttctcataactgaaaaagcagtgccaattatgtatgaggtataggagacacaattctccctctttttaaaaatgtttaatagctttattaaggtgtaaatgacataaaaactgcatgtagctaaagcatgcaatttggcacacatgtatctctacacccttgaaaccatcaccactagaaaggtgcatttctccccaggaagaggggcaagtctaggccctttgccagagttgctcccagattgttttcaggttgggcctgcattcacagctcagccagctgaagggtgacagcattagactcgtgacccaaatcttaaacccacacattccattttaacattgatacctgtgatcatcagccagtatagcccatcccatgtgccaggcggaggcatcaataagctggtctgtagcagctttaatcacagctggggagccaggagctaaggaatgctagactcctttgtaaacaatttaagtagggggtacttagcctggactctatgtgcttctcatccacctcttctcagggagattctggccaagtcctggaacctactgcagtccatctggtggttgacagatatgtggacggattggcaggctgggacccaatctatgtttgcccttgtgttcagttttgagacctagcacctttcctgatcctgctcacagaccccctgcggccaataggaaagaagtgttaatgcatatttgcttttggagggcccaaagccaggcccagagagttgtcaagggcggtcagtggtgggtggatggcagagttaaccaaggagttacacacctgcctagactaaggacaggctggaccaagtagagagggtggggctaagggagcctgagagatgctctggggcctatctcaaaatgagcactatagtcaccctgtcccctgcagagattgtctgacctggttttaggtcacacccaaccttgccagccaaggagtctttagaagcctgatattgggagacctgtcctggggtctacaaccccagaactcactgcagaagcccacgtggattgctagtctagctcagccatatgggtccccaaccctcacctcatgatagtcctgtgagaaaccgctgctgaccctttgttcatgttttcatcttttccactataaaagacatgctagctgggaaatagagcccatcatactcaagagtggcaggagccaggtcctggcccctgaagcttggcctcacacacagaggccggcaccctgtcatcaattccctcagctttttctccgcctccactcccagtcctagatttagcagccatgtgtgggtgggggccactgcagggatacttacccacctaccagagagatggcctgtgggtgctggcccttctgaggctgtggaggttggaggctgtggcagcctgggcagtcaggctgtggtcctcccatgttcttgactcctgctagtctgggctgcctcctgattaggggttggatgctccagttcttccctgggttggggattgccaccctactcccagcccatccaggttcacgcttattccaaagcggagcaccagcagtgtgcctgctgcgggagttctccgtgtccagcctgagggttgcctgccaacccctctgagaggtgcccggaggctgtgcgcccacactgcccagcagtgcggagaagcaggcttgtttttccctgtcactggcttggaagagatgctttgttctagggagccgcatgtccccttgcctgcgttgttggtgaggagccagcaggctccgtggagggcaggctagcagcctggcaccagggaggcaagggtctgagttcctaggagggtggttgctcatgtgagaagtctgcaaaggttactactgagcaccatctctctgtctgaaaaacatttttcatttttctgtgaaccactaagtttcccgtttgggctttcttcctgcttttggctcttgtttaggcaggcgcagccagatccaagcgtctggctgcttccccatgtcttcagacctctttttctgttcatggtaactatagatggaaccacacattggaagctggaaactcaagcggtgcagcctattccttaccccaatccctgttttacaaatggggaaatcaaggcacagcatggggtgatgcttatctgaggttggaagagttaatagtagagtgggagctaaaacccagtttcttacctccaagctcagggctttcagctgtaattgagcctagtatagttggtgtgcagcatcagggattccagctctaaaggtcacaaaaaggacccgggggtcattggcccagggtgggaacctgagcagagcaggtccagatggtgcactctgtgccctggccttagtttcttgctggatgctttggcccgtagagccccagagccctgcttccagaaccactccagtgacgttcatgccaatggcctgaaccccactgagcgagggtgccctgcctcttccacagccctgggctccgctcagatttttaggagcaagcgttagaggccttgctttctccagggtcagcatgtggacagaacacttactctctgcctgtctctcctcctcaaaatggaagcaagacagtggggcctacaatgctatgaaaaacaggatgggaaagaagcctgctctctgccttcctgcccaggtgagccatcacctgactaagtgagttcacactcagagcgtgtggggatggcaggatgttctgacttcattttccaggatgcctttgctttaaaaccttttaaaaagaagtgaatgatacaccccctttgctcatcttgcagtggaacctggtgtgtgaggacgactggaaggccccactcacaatctccttgttcttcgtgggtgtgctgttgggctccttcatttcagggcagctgtcagacaggtaaggtgtctgtcttctggagcaccaggggacctcagcactgaggaagaagcgtgtgcctggcccttgatttcagttggtagtattctttcagcgcagggccctgtattttaaagaagaggaagctatgtctgtgatatagactccatgcctagtaagaagagccaacaaatctgactccgtaattcttgctaagtaaagaaacctgagctgtctaagctgaatgtatctgtgatccggttgactaggtaatatgccatgattcacttctgcagtagcctggcttgcctcccctgggtcactgtgactctgtcatgcccctgagcatgggagaggttgacatcatgcacacatgcacatgtgctagattgtagatctgtagtagtgccacggtgtctgcctctgtagtcccaagaagaccagcattctctctgcaaagtgaaaggagctctcaccagccactagtggtatgaaaagcagaactcttttgtccacaaggctgatgccccttagctaagtggcctgtggttttggcatttactttatgacaggagggagaatagtgttttgatccatttcttataagcaggttatttgtataattctaaagcttttaactcaaggaaacattaacggcttagagaatcccaaacccctcgaaattatatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatggcacatgtgagaacaccccacaaatcggtgggttagccggtggaaaggagtcccagcatcttccctggtttttaattcctggcctcaagcaatcctccctccataacctcccaaagtgctgggattacaggcgtgagacaccatgcgcagccagatattttttattgttgttgtttttttttggaaaaggagtttcactcttgttacccaggctggagtgcaatggcacgatctcggctcactgcaacctctgcctcccaggttcaagagattctcctgtctcagcctcccgagttgctgggattacaggcatgcaccaccatgcccagctaattttgtatttttaatagagacaaggtttctccatgttggtcaggctggtctcaaactcccgacctcaggtgatccacccacctcggcctcccaaagtgctgggattacaggcgcgagccactgcacctgcccagccagatttttttttaaaaagcaggttaacctgtttattattcctactttacagatggagaaagtgagacagagggattaaataacttccccaaggtttcacagctggcaagtggcagagttaggatttggacccaggtagtcttgctcctctattgtgtatggactactgttctaggtccctgctgtcctaaaacttgctttctagcaaggtggaatgtattaaacaaccaagtgaggaagtcgttgttgtccttggccatggtaagagatacagagaagtgcagggtgccacaggagtgtctaacagaggaggtcaggggcagcatccctgagaaggtgaagcatgagcgagagtgggaagatgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtcctttttttttttttaaagatgctttgacaaccttgtgaagaaagaattgaagggaagcaaaaggtgttgtagagagaccaattaaaaggttgtcacagtagttcatgccagagatgatggtggcatggcctagcatgacggtggtagaaatggagggaagtggtaagaggtaaaatcaacaagacttgccgatgggctggatgtcggaattgggggaagaaagctttctggcctgagtaactgggtgaatgaaggtacacttctctaagacagagaatgctggaaaagaaccacgttcatggatattgagttcaatttgtgtgtactaaatttggggtgactatgagacccctaagtggagaagtagagtgtgaagctggctgtatggatatggtactgcatgagaggttttggctagagaaacacatgtaggatttgtcagcatatagaaccctcagcagagccccagatagggatgaggttgcctggggagaggggagtggggaggggaggggggaactgggggaggattgtgctatgcttagaggccacctgagtggacatgggagattccttctcacggagctaagtgacagctgcggctcagaagaatgcccttgatgtgaaaaggagataccccaagttcagagtagaaatgcagtgtatttttctgggtcagctgtgtcatgggtcagcttaagaaccttcttgccatgtgacacaatgattacctgaggaaagcatttaagttccaaaaggtctattcccagggaaactggaaacaaaatttgtgagtgtgtttaggaccactttagtctacagaagggctaatatagtgtttttcaaacctttctaaacattttggccacagaactttcattaaagtaggataatttaagtctagtaaatgaaatacaccctaagtggctaaaagtatggctgttctgcctgcagcccctgccttcaattcccaatgccctgcctcaagcctgtctgtgcccccttggaaggcccagggccctgtgggatggacagcttctgagtgcattacttctgagtaaaccagttctaaaacctaagctaagtagattacctgaaagcaatcaattcatgccctaacttgtctaggacatcaatgtaactttttatatagtataaaggtttcaccttctttctggcctatgaatatgtctgaaattcaagagcaattaaagtactcctgggttgtcaaagccctttatgtaacactattgagttatctttatgcgtctgacttgtaagagatgcacaactctaggaagaagtagactgctgtgtcctgtttccaggtatgtgtgtgtttgccattttgttgacagactttaaaagcaaacatttctggccccaaccctgaactgccaaggactggtgctatgtaaagggttctctggatctgtctcttccctaccatcccagggagctcttaggaagggaaagggcatagagattataccagcctgccttgtggttaggaaccaccccttggttggcatatagaacatgcttgttaaaaaaaccatgcaggggaaagtagagtctactaccaggcgagagtttctcaacctcgaccctattaacattttgagccaaataattttgttctagggcattttcctgggcattttagaatatttaacaacatatctggcctctactcattagatgccagtgaaccccaagtgatggaaaaaaaaaacaacaacagaaaaaaacctcttttattgaggaaaaacaccaaactcttccacatagttgcaagaccttgtgcaatttgcctcctagccaccactgtactcttgaattgcacgcctgatgccaaccacactggttcctcatgttcaccatgccccctccagccatgggggtgtgtggtcttctcagagtctgaagcattccccacccaccccaacccaccccctgtggccttctttaaccatgctggctaattcaggatccctagttccttatgactttcctttaaaacgtctaccagaaattgggggaaaaaaagtgttattataggattaatgttggtcttccccactatactgtgaatatcattgagagcttggtccctacaccttaaatcccccatcgtcaactattttttcccatctcagtgtcccatgatcaaggagaccctccctgaatgtccagttccccaacccttacccccagtccagggtagcttccttccttgtgcctctcattaacctgcatgccgatccttcagtgcacttgactcagtgtgtaattgtatattcagtagcgtgttgttagattaaaatgtggttaatatgtgtttcaccagttatactatgacactccttaagggcagaaacagcatcttttttaatttattgatatccaagtgccctctataatagatgctcaataaacattgaatgaaagtgggtgtcagccagtactggccagactcaaactgaacccactgcttcccactagcttgactttttcctcctgtttgtggcactctctttaaaacaaaccaaaataaacccaattttaaaaactttttaaaatgagcacggatacagaaaaccacacagaacaaatgtgtagcttaatgaatttttttcagagaaataaccttatgaccaccaccaagtcgagcagtagaactttgctgtccactaagaagccctgtccatgtgccccatcccaattacagcatcctctctctctccccattaagtaaccgctagcctgactcctgtaataatcacttccttgtgagtttttttagttttattatcgaaatatgcatccttgacacaaatttagtgttgcccacttaatatatttgatgtcttttagtctacttaatctatggattctccttctatcgccttctatgccttactgattatctatgaagaacctgagctattccacctatagaatttcccagtctggatttgttgattgcacactgatgatgcagttcagcacattcctctatgctctgcatttcctcaaaattggcagttggatccagagacttgagattcaggttctgattcaggttcagtccttttggcaagaccataggaagcatgcaattcctgactgtctctttatgatgttaacagtaattagtatataatgcatagatctattaatccattgggggctataaatggtattattctaattttattaccttttcatttaaaagttagaatacttttgtacatgatactacctcttatctattattggttgctgttcacatagtttacaaaggaaaatcaggacaaatgcttctttctctttatttgccagttttcatttataatgaattgtttctctgttattctccaaatttggcagattcttttttaaaaaaaatatcattatgaatgtatggattaaataattgatgtatttcagtctcttgcaatcattatcataattgtagcattgctttttaggcaaccctggtacccaggctgtacatttgtcatggggagtggggagggggagaaatagcatgggcactgtgagaccgagactgtccctggcagccagtattctggcaacactgttcacacccacttactggatggatcttgagaaagccccacttggtggagcccattcctgctgcccttttccagctggttatctgtcactctccttttcttcccaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctgggtatggccatcaggttggagttgagtacttgatcctgtatttcaccatcatcccatcacctacctttctggagacagctgtgatgtccctcaagggggacagggtttctaacaaaactagccagagcttcctggtgaaccttacttacaggcagggaaactgagccagacatgagaccagcctggggtccccagcagcacaatggcctgacttctgatttccagttcttttctggcctctgggctgtggctccttggtcttagtacttgatggtcaatttactaggactcaccagagatcctccatttacaaaaagggcctgccactgcacagggctgagccagccccagaaagagggcggcatggttggaggaggaggggctgtgactggcaagcttgctaaggtagagaaccccttgtctgcagagcactgtggctggtgatatctacggacaagaataaattgataggaaggggctttcgtcaccttcagggttttaattcagagtgcacactgcagggctttgtctcaaatgtgccagcctgttgtcactgagaagctgccaggccggcctgtgtttggaggaacctgactctagctgataaggcctttgagttccttgggttgtattgttgaaagggttgttttttctttttatatttaatattctttccttgaggcttaagtcagcatgtgctgacttagtaatgacttcacttttaataaattcttcctcatgtgaggattaaagggggcctaccatggcatctttagcacatggcttcagaacatggcgaaattttcaagagagaactgttgcttgggggcctgagaggccacagggatgtacccccaggagacagtcagacaggaggggttcagaacgccatccgctccctagcgccatgaacttagagagagttctcgctgttttcttgtctgtgtattcacaaagataccataaaaaattaataaggaaggaacccaaattaaactgctaactcgacctcccttgttttgaacagggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctgtgcgtggcactctggtggtgagtgtgaccctgtgccccatgtgcccactggcaggatgatttctgtctggccttcactagagggcagcaacaacccatgaatccctattttgtctcccagagacaggaagcatagattataaattatttcagaatgttttctccacactcaaaagagccaaaacaaaacagaatcccatgacagcaacagacttgctctcagccctgtgctgggttgccccaagtgtggggaaaaatagcagtagctgtgagaagatggggtccagcatgccctgtaggaagttcccaagcctcagggcaggacagtgtaggccctagttctggctgtgtgctgctgaagcctcatgccacaggcactggcaccaaaagcaagagtcctcagggtagccacatggaggaagccaggctccttctgcaccaccaaggtagaggagttgaacaggcagagaagaggccattccagaccaagaggggaacactgcagaggtgctaaggtgggaatcaccccttgcaggtggagaaggtgagatcaccagcccaagtggagcagagagcatttcagggcatagtgggagagtaagccgcacatcatggggcccagtcatgaccgagggtggggggcggctacctggtcccagcaaggtggaaaataatatccatagagcactcaagtgccttgataaacatgctaatttttttcctttttttcttttctttttctttttttttcttttttttttctcagacaaagtctctgttgcccaggctgtagtgcagtggcgtgatttccacttactgcaacctccgcctccccagttcaagcgattctcatgtctcagcctcccgagtagctgggactacaggtgcctgccaccacacttggctaattttttttgtatttctttggagagacgggtttcactgcgttggccaggctggtctggaactcctagcctcaaatgatccaccggccttggcctcctaaagtgctgggattataggagtgaaccactgcacctggccaaacatgctattttaggtagagtatctgactaatctgttggataaatcaggggtagggtgaggagagaagagaagctaaaaggccagtgcagaagcttctgttggtgccggggacagggaggagagtgtagcagggcctgggctgacatagacatgcacagaagccaggcttccggagcccatcttgcacccatctcctcagcccagcagatggcaacactgctcttcagaaatggaggtggccagccagcatggggatgccgtcagggggtgcagggctctcccatttttgtgcggtgtggggtacacataagctcatccaccccaggttattgctgcgtgtggatcagctctttgcttctggcttgtgatcaccaaacattccacaagctctggttctgcaaccttattcccacctatggctgtgctctacctggtctgtgggtctgctgttggcagggaggcctcactgagattggaccttgtactgccaggttcatccctgagtccccccgatggctcatctctcagggacgatttgaagaggcagaggtgatcatccgcaaggctgccaaagccaatgggattgttgtgccttccactatctttgacccgagtgaggtaagcaccatgtgggtgtgggtgagagggacagactgaccgtgatttgagagcagcagcacccagccctgaagtcctccctgctcacagcagcccagccctctctctgcccaagccccaactgcccattccccccatccccccactccccacccccacacgggccctgttaacactcagaagttgaggaataggttacagctgcctcactcttttcaccacgggtttcagattttcattttttacttcctttctaggcaatcatatattttaaccattacttctaacaataaatactctttttgagtaataggcctttcataaagtcagcatttgggaaaatcattgtttcttatacctaaggtggcttgtcaccttacaaagctaaccccaaacgtaaaatgtaaagcacaaatagatttggagttagaagtatttcatctcttgagtattagcaattattcattaaaaagaaaaaaaaagtgtttagtctctttctgccctccaatggttaattattgcatatcatcttggagtcaggtcctttttgatgtccacctcttccccctaccccacccctcccgtcagccctgttctcacacaccatgactcatttcttggctctacctagttcctggttcttgcttttccttcccgttccctctcctaccatctctgtagcaggcagttttccttggtctcgtgactatgagaggttagaagctgtaaatgctgcctggtggggttctggaatgtgtctgtggtctgactggaagatgaggggttgggtgtgggaacagccacaagcagccctgctgaagtgtgagaggcaggcatggttgggcttggaaaagagggaacagttattgtagacagcggaggccaatggccactgccagccctgcagacttcccagtgagtggtggcccagcagccactgtcagcatgcaccagaaaggggtcctgtgcgcaaaggtcaggcaggagtgtggcagagggcttttaagttaggtggttttgggggcttttaagtgaggggtcaatctgggtgaatgcataagccccactggcatctttgaggaaatgaggctatttcaggggatactttcagtccaaagttgaccttttgttgaacttctaactctggaaaaacaagctccaaacctgggtttgcttaagaaagcaacatcagtgtgtttagacgtgtggtttattaatggccttggctgtgctgaatttcataggaagtcactctgggtgaagctcaggtcaattttcctgtttttctatttgaattctttttccctggaagcacaccagtaactacatagtataaggactcaaaacattaacttttaaaaaatatcagaccaataaaccacacagccaggtactctctctgacccagagggcagggagccaggcttcgggaggaatacttagaggcctccttggaatgtggccaccgacaggaatatgtgggggtgcagtgaggaagctgtcagcctgggcctctgtcttcctgtacccttgagggactggtcacttacttttcctcattttcattcactctgatttgttactgacaaggcctagggaagttttcacagcctaaaacacagtcagtatacttactgttcttagaaacgtaacactccccgacgctgagatgcagacagctaagatgccagggattcaagtatgttattgtgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctatgtcatcagagagtgaaaaggatatgtcttgtgttagatggaaaaaatgggcatgtcacaattcttaatgggatggaacctcagaaaaggagaatgaaaacaattgtggaggctgttgtgggaaatatggactctcgtggggaatctctccagatcttaagatgaatccttgcccaatttgggtcatttagttcccgtctcctacccagttaccgacagtggctgaggaggccaggtagggcttttaagaaggatctgagtgaagacaccatgtcctgtaggctgcagaggctgccagttactttctggaaatgtggaagtgggatgtgctcctcctgggatgtccataaacggtcctggagtcagggctatagcctagatgtccttaccaggttcccactaatgaggcaaagtatgtcagaaagggatttgtgaattaccagggagaggaaacatgtccaagtgcacatcgctagcttttgctcagcggccgaaccctgggattctaggcgacttctggagcctggtgggttagcggtgagaagatgggcgaggagggcggacttcatctcagagtccttattactagtctcatccagctttgaggcagtcagccactgtgcctactgagggagtgctatgagtcacccgcttccaaggaatggcccaggatccctccaggcagttcaccattccctgagttggcctcaagacaggagcagcatgtagcctgcaccacagacatgcaagcctgtgatgagtcacccacttttgtgttcacccaggctctcctccctgctctggatttcctggggactcatgcacatactctttttattgtaccagctgtgtgttccacctgcagatgagtcaaaacagtctaatccataaaggtctggtttgtcaaagagtgtgggtcatcaacagagagaatgcctactggggatgcccaggtcaggggtactgcagggcatcctgatgagaggcagtgtggcccctccattgggagccacctctctgctccacaagtaccgcggggctggtgtcagctgtctctgaccagcctcttcctgactggtcaccacaggtagtgtgtgagggtctctctccaagtgtttgacctaatgttgttccttttgttatcttatcccccaaatcctatcacacctcacttgatgtctgcctcctgactcattctctagctccttctgcagttgctggatttgaggaggttcagcttaggatttttaaagctgaaaggcaggttggaatttttcttttcaatgaagtaaatctatctgaattatacaagcttttttgctgggacactgtctatatggaaggctctgagagcgcactggcgcagggtttacactgtaccacttgggctggggaaaattatcttttgatctatgaagtaagacgcagggttacagttactgctgccttactagtctctgcttaaagatggtttggaatttactgaaataattgcattgtaaaagttgtacaggttgggaaagatgtggatactgcttttccagctttcttctgcactctgtttcaggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccaggtagggaccatgtgcatctatggtttggggtcttcactgagtctcttactgtctaccaggctgtctcaattaataaagagaataaaatcaagcccatcacagctcccttgcttatatacattcttggcctaaaaatcaatagaaagtgtcttctgagactagaacacttatggcctgggctttgagggagtgggaaaaagcagccattggggctgttggttaattttactctgtacccaagttaatgtgctcatactgttttccactgcagaagaagagggaagaaatagctatcccattcctttttttcctggccctgtcttctttatttattcaacaaatagctatggcatgcctaccatgggctgggcactgtgctcggtgataacgatacacaagaaaacaagccaggcagaaccccaggccctcatggaacgtacaccctagatgagaagacagacaacaaacaagtaaataaaatgcttaatatagttcagactgtgttaccttctaggaatacaaatgaaggacaatgccgagttagtttacatagtcacagatagtgtccctgaacagggggcagttcagtagaaatgtacataaagtgacagaaagccctgaaaaagtctaggagaacattttaggaagaagaaatggcaaaggcagcgaccctgagcaggggatgagcctggcatgtttgaggaggagggagaaggggaggggccagaccactgagagggcctcacagacccttagcaggattttatttctgaaactatcttagtatcccacagatgggtgggaggtagccatttccaataatttatagaacagttcatgggccctcatctctccctctccatcactgtgcccagagacttcagtgtacctgtagatttgggagcctctgatggtcacttttgggcccatcaggctgagaacactgcacgggaacagctccccatgggatgtggcaggaggagcccagaactgatgtagaggctcacagctgagctcagagtgaccttcaggtcacacatagctctcccatcagcacagcacagagagattagaagatcaactcgagattctgatggcctatgatttttttgaggtctgagtgggaggaaagcatgaaatgagttagaactgaattctccattcatctaaacatcatgagttaattccatagtgcctgcagtgtgaggttctggggtgacagttaatccctgacagacatgtctttaatgacttatagactgggaagcaggttgattggactattaaggagcttactctggtggtctccaggttgaggaaagtgcatgtccttatagctgcaggtcccagcctcctttcagcaatcaatttggagggaaatcttggctatagccccttcccccacaataggaagtgatagaaactgactccccaaaaaatttgggaagaaagtatgtttgttttgctctcaatagctgcatgccatgggttggtacctactcctaccctctttcctttgcttctccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtaagtcccatgagccaagggcacactagagcaacgggatggaagtactaactggcttgaatgtgagctggaggttgcgtgttaacaggaaaacaagttcatacagtacatgggctccatccagtactggatctttggccgggaagggttcttgtcccagtgcactggccctcactttcaaatggaaaacaacctatagattacctagaaattgatgagaatattagagggtttgtttctgttttagccatcccaggccttccatcagagactacaattcctttatcctaagaacctacagagtggtttagggagccagtgtgcttagttggagaaatttcttggaatcagagtttaaaaggaacatgaggggaaagatgtccatgcaagaggtctgatgaacgtaaaattattataacctagagcactatagagtgattttatcttgtgtgaagatccaccccatgccattttatgtagcaggtctccagttttctcttctcagaattatgtcttcatagcacctgtggtttccctgcacatccctagccagtacctctttagggagggtggcacccacctgagagtactcagagtgctttgtgaacatgctatgtagatctcaaagcaagcaaaagcaccctgcctaatctgaaggcagatcacatgggctgggacacatctgcagaggtggaagagttatttccatccctggacaagtacctcaggttccttggaaacccaaccttggtaaataagaataatcagcatggcccagaaataggaataatcagcatggcccagctcttctcctgcaaccgcccctttgtactcctcccctgcatggtggaacactgctgggctctgggcatgcctgtgccagctctgggttctgaaacctgtctagatgccagattctaatctgactgctcagactgtgagagatgtgagaccaagaaggaaagtgatccccttccagagtcctgggagcataaaggggtagatgagagaccaagtctaactgcagccctgggcctgaggctccgtctgctttgccataggtgcctacgaccgcttcctgccctacattctcatgggaagtctgaccatcctgacagccatcctcaccttgtttctcccagagagcttcggtaccccactcccagacaccattgaccagatgctaagagtcaaagggtaagaagacctcctctgtcagtgttgatgcactgggtctgggtctggccaggtctcaggagcccctcacaatagagctactcgcaaactccctctcacagacaccatggactagtttagccattaaagggttgtaaatggcaaggtgcttacttatagcccatcctctctggtctgttcctgtgtggacatgtcactatacacatctccatggcagtagccgcactggataactcagaggctagaagaaacctttcagaatctgctgcaggattctcttcccagggaagatatcctcagttcttgtttgtttggagactgggaggcatctttttaaaatgtgttactgacatatttttgcttgtttttatagaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttactgtttatttgtttgttgttgtatccttttctccttgttatttgcccttcagaatgcacttgggaaaggctggttccttagcctcctggtttgtgtctttttttttttttttttaaacacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaatatcagcaactgcctagaatctttatttctagaatttagtgagcctgtgccacactgtcatctgccttttctctgtatcagcttgggctaattctagcaatggttgggattaatctctaagactaagatttgattcttgtgcactagaattcttcactttattaattgactatgggctgagccagccttcttgcacaaatgtatcttgggttcccttgaaagtagagactgagacaagtgcttctgtgcagttaagcagtttatgctttggggacaagattccagggagcagcaataaaggacaggaggagaacagggaaggagggaggctgaatacaaagatgcattttcaggttgactagcaccaaaggcagggatgctccatccagcaaggacttcagaagaagcttatgaaatgcatctcaacaccatctgtaccttgagtaaaagggggaagcatttctctgttggcatccatttgtaaaggcagcccacaggtgtcagctccacatgtttccaggctgcacatgcatgagtcccaaataagttctgtcccgtgggtagaaagcaagagagaatacattgcagggctgaagtaggggttgccagagcccatcagaactggtcactgcaacagtggctggagtaagtggtgggctgagaggattgggggttgagtgtggtgcacaagaggtgtcttaatctatatacaatttgcacagggcattttgggctagaaggtgtggatggacctgggtaaaaagctccagtgttggatagaaactcaagggcatgttgcataacaaaacaagcagcatcaaacttgggggagaaggaaggcagcacgtcttctggaacactgttggcttctccactctcctcaaacatggttctgtgctggactactgattaactgtcttcccaggggctctagaatctgaattgcagttctgtctacccattgtcctgtagcaggagtgaatagtttctgcattttctctcttattctccatgccactgattccagtcatttgtggccttctgagggcaaaaaccataattacctgaatgcttagagctcttcatgtggtgaggcaagagcccaagtcacttccagggttgagccaagcatgtggaattccaagtcctctgtcgaagcctgttggattcgtgtgtggcttgtttcccttagagccatgactttgggaagactgagtgtgttatcagaccaaggatctcctctgctccaggagagaggcatacacaaactgtagccacaggggcagagttggtgagtgatgaggtgttcagttaatgtgtataactagaaaccagcatacccacagaaatataaaagacaaagaaaaggaggtggaggaacaacccagattttcttaaaaaccagtttcctgccacagatcaaagtaaaggcaaagatttgccataccatcttttcctattcttggaaactagttcttatctctgtcagggttccctgaacattctcatggattccataaggctgttgtttgtcaaagagaattattctgcttaatacctggtctaagtgacggtcaatgaggtgggcacaagaccctattccctgccaggtagtaaatagcacaatagaactttcttctgggggtttgtcttttaattcttttcctaaagggcttttaggctgatagaggcttgatgcaatgcactggcaacaccttatgttctatgccattgctttaaaagcactttggaaaataaaatctcatgagattaacagaggatgcactgatgacagacacaggtttctcagcagaaatcatgttttggagctctcaggcagacccacccctgaaggtgtcacctcatgaagaagggacataacctcagggacagagttctgtaagaagccgccagagacactgggacatcatctgtctgttgcgccagccagagggcagcagccaggcccctgactggctctttacctgggaataagtctcacaaaagac

SEQ ID NO: 13801 - DNA, 11648 bp, Human
agtttttgttttaaagcattttttatagtgtcctgttgccttcacagggtcactgtggtcaacttatcagaccacaaagatgcaaacttcctttccctaatctcatcctgaattttccagtggatgtgtcaggttctcaggggaaggacaagcatctatttgctgtaccaagaaaggatcccacgactcaggggtcacttgttttctcttattcttgctcagaaggtcttggtccctgtagcaagtccccacttccatttgtcacttaaagtaccccaaaacccacctttccattccagagtgtcattgccctccactttgcttaacactcagttaggttccttcctcagtttctcctacctcctttcctctcctagctcctgacccacctctatctggtagacagttttgcccattcctgctggtatcctgggaaccaggtttggcattggtcacagcactcagattgcaatgcgccagaatgggattaacccatgcatttcctctacgggagggaggtagagtgactggcaagtcgaatgttgcatgggtgtgtctatttatagcctgcaaaatggggtgctgccctggagggagagctggggtgaaggaaatgacacgcctgggagagtaacttacttctgcaggagctttagggagatgaaggaagaagcctcctgggccagagttttggatggaaaatgaacacccagtcaagtctctaggactatacgtggggcggggactagttgtgcgcgagagttaagtaggggccttaccaaggagcatgggacctgggctccccaaccctttggctagccccatggcgttgatcagccctgagctaattcctccatgctgcccagaacctctctgggccaagccctggggactcagagatgacagcaatgcttccattgcggaactcccatacgcgggccacagggaggctctggaggcggcctgaggcaagagtgctaggagggatcagagctagcccacccctaccctcactcagccgtctgggcttctctgaaccccttctcctcctctgttccctaaagccagccagggggagtcccagggaggcagaccgaaaaggggtggggtgtcatcctggtcactattagaccctgcaacggcgaccttgaaaactactcagcgtctgttgcccgagtggagcatagtgctttacaatctcttcccatcacagcaaaccatcaaggtagggctactattattttatggttgaaaaacagaggtcctgcgtcccttgggggctgtgccagcagcggccaagttgggatttcccctggtccagcagccccagacagcacacggggcagggtaggctttctgccttcttcacttccccagggcaggtgagtgacctggagggagggggtcacccctaaaaacaggggtagtgctaggactgaaaccctcccttcttgatatcccactggcaagcttgaggagccaggctgccagtcgggagattcggcccagtgttcccactggagagggcggcaagtgcccgggcgatcccctcacctgcgttcgggagatatacccccgcccccgccccgccaggagggtgaaaagatggccccaggagccagccggctgggacaaggcggagtgagaggacaggctggggccaggggcgctgggctgtcccgggcagccctcctccgggcaagccggagcaggggtggattgggagcgctcggggcgggcccgcggtggccccggggcggtggcgcccggccggagagggtggggcggagcagccgccctgtacttccccttcgccgctagctctacaacagcctgatttccccgaaatgacggcacgcagccggccaatgggcgcccgcgcggctgtccgggggcggggccggccagggctggggaatcccgctaagtgtttggattgctcggtggcgccgctgccctggcagagctcgccactccttagtcgaggcaagacgtgcgcccgagccccgccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagaggtgagtacgcctttgaggcgcggggcaccggcggcgtcgaataaaaggcgcgcggggcaccaggaagtggggggtcgaaagctccaggctggagactcgccggcgcgcggcgttgcccgggcctccgcgcgggctccggggggcgccggaggagctgcgagccgcgggccgcggcgcggggagggcgggacgcggcgtggaccgcccacccggacgaggctgccggcgcccggcagctttcgcagatctgcgtgcgcgcagccgccaggggcctgtaggtggcccgctatgttcgtcccgcgcatccacacgccgtgccggggaccgagtgtcagcccacgcgtgggcgcccagtgctcccggctttcggcggtcccagctccgcgcccaggcgacaggttttgggctccctgtgctggtggcaagggctggcttactgcccaggtggctggagggaatcgtgacctacggagactgcgggaagaggcgccacaggtgttccttgggccacttctccagaggaggggaaaccgggccggaagggttagcgtcctggtcttagcgttgtgggcgctgtggctgtcaggaaggcgtagaatggattcaggggggcgggagggggctgttcagggtgacggctagccctttgctagctagtggttacaactcaagtcaagggaatttcttcttggcatcaagcaaaagaagtccctcccttcccaaaggatttgaattttgagcgaaaagttctgaaattagggtatctgtgcattttgtctcttttcctgcatatgaatcctgaagccatcacttgcatgcctgtctcctccagagactggctgggaggggctgaaggaaggggcaaaagcatttttgcctaagatgctgaaaaaatttggagagcagttttattccagcgcagctcccctccgcactgagtgtagtacctagcagctggctgaggtgaggggagggtaactaagtgacctcgggtggggcaggtcactgcccaggtactgttcaacagattccagactggagcctctgtgttctctttacagccaacatgcccatcactcggatgcgcatgagaccctggctagagatgcagattaattccaaccaaatcccggggctcatctggattaataaagtgagtgtaactctttgggttttcctgccactgttttaacccatgtacttctggagggaccaaagcttcagatgcagctcaaaaagggaagtgataacgggacaagcaggtgtttctcccagtgggtcctgcatgcagggagtgtgcacggcccagcctgggcctcacttgcatgactcctgccttcttcccttcttgaggtagggcacccacctgaaggcacttccagtttccagcagcaagactttccagcatctgcagagctggagttctgctctcctctaagcgagacccttacaaacatacacagcactctgcagggctccaatcgaacaaatagaagactgagaagtggatgctgctgggcagaaacgtgcctggcttagcagaggacaaacgagttaatcttgcaccagtcactctggcccaagaagcctatagctggtgcacttggggcaacatagaccctatagacttagtagcaatgatagtattcataataatagctaatgcttactgaacactccctgtgtgcctggcacctgctaagtatgttatttacattgtgtcatttaatcctcgcagtagtcctgtgggttagatcttactaatgtcatcattttcagataagtaaacagaggcactgagaggtagatcataagatcacacaaaaagtgatgaagccaagatttgaacttgaacggtctgactcagaaatctttactgttaaccataagtgatataataacagtaagaccttagacttcatatttgtcactgtgtccctacacatcctctggtttttaatcctcaaaattttgttggatatgttttctcatttccgagaagagaaaactgaggggcaaagagatacagtgacaatgccagggttacacagtgttcaccatccaagtctagcccagagctccctcagtggtatgaccaggaccccctgtgtaagagcccatgctcccaggtgtcctgaggagtcctttctaatggaagaagttcttacttccatgtgggtgcttacaagccagagagaaacatcccagagcttcaaaaccagggctttgggggagggtgccctgtgtgggtcctagcacatgtgtaacaggcagagggaggtctttgtgagctaataatgctgcagctcatccaaactaggtgtccctcctgagagatccagagtggtctgtttaagccagcctcaagatgggtgtccaagccagatgtcaggggaaaaaaggggaagtcagccttttctcagacctgtctggctgggcaggcctgggtctcagactcagccccaaagtctgtggtctctgacctgacacagccttatgtgtatgtgtgtattgttcaggaggagatgatcttccagatcccatggaagcatgctgccaagcatggctgggacatcaacaaggatgcctgtttgttccggagctgggccattcacacaggtgtgtgcctgggactcaggcctaggaagcccagggtagagacaagaggaggcactcacgttaacacagaggctcttcactggggtccctgagctccctgagacaacatgcagaattactgggaagaggggctggtggcagacttgtgtttctggagaagagagtcgatcatctcagcaaattctcaaagggaaaagccaagatcttagaaagtgtgtggcttcagggggtttgtggctagatgaaagttctccctggcaaaagcatctgtgaaaagcagctgtaagccagggcactgaaagagacccaggtctgcctttttcttcgtgttgaccaaggcccttggtccaagcctcatgtggttggtggcctcctttatccttgagagatggagctctaggcccatctcagaacagtcagcccacccatttagtaactgttctctgctgcccagtctgtgcccactctaccctctggctgctgatagcccaaggaggaagactgggcatagtctgagacacagatagtacactttggggatatggggactctagtgcttctggctgggcccttcactgaggcccgctagatgtgtttaagccaagcctgggcatttgagaaggcccagggcctaggacctgcagagtgtcaccgggagtacctgctggtttgaccactgtggctctctggtagcataagaggtcaggggtaccttgccttcctccttcaggccaggggcagctgaggatccctacccatggccctgacgatcctcttttttctcctgccctctaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaaggtatccaaggactctgggtccttgggaagccctcagggagggagggtagaaggaggtcagctggggctggagagcctgcaccaaggctgacagcccgtctgccccacagaaagaaagtcgaagtccagccgagatgctaagagcaaggccaagaggaaggtgagtgtggtcctaagcagccaggcctttggtcacctgtgggccagggtgagcagtggaagaaatgctaaggtgggcctgggcctaagctgctttctccctcgacagtcatgtggggattccagccctgataccttctctgatggactcagcagctccactctgcctgatgaccacagcagctacacagttccaggctacatgcaggacttggaggtggagcaggccctgactccaggtgagctggtccaggtctggcaggagaccccacaggtcagtgggatgactctttctcttggaggcatggtgctggcacatggtggcccattagtgcaggctgcagggttggtcggagggcgctcgatgtcttgcaaactaagaaagcacacaaccttgacctgtggcttctgctgttccccagcactgtcgccatgtgctgtcagcagcactctccccgactggcacatcccagtggaagttgtgccggacagcaccagtgatctgtacaacttccaggtgtcacccatgccctccacctctgaaggttggtgctcctggggcctggcctgcctgcttgactgtctgggtcctgtgaagggcttcctgagagagaaaagatgatcagaactccacctggcactgaattgattgagttgggcattgcccagtcttagccaccatagggggaggcaagcgacggggacactaggaaggcagttcagagtgggctgcagtacagtgggggctggtgagaggagggaagggggccaggggctgcattttggggtgctggttctccttcctcctctgtagcccagcatctgagggtgaggaaggaagtagggtaggggtgggaagcggcgtggcttcagggtttgagaggctgagtcaccaggccagggtcctgttctggaatctctatggcagataggtccaccgggagggtgtgtgtgtgtgtgtgtgtgtcagagagacagagagacagagaaagggcagggggatctggtgggctggaactggaactgcagggtgagtgtggctgactgccagccaacctctctgctttccccatccacagctacaacagatgaggatgaggaagggaaattacctgaggacatcatgaaggtaaagccccttcctacctgggcactcttgaagtgaccgtttctcagtgaggagagagaaccagtgaagcttccaaatcagaggatgggtagctgctgttgtcacctggctgcttgcattgtcccacaagtgccacattcacgtggcttgactggtgggaaagccaccatgggaagggaaggcaggtgggaggcctggcctctgacaggccgtcctgaagcaagccttggggcatcagacagctctgtgagtcaggcactatcagcgatgggtccctggcctgcatcctctgccccaacatgccccagccctgctagttcgggaaatgcacatcaggcttcaataatcagcctttaggatccgttaatatgatgatggctttatagaaaaagttagcaaattatcctccaggtttttttttctgcttcagttttgaaagtgaatatagtttttgcagccgggggcagtggctcatgcctgtaatcccagcactttggaaggcgaaggtgggtggatcacctgaggtcaggagtttgagaccagcctgactaacatggtgaaacccatctctaccaaaaatataaaaattagctgggcctggtggcgcatgcctgtaatcccagctactctgaaggctgaggcaggagaatcgcttgaacctgagaggcggaggttgcagtgagctgagattgtgtcattgcactccagcctgggcaacaagagcaaaactccatttcaaaaaaaagtttttgcagtagttgtacgccagctgttccattagcccaaaaaattgagacatggatgtcgttccttatctctagcttttctagtcatcttttcttgatttattatgctaacctttgttttaagccacattccctcttactatgtccttacacagttgagagggaagtcgtggagatgctataccagagagtgggtgtgagaggggtgggaaaatgaattgaggaccagtgccaacatgcatttctgcctcctccctcccgggcccttgtcctgactgcagtgcacttctgcatcctatctgagattgtgaaaatggccaagggtgtgatactggctgagaggagctggctcattgagggcagggccacagggtgagtctgcactggaagggagttgatagcctcttgctcttctgtccccagctcttggagcagtcggagtggcagccaacaaacgtggatgggaaggggtacctactcaatgaacctggagtccagcccacctctgtctatggagactttagctgtaaggaggagccagaaattgacagcccagggggtaagaaggccctggatccttatggcttcttagatgagggagaaccacgtagggatggagaaagcttgggggcagggccagggagcagggcggtaaagcatctggggtactgacacattgtgaattagctacggctgccatgccttaaggtttgcctgaagctgagtggatgtttactgctgtgctgggaagagcagaggccatgtctatggccttcaggggtagggggaagcacacctgatgccaccgtcccctaccctcatacaaccttcttcacatcttctaggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctattataaaatcctttcggccaggcgcggtggctcacacctgtaatcccagcactttgggaggccgagatgggtggatcacctgaggtcaggagttcgagaccagcctggtgaaactccatttctactaaaaatgcaaaaattagctgggcgtggttgcgggtgcttgtaatcccagctactcaggaggctgaggcaagagaatcgcttgaacctgggaggtggaggttgcagtgagccgagaacatgccattgcactccagcccgggcaccaaaaaaaaaaaaaaaaaaaaaacctttcatttggccgggcatggtggcttatgcctgtaatcctggcactttgggaggccaaggtgggcagatcacctgaggtcaggagtttgagaccagcctggccaacatggtgaaacctcatctctactaaaaatacaaaaattaggccgggcacggtggctcacgcctgtaatcccagcactttgggaggcagaggcgggcggatcacgaggtcaggagatcaagaccatcctggctaacacggtgaaaccccgtctctactaaaaatataaaaaattagccgggcctagtggcgggtgcctgtagtcccagctactcgggaggctgaggcaggagaatggcatgaaccccggaggcagagcttgcagtgagccgagattgcaccactgcactacagcctgggcgacagagcgagactccgtctcaaaaaaaaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgtttatgttcacatagacaatggcagaaggaggggacattcctgtcataggaacatgcttatataaacatagtcacctgtccttgactatcaccagggctgtcagttgattctgggctcctggggcccaaggagtgttaagttttgaggcatgtgccataggtgatgtgtcctgctaacacacagatgctgctccaaaaagtcagttgatatgacacagtcacagacagaacagtcagcagcccaagaaaggtcctcacggctgctgtgctgggtagcacttgccatccagtttctagagtgatgaaatgctctgtctgtaccgttcaatacagtaggcactggcactagccacatgtgccagctaagcacttgaaatgtggccagtgcaataaggaattgaacttttaattgcatttaataaactgtatgtaaatagtcacatgtggtcagtggttaccatattgaacagtgcaggtagatactggactgggggcagatctgagggagaggggtttgagtagtgggaggacactggggataggggcttggggctatttacctgccattttgagtagtttgctattttagcagccaacaataactattggtgctgaataccagccctgcagtgtagcatgagacaggtccatgcacacatgcattaggaaaacaccttcatgaagcaggattctgcctgggctgatgcacacaacctctatggagggtaaacagtgtttctgaagaccgtagtttgggaacccctgacatatgacaatgcccccttagataagctcaagttacaggaatgtctgagggtggaaggtgtggatatgtgcttttcctgtctccctcttcagtgtctggccatggggcataaacactacccagcagtaggtaggctggccaagagaagccagcttgcatcaccagcatcatctagggaatggaatcatggcagtaat

SEQ ID NO: 13802 - DNA, 38261 bp, Human
tgggcggaggctgggcatctcccgctctgggcttgctccctgatgagattctcagaccgtgcttcccctcattcatgagaggaaggttcacagagcaggcgtgggaacctgcctggccgccagggcctcctcccgctcaggctgaggtttgctgcatctctgtccttattcccttccagactggattggctgaaccaggtgtccactctttttggcccatggcataaagaagggtttgggcaacccagtgtgccccaggttgttaccgcccccccgcctccgcccccacccagcctttgatgggcccccttctcatcaatccatcacccctgcacatgccaccaggactgcctggaccagagcccgggactctctgaaacccactgagagctcggccctgggaatgggcctcccaatctcggtctccagggggtgggccccaggtccctagtcttcctcagggtcttctccactgttctgcctcctctcctgatacccagttcctagccggggtgaccccagcctcccgtaacagcctccttgtggtggtgctgggaagaaggggcccgtgtacccggcagggccccccaggcaatgggcatgagcgcaggcagggaaatccgtcagcctccagggacgctctccctacagccccggcgaggggatcgggtcgtggcgacctctccagacgcccaggggctgggcaggagggcgggccaaggcccgcaggtgggggcgccaaagccaggcgggcgcggagtacgtgcggtgggctgcgggcggcatgaagggcgcgggcggccagctccggctccggctccggctccggctcccgcgaggccgggtagcctgggcgttcccaggggtcgcagaggacggcgaaccccggcggagccaccggagctggggaccaggacgcaggcaggcgtgtggagcgtgaggtggggacgtggcggcggctcaagtgggcggagccccggcagcggcccgaggcggagtcgccaagggaggaggcgccgagctgaccgggcgacgccgcgggaggttctggaaacgccgggagctgcgagtgtccaggtgagcgccccgcccgctcagccgccagatcaaccttagcgctggggcgcgggctggggtcgccaggcggtgcgttctgcccgcgcggggctgagagttaggggccggggccggatccggggccgggggtcgcgccgctagccgccagcagcgcagtccgggccgccaccctgcaccctccgccctgtttctgcacccgtctgggttcttgtgccgccgcccgcaagccttcccgagctcagggtggtgaggtcagcggcgcccttcgtgcagttccctcggctgtcgggcggggctgggaacttggccgctcttccctgtcaggctcccgggaagtggcggcctgaccccgggctgccggctgttgggagcgggggcgcggcgtccgcctggccctgaggggcctcttcatattggctaagcccgttctgcaccctcccaagggctgggagtcctaggtcttgtccgggcagggtccagcttggagcccattagatgggccattggatcagaaagtcttttctcccccagacatccttgtggaaccagcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccaggtgggtccctggcctttgtattctatttgactttaagatggtgcaggagaatacaaaaaactatccgggcatggtggcgcgcgcctgtagtcccagctactcgggaggctaaggcaggagaatcgcttgaacctgggaggcagaggttgcagtgagccaagatcgtgccactgcactccagcctgggagacagagcgagactccatcttaaaaaaaaaataaaaaagagagatggtgcaggagagcattgggatccctcccaagactgtgactgttgtcttttgctgtagagtgacacccgagatttgtgcttcttgataatagactacctggggcctcacagccccagccctcttgtaggaaatcctgtcctaagagcaagggctggagtccgttacgttgtagcttggggcattcttaaatgtcccagactttgtggagatccattgtccacctaagaatttataggatgtttttggggtctgctgcttgttctcagcctgtgtctcatctgacattaggttccataatttagtctctgttaaatgaactaggatttcctttggcttgtacttaaactgcccctgaggtgtccaaggtgcagcctctcactgtggttctgggcctcagcgcccagtctctctggttgcttctccccactcacagaatgtttggtctttgaattcttttcttttagggcctccttgttcttacacagccgagtgtccactgtgtggcccagccaatgaagccacgtagcaaggatggagtgagttggctgggggcctcatcccaaagatgctgtcatactggatcaccctagttctctgagagctcagcaggcagacttggtgacagcttagctgaggcattgtctgtggcatgtgataggcccttgtatcctgtcgaaagctctgcattggggtactctagacagtgcttacttagtcaccggtttagactggccccagctgatctcagttcatcccttgagtgccttctgcctgtttggcttctgactggagcgtgcctggggctagaatgagggacgagagagaggaggtggccgaggcactattcttgcctgtgggtagctcgtactctgagattgctgcttcatattggcagctggccatgtgccaggggaggagcccggctgtgagtgctcatcaaaggaagagactacgtgggtgcagctctgaggaatgagtcggttgagggaatctagggtctcctcatttcctaagaaggcctccctttttcactctgccctcccacatccttgggagggtctgagactggaagcaaggccttggctgatgtgtggccacgctggctgatagtgtgcagagggctaggaggtgtgtccctggctcctggggtctgtcaagagtttactattatgcagatggaagttggcaggaaaagctgtgatgcaagtacatgcaagcccagcagagtgctggagtgagagttaaacttcgggaaagttgctcacatctagcaatttggacatttgaagttccttagggtaagacatcagcctgtcctagagcaaagagggctggaaggtcctgtggtctgtgggctttgtgttacggacatggaatgagagatagaaagacagttttttttttttttttttttcctcagagcagaggagaatgaaaagtctggatgatttactggagccctagaagagagttcttgttcagctggtgtcattgcagggcagaggattaagtgtttgggtagagtgctctccagctcagatggaatctatctgagcctggtaacaggccagcatctgctctggacctttcaggaagtgcttgcttagagtgtggcctgttttgtacctggcactctgagggccagggtgtagtggagatcctcaggcctgggtacttgtaggagcctggaatgagcaggtcagaggcatataagtacatgagttcctagagtattggtccaatcccccgccttttgctagagaacattgcttgatgagctttagagccagtgattgaccagttccagggttatcccctgatgatcaatgtactacattatacctgattccagtctctcctgaattaaatgtttcatttcttgtggtgctcctggaacatggagatcgcccaatttctgccttgtttgcatcttcactgttccctagtctggaccttctttctcacccaggaatcagctgacttgggctgggcagctggctgcctcaggtccactgatgtttctctggtgcccttggtactaatgattgacataaattatgcctagtgcagggctacctgccaacatctgtcatcacattcagtcctccaacagccctatgagatataggtcctagtattgtctctattatatacatggggaaactgaggaatcctataacttgtccaaggtcacaaagccgggaagtggtatagaattggggtttaactcttagtatgtctgaccctagggcaggtgtgcctgtccatttgactgtactgccttgccctgagctggactggctggttatttgtgagtgctgtcatgtctaaggtaggagtgactgcccatctgaacttaagggaccatgttgctgttttctgggtccatgttgcgttcctccctctggtgagatccagccaggcgtgtcatggacctgctttatgaacctttggtgtaacccatgataaagtccttaacctgggcaggcatgttcttcctgggcaaagtgtggcttccctgtttgggagtccattgcactttaaggtaacagattattgagtaggactggatagctgcaatatctagcagagtgtgttttgggtttgactcttggttctgtcattgatttgctgtcagatgtcagatatgtaggaaaccttctctcagcctcagctgtttgtcatttgtatctatcttatatctgaaatggaggtagttatctagcttagaaggtttgggtgagaattagatagtagaaatgaaagatttttggaaacaaatagtgcttatctcagactatgttcccaggaaacagcctgagacagagcttaagtacttaatgctttattggaaggtgtaattgcagggcagccagggtgagggaaaacaaaagtgaggtgcaggcctgtgcgatggctcatgcctataatcccagcactttgggaggtcgagatggatggattgcctgaggtcaggagtttaagaccagctggccaatatggtgaaaccccatctctactaaaaatacaaaaattagctgggcatggtggcacacacctgtagtccaagctactcaggaggctgaggcaggagaatcccttgaacctgggaagtggaggttgcattgagccaatattgtgccactgcactccagcctgggcgacagagcgagactgtctcaaaaaaacaaaagaaaaaagtgaggtataaaggaggatgggaggtggtgttttagcaagctggctactctgcacagagatgtacttggttaccctatgagggccctttggtagccactggggaggccagtctggtacttcaacagagtctggagatagtgagaggagccagagattctggcgtgggcctggatagtctcctccactgggctgaggcaaagtaaataccctgggacctgggagatgggtgagaccaagaggttgcaaggtgggacgtaagatgcatccaatatagtggtatatggattttatcctcaagtgtagttcccttttgtgggttagtctcatccagactgccaagtctctgccaagactatgactgaaaacccaacttggcttttgcatgtcagttttaacagccttctctgctacttcattgtctagttactgaagcaagactttgtggtggtgatggtacccaggtggggaagtggaagtcaaccactattcatgtaccagactgagaaagtatgtggatagatacagataaacatcttggctttattaggttcttcgtgaaggagaatattttttcacataaagtagttgttgaagatacgaaacctggcatggtgagatgaggctagagagggcagtagggcctggtcacacactcaaaaggaccctttgggctaaagagtttgaactttatcttgacggcagtagagagccaaaggagggctttgataaaccatgctggctactttgtagagcagaggtgggaggaaggccagatgacatgtggagaggccagtgtagtgggggccaggatgcctgtaggggaagttaggggtggctcagatcagggtgatgactgaggctaaggagagtagggtaccccccatacttgcctagggtgccgtggcagcagcttataggcctgaatggacatccatgtgctttggtggcagggtctcctggagcctctggatcctcttaggctgaacacacaggtcctttcagccctgttatcctagagttggaggcagcggggagccgtgtccagttaggttttcccccttcacagaaggcaggcaggttcttgttcagtgccaagcaagaccagtttgttctcagcaagctcatgttctgtctctaggctgttaaatacattgttaaaactcaggctgttgcatttgggttgcagctgggagcttggcagagattctgcctgatgaggtaaggagagaagctaaggacgctgctggtttgcagctggaaacatcttttcatggccatttggccagattgtaaatgtcttttccaaagttcaggtttggtgggacctctggttgtatgtcttggaattgccctgtgtttagaaacagtgccagtcgcctgatgggtgaatcactgttgctgggatgttggcaggttttgcaggactttcctgtgggggtccaaacactagggctggcagggcccgtttggagtctgtttgagaagggcctgctttgttttctttacattttaagcatatgataaaataattttaaaaattgctatagaatttcttgtagaaagattagagaaacaagcataaaaataaaaagaaattatttcaccaagatatagccagatgtatgactcttttcttgcatctctctatatacacatatacattaatttttccttacaaaaatggaattatagagtgcatattattggggcccacttttctcacttaacagtatgcttagatctcttcatgttgatatatagtattcatttttaatatactccataaaaactcattgtatagaagaaatgtaaaatcttctattgttgtagtttcctaatttgaacaagtctgtggtgaagtattttttgttgtgttcctggtatgggacagacattgttctaaactctggggatgcagcacagataaaactcagtattggttttctgctcaagatgtcactttgtttttcataaaagtgggtttgacattgttcacctccagacttattccagttggattctgagggtttctgggagggcttttagcagcactggacactttgtaggggcactcagcaggtacacatactttcacctactctgtcttaagcaagctgtgggcatagttatgagatgggttggaggttggcctttcccacattgtggggcacagtccctctcggatgctgcctcctcccaatctgactctaattagaggactttttgtacagagccttttgagttaaggggcccaggcttgggagaaatggggtagggctccagagtacccctgccagagatgtcagtgttgatgtggtagtctgggagctgctgcttggaggtgcccagctctccaggctagcagagttagttatccccttctcccaccagagcaagactttgcaggctcttggtaggtaagtcatctgtaattacctgtgattctttgaggctctgcccaaaccccatctgtgattctttgaggctctgcccaaaccctatctgtgattctttgaggctctgcctccaggctgagattcaagaatgggctcagtctaagccagatcgcacattccagagaaatcacagctggtattcatgtaatgaagaaacctggctttccctgagtgttgtgaggtatgaaccgtagatgataggagcagaatgatttgaaaggaatggacagacttcctccctggaatttatctggcctctaaaaaggtatgcaactgcaactggagacacacctgggtagagatgctgggttccccacttccaaccatgtctggtttggaacctgcctgggccctgttctcccaccaccccagctctgaggagcagtcagctggtccctttctgatcacagatacatcctcccagctctatgttttcactgtcccctccctacatacatacagaaggtgctgagcctgagccagtcaagccttttgaggaacaagaaacagacacccaatcccttaggtataaggggcttgtgtaagcaagagagaagccttctgaaatcctgggatagagaagacagtatagtaaggccttggagcagacctgtggctagaaccaggagggcctggactctgcctcagggcaagcccaggcttactcactttctcttgatgacttgctctcttctgctgctctaactccctaatggaccccttagcacaatacgccctaccctgcagcaggttccaggttggaagataattgtcctgtgtgtcttgggacccccacacctagactatgacaggaagactgtcagctctgcagacatttggcataggcatgaacacatggcgccattcacttatgctttccttctgatagaggatccatttgcagatgggagttgtggttggccttctctgagcctaacctggaatctcaatggattaggatttcttctgaaagagtaagatgaggaatggtgggtgtgctgtgtgtctaatcaagtatggcgggcaaaaaactgatgaactggcattatcttagacttagaattctgtcagataaggcttatgtttttttgggaaagcatttgtatttcctttgttttgcttgctttgtcttagtgaatttccatttgagcactccagtggggtgctcaaaagcagggcaggaagaagaccggcagagctggggtacagatgggtgctaatcctccagcacagtctaggctgcatggctgagctgggagacggtatcggaggcttctgttgtggactgaggtttactgccagtggggtttgtctcaggttgtgcctatttctgggctgatgagaagacagtagctggcccctttcccatgtcagcagcccagcctgaggttttggccatgtgtgccatattcatttttgtatcctgagtgcctagatcagtgcctggcatctgcaggtcttcagtaaatatttgtgaatgaatggtgacgggccagtgagaacagtgtctgccaaggagccttactacaggaagaacactgtctacctaggagactgtctcctctgactgctctttctctggcaggtgcagactgacaagggttagttttattcctcttctggctggccatctgttgtacaccttagtttgggtgttggtactctggaggatattgtgtcaaattatctttctgttattgtctctcatgtactgttgcctccttgtgggcagggactggttccccaaaacctggcactgtcctggcatatgtgttggaaggtaagatagaaacaaacagcagtctgtgaaataagaaggagtgggccagaatcttggactgacagaccattggaacccgagctgactgtaccccactgcgattccgccttctcatggtacaggtggttgctgggagttgagaggatgggctctctccgcagggcacgtgacttcccagagcagggaccagaattgagcacacatcactggctgcacgctctttgttctttctgctgtttgtcctttttagcttctgtgtgctaggccaggattttgatatgtttgattatctgcatatgtgtgtacatgcctatgtgtctcctcacctaaattagtctttttcactttgttgatccagtgattgtcattgaatgcctttcagacacttccctctgtgaccatgaaactctgggtgtctgcattgctgatggcctggtttggtgtcctgagctgtgtgcaggccgaattcttcacctctattggtacgtgccaacaggactgtcgtctccctgacaccttggctcacatgccacggatgtctctggctgcagcctgttctcatttagagtgggatagccttaactactggttttggccagttctgaggagagtggaactggcagagttgctgttttcccctataagatcccaatgatctggatgttcagggagccagatgtctgaattgggtctttcttcctgggaagtgcaggctgcacttgggctctctggtctttttgaccaccttgcccatggaccagagagtggttctgagcagcaaatcctttgtatcctgaggatcaagcttttcctatccttccgacctaaagttcagagctttttatcctgtggtgagcccccaggatatccatgccccagtgtcatgaccagctatgtaacagtcggagaatgagatttagggctgcttcttgagtgacatccagtgcacttatctcaaacatccccttggtgcctctgcctctttcttcctgaagttgcgagatagagccccatgagtgcctaggccccctttaactccaagtccccataatccccagagagctgacatgttcttatcccaggggacttgcttctgtgctggtattctgtgccccaaggaaggaggctggacatccctcatctgtttctcactggtgtctttcttctctcccttgcagggcacatgactgacctgatttatgcagagaaagagctggtgcagtctctgaaagagtacatccttgtggaggaagccaagctttccaagattaagaggtgtcctaagtccccaaccatccttagttggccttccttcccttctgcccctcaaggaacaaggaagccatccagggtgcctataagaggaaacctttgagagggtgatgtggggctggcctggttacttcatgccagtgcttgagaggagctaagtacatgggctaaggagtcactgtttattttctatttaagaccttttcccttacattgggggtcccagctgttatctagattaaggggctagaagtatctgtggggagttactgtattcatttttcattgcctcttgatgaaaagggccccagaacctggcaccagggaattctcactaggaaaattgtcacaggtcaagacctatgtgggtggacgcattagtcttccttttcctctggttccacagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggtgagggacggtgagcaggtgcttgagtgagcccatatgtttgtgtgctcatgcctgggttgttgtgtctgagcctgtcttgggtctgggtgttggtgggcaagtacattgtggaaacaggaccctgctggtctcatggctctctcccttctctgtggggacctggaagttggctggccttggtttttaacatgtaatgatgttcagttctttttttagcgtcttttttttagtgtctgtcttttcttattttttgctaatgacatttttccaattatactttagtgatacatgtttatagaaaagtcggaaaacacaaaaacaagagaattataattcttaatccagttgcccagtggtgagcattattaaaattgtagtttttctacctatgcatatacatttaaaaaatggaactatacatacataccagggcatgcaaactcagttgcttggagggacaatgaatttacaagtgtcaagtgggctggatggtggggccagggcaagttggggagcataggtctgatctaaattcattcctattcatatgttttacaaacaaagcatatctgttggtagatttgtgacagaagaaaaaattctgtgaatttctcagcttctttatatgccattcaatgttcttctgcaacatgattttaatggctggatggtgattacctgtcagatggtgataatctgtcatactgataatactgtcaaatgggtcaagtcattggatatgggattttttctgaattatcagcacctttttacatatttcttggtgtatacttctgattacttttttagggtaagttcctagaagtgatattaccgatgagagtgtgaactttttaaaagctttaaactatacttggtgcttttattgtgataatactttttatgccctaatacttttctgtcaataagaagagatggtacggtgggcctggaggtgggctctcctaactcctagccctgggtttagtcccctggactcactgactttttttttttttttttttttttttgagactgagtctcactctgtcaccaggctggagtgtagtggcgggatctcggctcactgcaacctctgcctccgggttcaagcaattcttctgcctcagcctcctgactagctgggactataggcacatgccaccatgcccagctaatttttttttggtatttttagtagagacagggtttcaccatgttggctaggatgttcttgatctcttgacctcgtgatccacccatctccacctcccaaagtgctgggattacaggtgtgagccaccatgcccgctgccttttttttttttttttttttttttaaagggacagggtctcactatattagcctagactggagtgcagtggctattcacaggtgcgattgtagcacactgcaaccttggactcctggcctcacgtgatcctcctgcctcagcctcctgagtagctgggactataggcacagtgccattgtacccagctcttcactgcctcttttccctgagctgtgagtgctgattaacttcagactagctgtctctctggctgagacattttagcccatgtggccagactgggttgggcctgggggcagggtggcctctggagagggattggtgagctcagccaggctggagctgtgcccagtgagctcactgcctccagaaaccacggctgcctttcccagactcccgcctctccgcctgggcctgcagctcgggacaggctgttctgcctgcacggcaggagactaagcctacccagatgacctcctctctccaatcttgttctccacaccctacactcccaccatcatctggttcctttggaaaaccttatgattacctggaaggagatagggcaggcccagagaataattggttgttttcatctctgactttgagttcttgcccctgaaacgagcagggcatgctgacagtgtggcttttcctggcagcatgttcccctactcccaccccaccagattctaaactctttagagtccctgaccatgtagctatgaagacaaggaaggcagggttacagcttcttggtccctgtccccagttatggctgaagtggatgtttaggtctgaagtcataggtggcagtggatacagctactcttgggaagaggttggggaaggaatggccttgttgttcccctctcacttctcagcttagaggcagaattgaaggccctaagtcagcctgggaaggcttggctcccacctgggattgtaggaggtacacatcttactttacagctagggcttggagtcccagaaaagcctccttggagtacttctgtggtcaaaagctctcccacgcttcaggctgtggtcttgagcaccataactggagagcccatgccctgaactcattgaaggtctgagtggtgggagtacagaggagaacaggcccaccgtggtctcttaggggacggaccttgctgggttggtgcaaccccaccttggtccttggcctgtctaggtggtccttcagctgtcaacctagggggagggggatgacttccaggactttcatcatcacctttctggatgataagtgccagtggtcagtaatgagtggccagctcggcttcattagttaactgtcattgtcccttggactcctcaacttgaaatgtgtgctggaagtctgtgtttacctgactagcccaattaccctggatcaaggttttccatgggatttattttccactgagtggttgacagttcttcctgagtcctctcccgtgctcttctcagttaccctctctatcctctgtttcttctgtctccaccagctctgactgaatgatttggagccaagacttctggactcctaaatattaaccaatatggggggctgcttctacttagttccaaagagcaacacaggcagtaggtatggtgaggagtaagaaaggaaaagtccccatagactggagtcatcagggacaacttcctggtggaagggggcaacagcctttgagggagggggcggggaaatttcactagccagagaccctctttgtggctgcctctctggtcccaagtggaattctgcccctggatcaagggtaatctcttgttctgactctcatttggaaggttttatcgccaacctctctgtgcagcggcagttcttccccactgatgaggacgagataggagctgccaaagccctgatgagacttcaggacacatacaggctggacccaggcacaatttccagaggggaacttccaggtaactcaccactccaggcgttgcctgtcccgcatgtgtctctttagtggcgggacaggttggagccaccaccaacttgtggcctttaacctcgggtgcacctctggtgcacctcttggctcaccagtttgtgctggactccctctcccatgacaggtttctccctcagcccctgccctgccacctccctccatgtattagccaaggccctctcctcttgcatctcagagaaagccaaagttgctgctcaggaaccccctccacgtctgtccccagagcaccacacagatctgcattcagacctgcttcttgtctcccaccctccaatgtcttttcatctaaggctgatctgggcttactatccccctgtcttgagtcctcttagttacagtctctgctcctatacattctgtctccacctctctgggttctacccttgagctcccatataggctctattcttgctcatcttaacacttgcctccctcggtatctgagagtctttcgagtctttgctgctgattcatctcttctcccctcctggttaggctactggatagagtaatctacactctgtccattttcctggttcccatatactcctgaactcacagtatctggcctttttccccactgtcactgatgctgttcttacaaggtcatcagtggccgcttggctggtaaacccagcgaacaaggttcacacataatgttctttaacttcccagcagcatttgacagatagattgcctcattctttgtgatgttctctcctcctttgaattctggcatactgatatctgcttctcttttagcctctctggtcattttctctcaagtggcccctctcccactgacttcccagtgttagtgtttataagaagatgttttgagggctgctggagacaagtaaccccagcgattcactgtgtgaggctcatgcagacccagcttattccagctccagaacctcagctgccccctttagactccattagagagagggcagttcagggcacctgcaagatctgttcactctgtagccttgagattggttgcttggaggagggaaccataccctggcgttgacctctcacgttcactcagcaaacccatgagtgtcctgaatagggttatggggcagaaaggaattactccctaggactccatccttacctcatcttctccctgagcaccttccccaggtgagcacagccatttccatcacctgaggtggatgacatccagatctgtgtttcttgccaaggcttgtctcccgagcttctaaccagtgtagacggatgcctttgggacatctgtacttgaatgtcccatggacttctcgaacttcatgtgtcctgaactgaaatcctcatctccttgtaaacactttaccttccccctcatccttctatctcagcaaaaaggacctccatcctctggctgcctaagccagaagcctaaggcctatggattctacctccttctctcatgtcttccgtgcttatcccctgactccagcctcacagctacttttttctcaatttgattatcaaaataccattctgacttgtctcctacctccagcttactgcttaagaccatcctccatgtggtcttaagcacacatttgttcacatgagttcctgattactgtgcttaatttccaaagctaaacccaaactcctcctgtgtgtggtctttggggtcctgcatgactccattttcctggcttccttgcccattgtactcagctttccctatcactcagctcttttgtctcaacccctctataggaatacctttacccatgtcagctaggctactccatgtctgattgcctatcagcactcagctcagctgtcactctcccaaatgctctccagggagtagacattcgagttggctctggggaggatgctgagtgccagggagccattcttagcattcttggcatctgggagacatgttgataatagctactggtcattagcatcctggggagcataggagacatcttcatatgtcatcttattgaattcttgccacaagctctttaaaattgatgatattatctttatttagagataaggggactgagacttagatatggtaacttgtctatagtcacacagctggttggcgccctagtgaggccaacacaaacctagtttagttcagctccagagccccagctcagtcagctatgttactctgccccagcaatgtaggttcctgggcctgcagagccagaggagacctgtggagaaggaaaaggggctccaggagccccccagtccctggcctacctagggacttcatcttgtgtttactgtccccaacttcctattcctcgttattggttcctgagccaccggggttagcagaccctggtctctgaagcatttagcctactgtgtagtggtttcattccaggcagaaagagccttctctgagttcttttgtgtcagccatgcccaggttgctgttaatggggctgtggggagtcttccttgctttccagggagagtcacagcccccacttcccctccatggtatctgctttctcattattctctgaggaaccacacacatagtctttcccatcttgagctcaccctaaatcctgcatctccctatagctgcttcttcatattggcttgaaactatcttcatggtcactttccagcactccctctacagcagatgacctttggtcataagacccactgaactgatactcagcaaggtccctgccacttaacagccaaagctggcactgcaaccttggctcttggcctcccttggtgtctctcacaccactcccgctccctctgtttctcctatctttagttcattctcagggttattcattgtctgttctttctgggtaggtgctccctggagctctggccttagtcatcttctccattctttcctcagagttcctgcaagctattttcctcacccatggcttggttgccacctaaatttatgttttttatattcagctaatttttccatcctctagactcatatggcaaactgcccaccagacatcttcttctctgtggtccacaggaccttcccactgtcctcaacaatgcttcctggtgggtttctggggctccccctaaaaaggccccttcccacttgggagatggggaatctgaggctaagaggtggctgtgaaccccagtccagggcagggctgggccatctgtctgtgctcactgtgtcagtggccctttaggatatgcagtctaaatgtccgatggagttctgcttggtgatgccccctatccagtggctcaggctttccttgaagtgggaatctctttccctaatccagaggctctttggagcctgacaatttacttcccctgctgtaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttggtaaggagattctaggggaaggtaagatgggaatggagagtggcagaggaactgcactgtgctggcatctgcctgacccctctcctgggactgagtcagtttaccctgtcacttggccagtgactaatgccttactgactttaggaccagtccagcttcttactagctccttacccacctcaatcctggccttaggtttgcgcagtcgctgatagatacgctcaggcctgtggcacttgtgggcctttttaataaggactctgttatggtgtatctgtcaccatgcaggactacacagggtggaacctttactacatcaggagcagctcaggagtcaggttgtactttaggattgttacagtgacaaacagtagcggtgctattagaggcctgaggtctaatagtaggacttcatatggcattgatactttgtgtgccttgtgctgttggactgaagaaggccaaaagcactgtgcctttaaaactcatctacctttttttttttttttttttgagacagagtctcactcatccagcctggagagcagtggcacgatctcagctcactgtaacctccgcctcccgggttgatgagattttcctgcctcagcctcccaggtggctgggattacagaggcacatgccccatgttgtattttctttagtagagatgaggttttaccatgttggtcaggctggtctcgaactcgtgacctcacgtgatccacccgcctcggcctcccaaagtgctgggattgcaggtatgagccaccgcacctggcctctgttggttttccagttacgaccagcgtactctggttagatgctgtggaaggtagaatgcagcatgcaggtgagctgctgggagagaaacccttacagaataatttctctaaatgacctaacagatgtttgtggtttccttttccttctcattccttgcattttctagacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactggtgagatgtgtgagggggctagggtgccaaagctgtggacctggactctggctctgggcaggcagatttggggaaggtgttctttattctgtaggtacttttctcagtatatcccccagtttttcatggcatctcctgaggctgacatgtggatattctctgaggtgtaggaaaggagactctctcccctcgtgccccaggtagagtgttgctcctctaagttaccagtgagctcgcctccttaccccaatatgtcccactttttgcttcactcactgttgggaagaaaacaatgggtggacgtacctcaggccccaaaagaagtcatggtataagtggagagtaagtctctgtggtaaagacaccagcgtgtactagagcttggtatcgagcctttgagagccctgggatcctagtgcttcctgaggaggcccaggtgtgacaggctctgagccttttccatgcccctgtctgcatggcttctactggctcctccaccaagaaaggtttctcccctgtcccagcccttcagacctactcaagtcttcacgaaaagggtcaggaattactttctgccatgggacttgaggatgtgaggtgattttgggagagaagaaaaattgcatgatttgtggggtgttatttcatgccagttaagctgaaggggctctcctctcctctcccctccccccattgcccccctctcctcccctccccccctcccctgccccctgcccctccccctgcccctgcccccttctcctcctctctcctcccctccctccctcccttcctttcttccttcctttttcttctctttttcctgtttcctctttttccttttcttttctttctttcgtctcaccctgtcgcccaggctggtgtgcagtggtataatcatagctcactgcagctttgacctcccagccttgagcaatcctcctgcctcagtctcctgagtagctgggactacaggtatgcaccatcatgcctggctaattttttagagacaggtctatgtcatctaggctggtcccaaactcctggtctcaagctatcctttggccccccagagttctcggattacaggcatgagccactgtgcatgcccacctgctgggacttttgttttcttctgtggtgtggtgggagggagcagctgctggccatgaggtgagtccagtgtctgcagacagccagactgggaccgaggattaggactcactcagctcagggcctgttactctgtgctttccagacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaagtaggtgtcactgtaggtccttctcgggtcactgaagggggaaggtcctttttctcatccctagcactatgggtggttggtttgcccatctagccaccctttatccatatctagcatgggcctaccgtggggatacagagatgcttcagactcagcctgaccttgtgagttcatggtccagtggaagaagaacagggtaaccaatgtggacagccaagtgctatcatagaaggtcacgctgggaacagggcaggtctacactggtgtgtcagttcacctggttgggagactggtgcgtgggtgagttttttggaaatgttccataggatgctatgaagctgggtcctgtggagctcctgattaggactgtaaatgaggtgaatgacttagaggagaatgtatatctttataatattgggtcttctcatccaagggcatgacaggtctctccatatctttttaagttttcttcatataagccttgaacatttcttaagtttattccttggtagtttctttgttactgttaatttactttatttcttcattattatttttaactggttacattattttattagtttactattatatgccaaactattgattttacaaatacatttcatagtaagagctaatgtttactgaattcttaactgtggcaggaacttctaagtgcttaacatatatattaagtgttatgtcacagttatgaacagctgctcataatgatgtcactgtctctgttttacctatgaaaaagcaaactcatacagattgcagctagtggttgaatttacttatttcttttttggtttttagctgatttctctttggttgcctggatagcattaacacctggaaataaggaaaattttattttctcctgatacttgtagttcctttgtttttataaccttattgaattgcccagaacttctagagcataattacgtagaataggcatccttgtctcattcctgaatttcctggaaattcctatggtattttactgctaagaatgcagttggctgttggttttgtatatatgccatgttttaaaattattcttctgtttctagttcataaaagatttgttccccatttgacatctttcaaagagacctatttgctgccatatcccatcactgatgattgggagggaggatttagctcgattctctattgctctgctcctaatagaattgtaggggccgaggtgaccaggaggcccgacactcatggagagacctgaaataggttcctatcctggcccctggacctcatcttggaacagctttggcttgaggtactaggacatctagggctttgagtcagtggttggcatcatcgatgtggctgaggaagggggctagccagatatatggagaatggggactaggactcccctttctactcagctccagagtcctccaggaaagaaaactactttgttggttgtgccaggatttcctgagagatttcttacccgttcttcagttccagacactgagaacatttctctgtgcatgtgtgcatatgtgtacacatgtgtgtggctggccagagggtagtgttaggaaaagatatatttgaatagaagccatgcaaagagccaaacaaggttggcaaacatgtttggctcttaacatggcttctattcaaagataagctgacccctcctttccggagactgtgagggacagatgctattctggctttgaagtagagccaatgagcttaacttggcctgtggggaatgcctggcagctgtctgtggggtctctggcctgctttcaaaatagccctgtgcttcccctggggcagagcacagctgctcagagcctctttgtgggtgtcaggccaatgctgaggcacagatgtttggatggggtctggctgtggctgcagttttcagggagggactgacatgagctgaagctcaggaagggccatgagtaggagcttgggagccgtctgtcctgcttgtgctggccatcttaccagatcatgccatagcagcacagtgtccaagttggtccatctcacccccttactagccttctggtccatctactcctctccatcccttctgccaccacctggcccgggccaccatcatctcttgccctgacctctgtcgtggcctcactagcctcccagtccccactctggcccctcattagtcaactctccatgaggtattcacagtgatccattttacattcacattttgagtgtccctcccctgcataaagccttccccatttctcgttggccacaaggttgcatctagttcctagcccctgcttgtctcttcagcctgttctctcttactacttcccataacctttaatccacacctactgcaacacccattttcattcccaggcctctggattgctgctctttccctgttcctgtaatgttcctctacttggataactcatgttaacccttcaggcctcagctaggtggtctcctcccctaggaagctattcttgacactataccctgagcttccacaggatggtaagttcacccatgctgtgctgcagttacctgactggttttctgctttccccacttgactgagttgtaagagtgcaggggccatgtctcagttacctagcatagtgccaggcacaaagtaggcactcatcaatatttattgaaatcaaggggaagtgtgttggggtgggagtacctgggcctatggccccacccatgtgaggtcatgaggacagtccacagctgaagcacatggacctttgccatgttggctggctctgggcggcgagtcccccttggggtttcactaagcctaactgtggaggctgggggagatgaagtagatgcagggagtgcatgtgtagtgtgtacctgtatgagtgggtggcttccaggcagtggttcacttattttaacttacagaatcttttcctggttttatcatctgacttgtaaggatcccaagggagcgaaaactgtgccatctgtctttgcttcttgaggctgtgggaacccagtgtgaggtggtgcagcaggagagtgtttggatgggtttcttggcagaggagcccactgaggttcggaaggatggtggaacttgactcaattgagagaagtacataaggcggaggctcaggcatggtggcacagtctgaaaatggtgggagtagctaagctcaggcaggctgtgctcaggcaggggtggtatgtgggcctggcaaggaaaggggctagtcaggcagatgcatgggtagacaaggcaggcataattctgcaggcaaagcggacctggggaggagaagggatgagcagtgaccgagcagggcaatagccaggaactgattgcggattgggaatgtggaggcctcagactcttgccctcaactggcctgcaggatcttggggccttggctagagccattggctgcaaagcttcctccactagcatggcagtaaatctggtcccagtgctctctgggaaaatattcaaggcaaaacaaacaaacaaacaaatcaagtcttccctctcctccttccttctagcttgcacgagccaccgttcgtgatcccaagacaggagtcctcactgtcgccagctaccgggtttccaaaaggtaagcaaagagcaggggttcgtagctgctcaagccccaacttcaggacttctcagtgcctaccctagggatgggtggcttgccttttcctgcctgctggcacctcctcacccccttgcagcaggcatcctgtactgcctgttcatgctggccctgactctggggacagagttcaggacctcatggaagcctgcccttccgtcttcttttctctgcccttttctttttgcccagctcctggctagaggaagatgatgaccctgttgtggcccgagtaaatcgtcggatgcagcatatcacagggttaacagtaaagactgcagaattgttacaggtacagatagtacctgggactgtaggagttgggaagtgggtatttgtggctagatggtctcacagggtgtccagaactgggccaagaggcccaactgtatgactactgcctgatgctatgaatatggagtgatctcattttaggaaaccagaattaatcatgcctgctggctttcaacaattagtgttcaacaaatatctattgagcatctgctgtgtgcccaagtgtgctgcaagctagggatcaggggtagttatggtaggttcgttcatgtcttcttgacaacagaagctcaaatcctgaatggtctcagggacatctctaagagagctaaaaatgacttcagaggccatggttctgtgtcataatcaaatacatttgaaggtcaaagtattctgtgtgttttctcctgctgaaccacaactgaagttgctccaaaagcagcagcaggggacttcccatgagggactgccaagatggggtcagttgagaattcaaagaaagcggcactaaacccctgggtcttcagtccacagcatttattagggaacttgcagagtgggctgcagcaatcctcaaaatggacagcaagagacaagaattgttttacctaagtatttccacagtgagggagtcagagtgtggagtttatttgagggtttagggaatttggttcagggctggggctagtttctttcagtgttatgggcaacaacctaaacaccttcatcagtgcctgggaatgttgaagactccagcttgtgttccagcctgaagggaaaaacctgcagctggctgggtcacagagctgtcaagggagtctgattttcagtcagaacaaagaaagaaaggcggggtgggtctgggggaccttacactgtgatatgtaggtggaagtgagaggcctggactggttaagctggtgcaggtggaatgttcttgtccaagtactcccactgggaccctggcttcctgcctttattcagaggtgattttgaagaaatgtggcagcaccctgctgaaaggttttgggtaaagctccttattaaagtatcctcttgggtaaagcttagtaaagtgtcctcttgggtattgagtccaaatcagcactggctatgttcccttataaatattggaacttctgtgttctgttgtaaaattgatgacctgagacaccatcagagaagtttcactggcatctttctagaggcctctgggtctctctgtttggccaaagtttctgtatacttaaagatagcagcctttacctttaggattggcatttgggtctgatctaccatagatctcattagaatattgattaaagatcatttggaaaagattttttgaacttttgcttggacacgcctaagcaaatcagccttctttttgttgttttttctgtgtagctgcatcagcaattggaaaatcaattttgaaggtcatctttatggattggtgtgaagtctaccagagttttaaaaagcatactgattaccttgcaaatagtactgtgaaattttaatttttttttcagttcagctcaacttagtgttttgtaatttttaaataaattctgcagataagcacatccatggaggacttctgcctcatctcccacttgctgcgtatgtgtaagagcaccaccatttcaagagtgataggcactcttgatgtgctagatgagtccctgttggcattgtcttgattcatatcttcttggagcaggtttttgtttttgtttttaaagacatctgccactgcttcctctgtgttagagccagtcttcaggactttcatggtcctgatcaaagaccacagtctgcttggctgatttcataccctggaccaagaggctgagtagacaggacctgtggctctgttgctttcctggctagctgtgcggctgtactcactgtatccctgtcttacactcacccgtggaagatagcagcttcttgcctatggactgacttctctgctacaattcagcctttatcttgtctggcctctcattgtgttgtagctcaattgtctggggcccgaatgccagacctcttggtagaggggctcttatagttaaggatcttctggaaattcagaccacagctgccaagtggttgagatgccatttttgtttgtattcttctcctaggaactgtctcgacatttcctttgccagtcagtggtattgaaggctttgatccttcatggtctggggaacaggaacctgggtttcagcatgtatccctaagtgcttactccatatgaaatgcttgtggtatgatacatgcctaggcaccagcaacagccctcacaccaggtcctttaggaaatgctgcaggcctctggaaaggagctggttcttctatctgttgacattctttcagctgtagctcacatgtttgctgtagatcatttgaaggaaaaaggtaattgaggctttctggtgaattggatgagggcttatctgatagagaggaagagatgctacacctctaggattctaaagattgaagactttggctgcatgatgtctcagcctcaccagaaaagtgatttctgacctttttaattttgcctttactctgtccttagcattgtaaatacccacatctttcaaataactgaccccactcttacaatagtaagtctaaagatttaagtgaatacctcctcacatgaatcggtcttgacgtacagtttcttgttattaaaggcgtgagcctggggacttgagtatgcctggatagggaatcttactgctgcaaatctagatggtcctatgcattttgtacttatttgggaactgtattaaagaaagtaggtacggtggcttcagaaccataatcaaatataattctccaaacctaaaagatgagccagctctcgcaatgcagcttctttcactgcctgggatttgtaaatttaagcaatccatttaacaagtggaagtattggaaaatgcagtcatactttgcagctccagcaacaagcactaattgaattttcctgagtgtacctgcacagcagtcacagttgtgtttaaaattttcttccatgccaggtgtcgtggcttacatctgtaactcagtacttggggagaccaaggcaggaggattgctcgaagccaggagtttgagaccagtctgggcaacatagtgagactctgtctctacccccactccccccaaaaaaaaggagagagaaaaaaattttcttcaagctcttgactacaaaaagagatatgctttctcagctgctctggcacttctctccttagatgcatctccagccttagggccacctgctgaaccaggcttccttgtgctgttgacaggatttccaggtatttttggtacaggaatcttaaaggctgaagcaatggatgacaacatgttttcatccatgctttgtattaaaatttttatttttgtagacatggaaaatgatactgccaacattttgtgctctaataagaggatttcatctcttataaagtccactgtccctttctttcttgcatttctttttttgtgtgtatgtgaaacagggtctcactctgttgcccaggctggagtgcagtggcacagtcatagctcagtgcaaccttgaactcctgtgctcaagcaatcctcctgcctcagcttcctgagtagctgggactacaggtgcacgccactgtgcccagctaattttttcattagtagagacagatggggtcttgctatgttgcccaggctggtctcaaacttctgagctcaagcagtcctctcacttcagcctcccaaagtgctgggattacaggcgtgagccaacacgcctggcttctgtcccacgtttttataggtctctgttattgctagttttgtagcatctctcacctgactgttgggattgcagaaaaggatatacaaaaaataccaactttctgagaacttatggcctagccccagaggtttttatgttttcagtgagacacaatagccaactgttcccagatggacattggtggtgctacttgatccatcagcttccatgtcagattctgtgcttcatctttaaccttgtctctcattctgtctactgacgctgagacaataattgtgatttaggacttcccattgtgctgataagctgtccacaaaggcatttacaatttctaatccaatttatgacacctggtagttgctcagatgttacttcaggtccagggtcacactggggttgctgatgtagcacggtaattcttgactgcctggcagctggccacccatgttgtgctgtttcactccatgcagtagaccactgtgggagtctgccccactcagtctcaccaggaatagcagaggtggtaggaacagtgccaggtgctgagtacctccaaaactagtttaaaaaagaaaatcctcgtcttaaatttgttactcactttcctctggattactttcttaatatgtcccaaacaaactgggtccaggccagggcccgcctcaagcagtgttccctttgctgctgtctgagtgtccatgaagggctggtgcttttcctcagtgatcatatgcagttcacccatcttgttttgtttgggaaaccacatttgtgccgcagccttactcttggacagaactgtagacttgtttgtgatgtttgctctgcctgtgctgccagggcatggttgtcttccaccttagagaggctgctcttgggagttctggttgttttcaggcctgggaagatggtatccctagagtgattggctgctacagagctgttcatgctgcttacaaggtctaatgctgttatttcccacaggttgcaaattatggagtgggaggacagtatgaaccgcacttcgacttctctagggtaaggcctaaatcacaggtgctttcaaagggccctgctctagctgatttgagaagggtggagcttctaggagcatttcagcctccacatcagtacccccaccccttgtcctccctccacctctgcatcaccaggggaaactcttcgttactggtgaatcccaaatctggaaccaagggtcctgcagaatgcagtggagcctggctgtctcccctgtagatgtggggcgttcgtcccctgccctaattctgtcaccctttgccctgattctaaagcaaagagcctcactaggtctttgtgaaaactgttcttgtcccttttcctcttccccgtctactccatgccctagccagaatttactttgcagctttggcacatattccaggctgatttatggaacacacacttattacttttccctgacccttttggtcctagtcttgtgggtggtggatgaagcctgttgtaaacttgggtgaaagttgttgtctgttgcagcgaccttttgacagcggcctcaaaacagaggggaataggttagcgacgtttcttaactacgtaagtactgggtccaggcccacctgttcattctcacttaattttgtagaatgatgagcgagatactttcaagcatttagggacggggaatcgtgtggctactttcttaaactacgtgagtatgatgtgtgctgatgagccctaaggggaccctgggtccagagggctgccttatatcccacccccatcagggctgatctcatctgctgttaagtaatggtcaggtccttctggctctcagcacccttcttggctgcagtagggagagttggcctctgtttctattcattttccccactgccaccagcaggactttaacattcctggctcctatttttttccccagtgtttaaaattgtgataaaacagacataacataaaacttaccatcttaaccattttttaaatgtacggttcagtggtattaaatacattcatagtgcgcaagcatcaccaccattcatttccatctattttcatcatctaaaactgaaactctacccattaagcaataattccagattcccctcctgcagctcctggcagccaccattctgctttctgtcgctgtgattttggttacttaaataaatggaatcaaagtattaacacttgtctttttgtgtggctggtgcataatgtcctcaaggtttatccatgttgtagcatattctggcttcttcttcttctttttttttttttttttttttttggagatggagtcttgctctgtcacccagactggagtgcagtggtgggatctcggctcactgcaacctcagcctcccaggttcgagtgattctcatacctcagccttccaagcagctgggattataggcgctagccacaacgcctggctaatttttgtatttttagtagagatagggtttcaccatgttggccaggctggtctcaaactcccgacctcaggtgatccgcccccctcggcctcccaaagtgctgggattacaggcgtgagccactgcgccctgccattctggttcctttttgatgggcccagtgctagtctggacttttgggatgggtgccctggagggttccctccttggcatcagagtgaggagatagccttagctctctctagatgagagctgcctttgtgttctccaaggcttaatggcctgattcccacctcttgcctctgttttatccataggttgtagggtttatctttcacatgaggagcagtttcctctcccctctgctgagagccagctctaaagaggcatagaggcagtaaagtaacttggagacagaagcctgtgtccattttttccctttatgcttttattgtgtggttattacatgctggggattgtgctgtgtacatgctggtgagcagaacatatgtggtctcccttgtgcttgaggtccaatatgagagacttattttaaacatcagagagattcttctttatcttttttttttttttttttttgagacagactctccctctgttgcccaggctggagtgcagtggcgctatctcagcttactgcaaactctgcctcccaggttcaagcgattctcctgcctcagcctcccaagtagctgggattataggcgtgcaccaccatgcccagctaatttttgtatttttagtagagatgaggtttcaccatcttggccagactggtctcaagctcctgacctcaagtgatccacccgccttggcctcccaaagtgctggcattacaggcgtgagccaccatgcccagcctaaacatcagagagattattatgtagttatggagacaggtgctgtgaaccccaggcttggggttcagtggaggcctctctttggaagtaacatatcagttgagacttaaaagttgagtggaaattagctggtagaacatggtttctggcagaagagagagtgtatgtagtcctgtaagagaaaaggaacttgggatgttggaaaggtagaaaaaggctggtgtgtctggagagaggctagtgagactgacagggccttggggttctagaaaagaatctgagtttgatccacagggctgtgagaagccatcagagcttttgtcttattcatttaccatatgtctgtcaagtacccttcagtgagtctggtatgtgtcctgtggaaatattttttacctccaatttttattaaattatggacaaaaaaagtaagagagccagatgggaaagaagtagtgctttggccatgagtcaaggcatgctctgtgggcatgagtacagccttgctagtgtggaacttgtgttcaatgtagtttaaggccttaccataggagaaagcagggcctctagagacacagtgccccacccttccactcagttggccccaggaagggtggctactctgggaaggtgaaggtctgactagagcagcaaactactagagccagagaaacagagctgcagtggggactgcacatggtgttggaaacagtacagagctcctggtcagggcactttgcagagtacagtggcttaggcaaggccaaggctagatggggattcaaagggtggggtcagaacaggcattttctgagtacagactcagattattttcatccagggacagcccggatgtgggtctcctgtgggcctcaactcttgaacactcatgacatggagactgttctaatgaatcacactggttaagtaggcatgggaagagcctttcttggctaaagggctggccatggagcagacaccaagtagtgtcactcatgctgagaggagggcaatctatataccttgtcatgtcctttgtggctcaattgctctgagagccttgggtaggagggtcaagctctatgtcttatatttccagatgagtgatgtagaagctggtggtgccaccgtcttccctgatctgggggctgcaatttggcctaagaaggtaagttctgattcttgtgggtcagaggttgaagcaaggctcagactttactttgtccatgtcccccagtaccattacctggcctgcctgattgtcactgtgatgtgccttagcccacctggggtctgacctggtagcccagcttctccctgtgaagaaaggacagggagggaagtcccttcaggggcgggtgagttcccagacttctacctcagaaaggtaggtgctttctgggaaatgtctctgttgctggagtcccagagccctatcccctgtccatgggaaaatgagggtgtttctgctcagggcagagcttctgtgatgcttgcagtcaggtccctgagcacagtctcttaagaatgtgttctgaaaggccatctctttcccagggtacagctgtgttctggtacaacctcttgcggagcggggaaggtgactaccgaacaagacatgctgcctgccctgtgcttgtgggctgcaagtggggtgagtgtcttaaggggtagtgttggtgttggtggcctcagcttgggctttgcttattggccttagattctgagctgggaggcaactgctgccaaatttgctgagactgtctcccttcttaggtttttttctgctgttattaccatccagccatgtaatgtccatgcagctggtaaatgccaaggcagctggttggaaacactcagagatacacaggaagctgaagaaggcctgaggacgaatagctgcataagcaccataggtccaggaccctctggcaaggcttctgagggagcagagtggagagctggaagcagtgaggggaaagagtgtctcaggcaaacaaggcccatatggatggaggcacaggctaaaaccagcatacgggtgtgggggctggctcccttgtcacttgaagaaagggaggcctgtggcacaggggccagaagatgaggctggaggctgggaccaaactgcagaggctcaagcttgagccttatcctgggagcagttgtggtgagcctcggagaggctcaaaccaggatatgacaggaagtgtttgtaaggagatgagtgtgtagcccccttggagagttttgaagataaatagtgataggtttgcagataattaagcaaatggaaaagaaaacaaggcagttgctgaattcaggggaaaaaaagttgtacaagaaaggaaatgtaagtataatctactagatggctcaggtgtaacacatgatataattatgtacacactgagtattactttaactaaaacttatgatttacctgtactggaaaggtgggaggggatgagtttgtgttttaggggtagaataaaagaattccaaagttgaaagtcaaggaatagaactataagcatcttatctagaaaaatgaggttaaatatcagaagaaacagctagaggagtttaatgttccctgggagtggagattagggatgggaaggagaggcttaggaggagtgctatttatcattataagccttgcgacaattttatttttttcaatgaagtacatgttattactttatattttaaaagctctgtgacttcagtagtgcattgaaataaaatttttattcattatgagagagtctgtgaggaacagaatcatggttcctgtgtgtttgaagatatggcgtggggtgatagtgctggcagcagctctgttgctcttgtgcccatggcatacagactggatctgctggtccacggctcctgaggttaatgtccaagccctctgcaatgctgacagtcttcctcatcctcacaccctacctctcagtttctacctgccacctcccagtaatattaggcctcttgagtccccaacacacgtcagggtggcttctgccttgattactttctcatcctgttgtcactcctgggaccctcttggtgagagaaccatctgggtatgcccatcttcttcccaggataacttctatgtagctttatattctagccctaggatttcctcttccctctaagagcaagaaacatgtgtgcaggttgccatgggaatagagccaaagggcatcaaaggtcatgggcatgaaagggcatgattagatgcccttgggtgctattcccatggcaacctgcacacatgtatcttgtcccactggcagaatttcatacaattatctgtttacatgtgtcttccttaccaattcttcagcaaattgaggcctgagatcatgtcttgtcttatttgtgtctgattccagggcacagtgcagggggtcatcatgaaggagtcattcattcaggctactaaactgaccaataggattgtaacatgcttgctttcttttcacagtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaagagccttacttggagtatttttaagactggaagcttttaccaggttcatcatttcctatgcatcaccttcatgcaggcagagtctggataatgaatgctttagcagcaaaaaagcatcttgggtcttggatttcagacctggtttcaacacttgtgttccctctaagtgtcagtgtccttttctggaaagtagggtaaatagtttctctttgtctcccagagaacatagcacatgtgttcatgattgtaatgctgttataatgtgtacttcatttttaaattttgagataagaattgttcatgatacacagatgtatacttaaaaaaatatgaaggtgagcaggagcacctgtgtcaacaccaagttagaaaagagaacgttttcaagtcagtacctcaggagccccttgggaacccctcctagatcacatctccttcactgcccccagcactttggagataaatcattgtctcatgatgtgtggtactcattcctttgcttgtctttatagttttaccatctatgattagatccctaaataagtagttattctgttttccctgattttgaacttttactaatagaatgagagtaaatatttttgggtatgtggcttcttttgttcaacattgttttaagattcatccgtgttgcttgtgtagctgtaatttgttttaatctttatagtacattcagttttgttaatgcttattgtaggactgtaccataatacaggcagcatgctgctgataaacactggaattgatttcagtctttgtatattgtgaataatgctgtgataaacatttttatacatgattcctggtgcacatataaacacatatttctgtaggatatatatctaggagtggaaatgtggagtcttaatggtgttccaactttactaaataatgtattccaaggtggttatacacattctcaccaggagtaaatgagagttattaccccaatcttttccagtatttagtattttcatacttttgaattttagctagcttggtacatgttacggactaaatgtttgtgtccccccaccagattcatatgttgaaatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccatatgttgaaatcttaacccccaatgtgatgatattaggatgcggagcccttgggaggtcgtaagcatggagcccacgtgagtgggattagtgcccttatgaagagatcccagccctctttctgccatgcgaacacacagcaagaagatgcctgtctatgaaccagggggcccttaccagaaacaaacctactagcatcttgatctcggactttccagttcccataaccatgagaaataaatgtttttaattcaatgtatggtattttattatagcagctctacctaagacagtacatgtatagtgtctatttgaacattactgataatgttgaacaacttttcatgtttattagttattaggtttcttcaagtgttcttattcatacaaattttaaaatatgtacacaagttctttgttatatattttgcaaatatcttctgtggcttgtcttttcactattttagttctgtcttttgataaacaggagcttttaatttttatgtcaaatctatcaagctttttctttttgatttatgttttttatgtcttatttgagaaatccttctataccccaagatcatgaggatgtttcctgtgttctcttctgaaagctatata

SEQ ID NO: 13803 - DNA, 6300 bp, Human
ggtacagttgagtatgcaaggaacaaactctgggtccgtggggcaataggggaccctaccggagctaagattgctgaggtagttagatcagagcccctcaaatgcactgaatcactgaggatcttatcaaaatgcgatttttgattcagaaagtctgggctggggcctgagggttgacaccgctaacaagctcccgggcagggctgacctgcaggtctgggaccacaggaagggtagcaagactggaaatctgtctcctcacaagactgagctgctagtggaggttaccatgtctgttttattcacagcaagtgctttgtagacgtctgttgaatgaattgtgcctacggagtacgcaagctggtgctaaggctcccctctgtgtgttgagttgtgcctgtcagactccactccgggtccagaacctagggctcttcctggtccagggcccagcctggggctgagccaggagggcatatcagctacagaaatcatcctcacagcatggccttgagtcacagcctcttcacctgcctccccacagccacatcctggtccttgtcttcacctgatctgcttatgctcagaagcccaaagcacccaaattccgctgcctcagcataacctcctatcccgcatcccccacactgatcacaacacaccgcaccatgacccagaccctggcctttccttactgctctcctctccctcccacccggggccagtcatcttgaagaagtcttccacatgcccctgtcacactcatccctttaccaaaagcccctaccccatggggtgggtcaggcaggccccaagacaggcccgtatcaggaggacccctcttctctcaggggctgccctctgggataaccacccccgcccttctgggtttcctgcttcctatctggctgcagtttctcaggtcccttgtggatttccccatggtctgtccccactcacatcccctctctgcaaaccttgcctactgggcctgcacctggcaaatccatgctcagcacagacggggatcaagacctctcaatacaactgtctcctgccaatccctgccccagcagcctgaggcccagtctgaaaccagggagttgctctcctttctcctcccttgacctcacccctcagaccatgccaattctgcctcctaaacctcccaggccagcccctcccccagctcccagtgacagtgtcctcaggtacctgagctcagctctcggtgctaccagagggactgccaggggctgcagccgggcctcctgcagaggctgagtcccacacgcagggaacagccatgccactgctagcagaccagtaagagaatggccacctggggcctgagcgccctcggccatccaccagaaacaaagtgtcaaggagaagctgcccgaagcccatgggacaaaccactggggactggaacaccagtaattctgtattgggaagcggcaccaagagatgtgcttctcagagcctgaggctgaacgtggatgtttagcagcgtgaccggctaccagacaaactctcatctgttccagtggcctcctggccacccaccaggaccaagcagggcgggcagcagagggccagggtagtccaggtgatggcagatgagatcccactgggcaggaggcctcagtgagctgagtcaggcttccccttcctgccacaggggtcctctcacctgctgccatgcttcccatctctcatcctccttgacaagatgaagtgataccgtttaagtaatcttttttcttgtttcactgatcttgagtactagaaagtcatggatgaataattacgtctgtggttttctatggaggttccatgtcagataaagatccttccgacgcctgccccacaccaccacctccccccgccttgcccggggttgtgggcaccttgctgctgcacatataaggcgggaggctgttgccaactcttcagagccccacgaaggaccagaacaagacagagtgcctcctgccgatccaaacatgagccgcctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggtgagtagcttggataagactggcctgcagcagtgaggggtggtggctgcctaaggccaaaaggcctcatgggcctttctctcccttcacccccacaggacttcaacaacctcaatggggaagaccaagacattctgatggtaagagctcagcccgtggatcccgatccacttcctgcctgggtgacttcagccatgtcattccatcttacctagccttgctttcttcatctgtaaaatagggttaatagcacctatctcagtgggattgttatgacaatcaaatggcacaatgtgcatgttctggcccagcatctggcacttaagagttcaatacatggccacagccatggctataataatgaaaatgacttttaaattagaaaatgaaaaggcagttctaggtgaggaataccaagggccttaaggtcagtgtttggtagggcagactctggactgacagacagaaatttccccctcagatgtgccagcttctttttcccttaaaaaattgagtttgtgttttccaccctcattggctgtggcattatcatttacagttatttttcatggttccagttggttgcagttgttctgtctcacctttgcatgacatttcttgggtcaaacaagaagtggaagcctttgctgagttcctgggccatctgtgtttggggcactcacagctcacatgctgcacccatttccatgctggggtctctgtgattttcttcttgatttctaggagactttaattcagtcagggcatgaacactgttatcagcctctgagctacaaatacttcccttggaaaaccccctgtcttttgtagagcttctttttggagatattttttcccccaagtgcagaaagatccacctaggtaccccctccccacccatttttttttttttttttgagacaagagtctcactctgttgcccaggctggagtgcagtggcacgatctcagctcactgctacctctgcctcctgagttcaagcaattctcctgtctcagcctcccaagtagctaggattacaggcatgcaccaccactcccatttttgtatttttagtagagacggggtttcaccatattggtcaggctggtcttgaactcgacctcaggttatctgcctgcctcggcctcccaaagtgctgggattacaggcttgagccactgcgcccagcccacctaggccctttatgtagctcaaatggagccagagactgggggcttgaggaaaccaggtcctgcctgccactcacttctaggcctgtgcccttgggcagggacccacctgaggcaagaacgggactaggagggaacccgaggatgtccccaacagtgggcttgggaaactgtgggggtgacttccacctgcttgtgggagggatactctgtaacctttcccccttaagtgtattctctgccccgttaggaaaataaccttcgaaggccaaacctggaggcattcaacagggctgtcaagagtttacagaacgcatcagcaattgagagcattcttaaagtatgtgaagctgttgagggtttgggatccctgtgttggccctgccctgcctctggggaggagagcagggcccactccctttccaagggaatctctgaccatctgctttggtctctttccacagaatctcctgccatgtctgcccctggccacggccgcacccacggtaagctgtcccccaagatgcccgtcatggcttgctcctcagctggtcatcaccattacagcctggactcacctaatgccaccttcttggtttctttatagcgacatccaatccatatcaaggacggtgactggaatgaattccggaggaaactgacgttctatctgaaaacccttgagaatgcgcaggctcaacagacgactttgagcctcgcgatcttttgagtccaacgtccagctcgttctctgggccttctcaccacagagcctcgggacatcaaaaacagcagaacttctgaaacctctgggtcatctctcacacattccaggaccagaagcatttcaccttttcctgcggcatcagatgaattgttaattatctaatttctgaaatgtgcagctcccatttggccttgtgcggttgtgttctcatttttatcccattgagactatttatttatgtatgtatgtatttatttatttattgcctggagtgtgaactgtatttattttagcagaggagccatgtcctgctgcttctgcaaaaaactcagagtggggtggggagcatgttcatttgtacctcgagttttaaactggttcctagggatgtgtgagaataaactagactctgaacaactgctttgttaccagtgtctcaatttgacttgggacttagtgaccattttaagggagactggtgtgccacaaatcctgggtggcttgatcctgccacgtggatgctgtctgggtgagcttgttctcacactgccctcctgccacccccatttccagaaaggtgatgataaccctagcaatcttgaaaatccacagaactgctaccaggtaccaggagccgttctgagcattttacctatgctatctaacttattcctcaccccaaccaagagtatgttttctccgtttcatgggaaactgaagttcggcctggttgagcaactgcctaagctgatagtggcccagctggggcttgaattcaggtccctgtggtctggagcatgctaatcctgtggcatgtctccccctagtggtccttccagaaactgcagccgccgcccctgctcctcccagggccaacatcagggatcaacatcccctgaccccctcaaggcagcaggttctgctgacacaagccacccaattcttcattccattcctttaaaaccctccaagcctggagtctccacccctgcctaagcccccagcctctcctgcctgatgatttagcagccaccctgtaggcctcccggccagccctggaacccacaccctgacgatctgtgctctactggggagccagatggagttttagaaaatgcaaatctgaccatgtggatctatactgaatcccccagtcctcggggtcttctggaccttgtccatatccttaggacaacgtataaggctcacctccatctgttgcttctgtttcccccatggctaccaccctaatcaatgctccagccaacaggagtgctgggacttcctagacagccttccatgaagcctctcttcatgccctggagcttctatccacattgtcacctcagtctggcatgcccttacttggcttgatgagttcctattccatggaccaactcaaactctgcccacctctggactgtccacaccatcccaggatggggccctcctccgaaataggtgggtacacagggacccactggagggacagccactgtggcacggaggtggtgcagaccagcctggaggcagaaggcaggaggctgggacatcccgagtgtggcttcagtctaccacctggccctttagccctgagtgcccccctctaactcccctgcacaccaccctgtggccctactcagtctgccagtggaaggaggggcagaggggccttcctctgtcaccacgtaagcagcaatagcatcctctctgattcctctcaagtcccagaaaagcgtcagaggctgacaccaggtgcaggggtcctgtccccctttttcctgttttccaccttgatccatccctcccttgaggttatgaataaggaacagcccggctgcttgaatgggactggagatgatggaagatttatctgctacaggctcagaactctatttccctaaattcttccccctaaaaaatcgttatgttcccacagaagaactctcttttccccctccccccacctctccccagcctggctcactgagggcattgcctggggaccaggggatgtctgttgttggacttagcctgggaggagatacagaggatgctgctgcagtttctggattgaccactagggggaggtgtgtgccactggtctcagggcacttcagaggtcctggaggagccaggcctgagagggtagggtgagaggtctgactctggactgggtttcccaagtctcctgcacacccagctcccc

SEQ ID NO: 13804 - DNA, 85963 bp, Human
  misc_feature (1)...(85963): n = A,T,C or G
aatttgctcattatatggagttgtttttcgtttttaattattttaacttttttgagacagggtcttgctctgtcactgagactggagtgcagtggtgcgattagggctcattgcagccttcatctcctgggtacaaacgattctcccacctcagcctctctagtagttaggaccacaagcctgtgccaccacaaacggctaattttttattttttgtagagatggggtctcactatgttgccctgtcttgtatgaggttattcattgcagcttagcatgtaatagtaatggcttggcaacaagcggaatatccacctgtaggggattggttaaataaattaggatgtttgcataagtggaatattattctgcctctaggaagaaaaaggtagttcattatatactgatatggcaggatgtccaagacatttttttcttttttctttttttgagacagggtctcactctcatccaggctggatggcaagctcccggctcactgcagcaccgacctcctaggctcaagtgatcctcccacctcagtctccagagtaggtgggactatacgcatgcaccaccacgcccggctaatttttgtatttttcatagggatggggttttgccatgttgccggggttggtctcaaactcctggtctcaagcgatcagcccccctcggcctcctaaagtgttgggatcataggcctgagccactgtgcccagcctatccaagatatttgaagtgagaaaaaaaggactgaacagcgtatatagtgtgttaccttttgtgtaaaaagaagtatccctatattttaatgtattacttacaaatatgtagggaaagatacattattaaatgctaagtgattgccttccaggactgaaacagctaacagacagagatgggagaatcaattattttttattctgtcatgttttgagttttctattaagacatttcctaatttatatagctctatagagaaaatgcatataaagagtgaagcttaaaagaaatagtagatgtttagaggtgaaagaagtgttcagaatgatatgctgaagaaaaacattagtgggccgggtgcggtggctcacgcctgtaatcccaacactttgggaggcccaggcgggtggattggttgaggtcaggagttcgagaccagcctggccaacatggtgaaaccgtgtctctattaaaaatacaaaaattagccgtaggtggtggctcccccctttaatcccagctactccggaggctgaggtactagaatcgcttgaactcgggaggcggaggttgcagtgagccgagatcccgccattgtactccagcctgggcgacaacagcgagatctatctcaataaataaatgaaaaggaaaacattagtggcagaagatgtttaaatgacgaagaaagagggacggtttggcttcttagggtaagtttactggaaataccgaacagcctcctgcgtcctttgcctttttgctggacctcttgaggactcgaggcttcgacacctggaagcaagtctaggaagctccgggttgggccggatccccaccagaggcgaggggcggaaggcctgggtttgtcacctgagccccagaaccggcatatccggttcggcccggccccgcccttcggaacctcactagcgggctacgcgcaggagggcgtgagctcccggatgtgcaggccctgtactgccgtggcagccctgccggacgcggccgcagtgcccagaggctcaggcctataccgctcgggcgggtcctttgcctggcccgggtcatcagacccccacagccgggaacgtcaccaccccgggcgtcagcctcccggcccagccggcccacagacccccgccccctactcccccagcggggaggggcgcagaggcatcacgtgacgccccgcacccgcccggtcttggtcacatgtggcacgccgctgcgtcagtcacagccctggctgcaggagtccagctgccgtcccccgccagcgggcggggcggggatctggtgccaggtcttcgttaacccgcccccgccgcctcagtcagctgtcccagcccgggcccgaccgtcatggagcggtgcggggcctacgcctgttccgtgtgaggcgcatcgctgccgccgccgcggacgccgccttcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggctacggagccgggactggaggtaagaagggccgacagactgacccaggccgggccgggccgcgggggttgtggccggggccgggtgggggtgggggcccgcaagttctgcggggagcctcggggagaccctccgggctggggctgctcaatcaggcgtcacccctcctctcatctgcgcgtcccaccccaccaccttcccgcaaagataagaaaataaaaaaagctaacccaatcctaacaaaaattcccagaaatccatccgtttagtgtttctcctttcctctttctttcctcagacgttccatcggctgatttgttactttttcatatcctcctcaatttcaaattatgtctaattaaagagaaaataggcccagattctggctaacattacccagctagttctcgctttccttctcgcgatcctgcgcacctctcccacacccccacccccgcaaaaaaaaaaaaaaaagaaggaaaaatttccgccttcgacttgcgaaggggattgactaaaaatgggaacgtgggggtataatactcgaataccctcccctacaacttctgaatcggtctgttacctagttatcccagtagcttgtgcgtggatattgatgtttaggcctttcctccagctgcctgtgcttggggttaatctcgtaattgacgtcagtgctttgttccttctactttgctgttccttccactctttgaggatggatcatggagtacaggagttttgggagtaaccttattgccttttcgtttacaaacagtattattttcaggaagtggaagtacgaatctgaaatgtttgtatatggagttcaaggcgaagagttcgatttagggttctcgtagttttgtcagttgtaattcagaattatgcggtttcttccctgctggccacatggaaattttatactaaggccagtcacttttccattgaccagtgtttttcttgatggaatctaagctataggtgtctgtgaatagactgtaaatgtaacataaaatgtgtgctgtttttcgggctcagatatgaaaagcgcaaagcttcgtttctgtattgattctgcacttcataaagtgctttttaaaacttaactggtctttaacttatcaaaattgaaatatttatgagaactttcttaatttgggatttgataaagagcctttgtggtctgtgagtctgcctagaatcatctttggtcatacgtgcataaagaagtgttggcaagtggccacttggttttcaacaaagctggcttctttaaatttctcagattcgttttccttattatcactgcatctttcagctcctaaatataagaaaaattcccagtaagttattttaagttatctttcagagttaacttactaaaaacctggaagcagtcaaatttttctttttttattaccagcagtttcattcaatttgcggtggtttgcaggctggtactttgatttttgttaactctctagaaacagtaggcaaattttactttaaataaaattttgcttcaagtggggacaagatggggtgtctgaaaaaagagcccagctgtgttaattggaacatgatctacagtttgggagtgtaaggtgaagctgtgtaattaagaattcttaaagattgaatatttttgttctgagtcactttctacttgtcagattctcacattcaggttgatacattctcttctgtgtactcttgagttattgtaccctttttgtagcaatatattctgcagccgggcctggtggttcacgcctgtaatcctagcactttagcactttgagaggccgaggtgggcggatcacctgaggtcaggagttctagaccatcctggccaacataatgaaaccccgtctctactaaaaatacaagaattagccaggtgtggtggtgcacacctgtagttctagctacttgagaggctgaggcatgagaaccaaattagccagacatggtggtacatgcctgtagtcccagctactccagaggctgaggcacgagaatcgcttgagaatcgcttgaactgggaggcgaaggttgcagtaagccgagatcacaccactggaatgcagcggctccatctctgctcactgcaacctctgcctcctgggttcaagcgattctcctgcctcagcctcctgagtagttgggattgcaggtacacactaccattcccagttaatgttttttgtatttttagtagagacggggtttcagcaggttggtcagactggtctcgaactcctgacctcgtgatccacacgcctcggcctccccaaagtgttgggattacaggcatgagcactgcgcccggccaacctaggcgatgtctcaaacaagcagaagcctactatatgttttgcactgtaattttctttttttccctgtctcttgcagatattgagggatgcataataattttcttacagatctgttacagggtctttgaggaagtactatatttattcctctttttatcttcctcagtattttacacaattactagattgaatttgaatgtgataatattttgaacttgaaattgttgttctatcaacttatctaagatttcacaaaaaggtaatgtaaagaaagctgtatgagcaaaggatcagtatttgaaagggaaaaacctgtcagtttcagaagatgagacagaagatgaagctttctaaaagttatatattttgccttttttgagaaggtaaggtaaatgccgtagttttatgtgtacctgagaggaacaaataaaacaggtatttcttcctttgtggccatccactggtttagaatggagttcaaaatctatgaggacttttctttgtggtatttttaataaaatcaaagaggtattcttaagtattgagagcacacctggacaatgacccagaagtacagcatgtactataaaaaattgatgacttagatttttttttactttagctttattctacagatatctcactatgaagacttttctatatgatataaaggttcccagctctcctgcatccttattatgttttacccattcccttattcatttcctctgataagttggaacaattctatttgatttctgggagggtgttagctagtctcagttattgtgaaagaaggtgtagtgactaaagactgcctaaagctaacctgacctgttaccttgctgctttttcctttggtttaagaaaagcgctcctactggccaggcgcagtggcttatgcctgtaatcccagcactttgggaggctgaggctggcggatcacgaggtcaggagatcgagaccatcctggctaacacgtctctactaaaagaatacaaaaaattagctgggtgtggtggcaggcgcctgtagtcccagctacttgggaggctgaggcagcagaatggcgtgaacccaggaggcggagcttgcagtgagtcgagatcgcaccactgcactccagcctgggcaacagagcgagactccgtctcaaaaaaaaaaaaaaaaaaaaaaaaagaaaagcactcctacttgttgttaactccctatacatacccttcttggttatttgaagtgatactctagtacacggaagagggcagtaatatatgttccagttactgagttttggcacatcatctgcattcctatttgtcttgatgttcattttcgctggtatcatatcttgaaagttttaacgatactggggcacagaaaatattagaacctccaaattcaattccagagtattccaaaacattttaatactagaactacctattctatttttgaagaaaaaaaatcttagctacctgctttatcagctattctttatttaaaaaaatctgtaaccttgccgggcccggtggctcatgcctgtaatcccagcactttgggaggccaaggtgggcggatcacgaggtcgagagatcaagacaatcctggacaatatggtgaaaccccgtctttactaaaaatacaaaaattagctgggcatggtggcgcctgtagtcccagctacttgggaggctgaggcaggagaatcgcttgaacctgggaggcggaggttgcagtgagctgagatcgcaccactgcactccagcctggcaacacagcaagactctatctcaaaaaaaaaaaaaaaaatctgtaacctgaggaatgttctgacagaaggcattttatgtaactttttctctcttggagttcttaatgaactgtgttggtggcttttaggcaaggaaacgtagcttattagtggatactgttttaaactaattacttcaataatcatttcctaggacaggtaaaagaacttcatgtattcttttcccaaggttgttgggtaggaggaatcagggactgacatgaatagactgcactggaaagccagtatggtttgattacccagagatctgttcggggacagggctgcctggagttgctttgggcctaatagctctcccaggattttgtcagtttggagttgcctagtgggttatgacttttccttttcatgtcatcattagggaagggacagttttatggagagatgagtaccagccaatactctgtagagacacaccttcttacctttttgcagttgcttccatttcttccaattggaatattatttcttctaacttgtttcttacctgttaaaatttcaccgtttttaaaggcctgatttacgtttcattgccttcttgaagttttggttaattcttcaccccactccagttgtgatctacttcctttcaatctctgcatcactttgtagctccttttttttttttttttttttttttgagacagggtctcactctgtcatccaggctggagtgcagtgatgtgatcttggctcactgcaacctctgcttcccaggctcaagcaattttcataactcagcctcccgagtagctgggactacaggtgtgcaccaccatgccctgctaattttttttgtattttttgtagaaatggggtttcgccctgttgtccaggctggtgtacctcttttaattatttgttatgcagctactatgggactatagcctgctgagtaacatcacgaaaaatgtattagggaagacactagtaaaagaaggactgtaagtgttgtaatatttcattatgtgtttctaaaatataaagattaaaacaatcccaatattatacactaaaaaaagtaacacgcattccttaatatcatcaatatcaagtgttcacatttccctgattatagtttttgtattgtttttacaatttttgtgaattaggatccaaataaggtctgtaaatattacattgggtttaggtaatcgatacttttttcttttaatctataagttttcctctatctttttattgtggttattcccatacaattggtttgttgaagaagccaggtctttgccctatgatacttctcagaatctagattgtgttgatgagatcccagtggtttcatgtaatatgttcttttgtcccttgtattttctgtaaattttgtttattttattttttttatttctattatttgagttggagtcttgcactgtcacccaggctagagtacagtggcatgatctcaactcactgcaacctccgcttcctggatttcaagcagtcctgccccagcctcctgagtagctggggtctacaggcgcctgccaccatgcccagccaatttttgtatttttagtagagacagggttttgccatgttgaccaggctgatctcgaactcctgacctcaggtgatctgcctgcctcggcctcccaaagtgctgggattatacgtatgagccactgcacccgtcctttctgtaaattttaatagttaacatctagaagtctgatctgatttagcattaaataaaataacattttaaataataacattttaaataataataataattattatttttttggacaggactgcactcggttacccaggctggagtgcatggggcagtcacggctcactgcagccttgatctgctgcacacatgtgatcctcctgcctcagccttccaagtagctaggactacaggcacgagccaccatacctggctaaattttttggtttttgcaaagatggggtcttgctgtattgcctgggctggttacaaattcctggcctcaggtagtcctcccacctcagccactcagtgtgctgagattccaggcatgagttactgcacctggccatttttctgtttttttttttttttttttttttttttttttgagacgaagtctcacactgtcacccaggctggagtgcaatggtgcaatcttggctcaccacaaccttcacctcccaggttcaactgattcttctgcctcagcctcctgagtagctgggattacaggcacctgccaccatgcccggccaatttttgtatttttagtagagatggggtttcaccatgttggtcaggctggtcttgaactcctgacctcatgatctgcctgcctcagcctcccaaagtgctggggttacaggtgtgagccaccttgcctggcccatgtttacatttttaaatggtgggagaaaaatcattttttttagcaagtcaatattttaggaaactcagatttctttctctcgctctctctttttttttttttttctgagatggagtcttgctctgttgcccaggctggagtgcagtggcatgatctcggctcactgcagcctctgcctcccaggttcaagtgattctccctgcttcagcctcccgagtagctgggattacagatgtgcgccaccacacctagctaatttttgtagttttagtagagatggggttttgccaggttggccaggctggtcttgaacttctgacctctggtaatccacctgccttagccttccaaggtgctgggattacaagcatgagccactgggcccggccaggaaactcagatttcaatgtccataaataaagttttactggaacacaggcagcacacccgtttgttttttgtttatgtattgtctgtggctgcttttgctgctgtgatggcagaatttagtaattgtgactatatggcctgccaaacctgaaatatttactgtggccctaaaaacatttgttgaatccagccttagtggatacttgggtttgaggatttctttagggttgagcagttagttacaaggtccccatttacttggtggctgttagggttttttgtttgtagaatatgtatatttgtgtaatacatatgagtataatacacatatatttacatgtattacgtgtattatatatttatatattacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttctgtgctaaatattgtcttgggacctgagttttgttattggctttgatctgtaggtgtacaacctttgtttccctgacttgtaggaagtgacctcttcagactgtctcatgggtagagaaattctaccaaatgaggccaagagggatttatgtactgttgaggctttgtgctttagcatagtgcattgtggtaaagttacagtttaatagcagttgtaatatactgggtttgaaaataattgaaatattagctcaaatctcattttgactttcagagtttaaatcactcaataatcttatagttgaatgactctgtttttcagtaggatagttattttaagacactaagtgaaaaaaacaaaaaacaaaaaacattgtaacaaattctgacctccacttgaatgggggatgttagaatacacattttacactaaatagttttaattttttgttttcgaggcagagtcttactctgttgtgcagcctagagtggagtggcacaatctcggctcactgcaatttttgcctccgagattcaaatgattctcttgcctcagcctcccgagtagctgggactacaggtgcgcgttaccacacccggctaatttttgtagttttagtagagatggggtttggccatgttggccaggctggtcttgaactcctgacctcacgtgatccactgcctcagtctcccaaagtgctgggattacagatgccagccacaacgctcggttgttttaaattttttaaaattaaacttgcaaaaagtcataaagtgttttatatacttatttaatttatttgagacagagtctcactcagttgccacaaagtgcagtggcatgatctcggctcactgcaacctctgcttcccgggttcaagcgattctcgtgcctccacctcccaagtagctgggactacaggagcacgccaccacgcctgacctaaaatgttttataactaatgtatgtgtttataaaaaaattatagaatgcatttaattcctaggaatacacatttaaatttttatttttaaggtgtactaatttttttattgtggcaaaatataaaatttactattttaataattttacatatacaattcagtggcattaagtacattcacagtgttgtacaatcatcaatactgtctgtttccagaactttttcatcatcccaaacagaacctccccacctctattctattttcggtctctatgaatttgcctattctaggtgcctcatattaagtagaatcatacaatatgtgtccttttgtgtctgacttatttcacatagcataacgtttcaaggttcatctatgttgtagcatgtatcagaatttcattccttatggctaaatagtattccattatgtatgtgtgtatatataccacattttgcttatccgtgttgatggatcgtcatctgttgatggacatttgggttgtttccatcttttcgctattgtgaacaatgctgctatgaacattggtgtacatggatctgtttgagtctctgctttcggttcttttggatatattcctaggagtaaaattgctggatcctatggtaattatttgttaaagtttttgaggaactgccaatccatagcagctgcaccattgcatattcccaccagcagtgcacaaaggttacaatttgtctgcatcctcaccaacacgtgttattttgtgtttttgtttttatcatagccatcctaatgggtgtggagtgatattgtgggtttttttctttcactaaactttacttgtttattaatttattttttttgagacagagttttgctcttgttgcccaggctggagtgcaatggtgcaatcgtggctcaccacaacctccgcgtcccgggttcaagcaattctcctgcctcatcctcccgagtagctgggattacaggcttgcgccaccacgcctggctaattttgtatttttagtagagacggggtttttccatgttggtcaggctagtctcaaactcctgacctcagatgatccgcctgcctcagcctgcgaaagtgctaggattacaggcgcgagccaccgtgcccggcctgtttatttttatttttattttgagatggagtcttgttctgtcgcccaggctggagtgcagtgcagtggtgcagtgttggctcactgcaacctccacctcccaggttcaagcaattctcctgtctcagcctcccaagtagctgggattacaggtgcccaccaccatgcccagctaatttttgtatttttagtggagacggggtttcactatgttggccaggctggtctcgaactcctgatctcaggtgatcctcctgccttggcctcccaaagtgctgggtttacaggcgtgacccaccatgcccagtgttgtttgtttttaaaagtaggcagtcaagtgtgggagtgagaaggggtcaaagactagagcaaggggttcagtctataacttgactgtgaacaatcagttgagataactgactaccttcgaaccagcctctcattaaactttgtttcatgggtctcaaaattctgagacagattcttggttaagtcgcttccattgaacagtactgattttaaaaactagtaatttaaaactgccacatgaaaaaaactgaaaatggatcacaaaacagtcatcttttccttctgaagatttcaccatgcactgttatcattaaccagtcttttactgttaaacttaaatggccaatcgaaacaaacaattctgagactgttcttctaccattgattgagactggggtggcaggtattagggatgatattcatttagtcttccgagctttctgggcagactcgatgatattgccaggtccaggagccttcttgtccactgtttttttttttttaattaaaaaaaatttttttttctttttttttttttgagatggaatttcactcttgttgcccaggctggagtgcaatgacatggtcacggctcactgcaacctccacctcccgtgttcaagtgattctcctgcctcagcctctcaagtagctgggattacaggcgcctgccaccatgcttggctaatttttgtatttttagtagagatggggtttcactctgttggccagactggtcttgaactcctgacctcaggttgtccgcctgcctcagcctccaaagtgctgggattacgggcgtgagccaattttaaattttttgagagagagtctcactctgtcactcaggctggagtgcagtgatactaccttgactcatttgaacttccacctctcaggctcaagcattccccagacctcagtttcctgagtagctgggaccacagacgcatgccaccacacccagctaattttttgtattttttgtagagatggagtttcaccatgttgcccagggtggtctcaaactcctgagcttgagtgattctcctgccatggcttccaaagtgctgggattacaggtgtgaaccaccgtgcctgaccttctggccttatcctctgtttttttttggagacagagtctcgcgctgtcgcccaggctggagtgcagcggcacgatctcggctcactgcaagctccgcctcctgggttcacgccattctcctgcctcagcctcccgagtagctgggactacaggcgcccgccattacacctggctaattttttgtatttttagtagagatggggtttcaccgtgttagccaggatggtcttgatctcctgaccttgtgatctgccctcctcagcctcccaaagtgctgggattacaggcttatcctctgttttgatgacactcacagcaactgtttgtcttacattatgaacaacaaaacaacccaaagaaggatagtcagaagctctcaacacacgtgtgggcttgccaggaattttatcaaagatgggagcattaccagatttcaagaatttagggccatctttcaccttaccagaatggcaatccgtctttcccttcagctcaggaaacttgcaggcagtgtgagccatgtggcaatccattacaggagcatagccagcactgatttggactgggtggttcaggataatcacctgagcagtgaagccagctgcttccattggtgggtcatttttcctgtcaccagcaacattgccatgatgaacatttttgacagatacgttcttgatgttgaagcccccattgttcccaggaaaaacttcactcaaagcttcatggtatattgcaacagatttggctttagttgtaacattgactggagccaaggtgacctctatgctgacaccagtctccacttggcctacagagatagtaccaataccaccaattttgtagatattttggagagacagacacaagggcttgtcagttggacaaattggtagtaggatgcaatccagagcttcaagcagggtgtttatactggcatttgccatctttacaggtgactttccatcccttgaaccaaggcatgttagcacttggccacagcatgttgccatcattccaaccagaaattggcacaaatgctactgtgttggggttgtggccaactttcttattgtaagggctgacttccttaaccatttccttgtatctcttctgtttgtagggcggctaagtggaatccattttgttaactccagcaattagctgtttcacacccagtgtgtaagtcagaaggagataccagcttcaaattcaccagctgcaacaatcagggtagcacagtcagcctgagatgtgcctgtaatcatgctttttaaaaaatctttgtcttggggcgtcaactagttacataatactttctggcctcaagtttccgcagggaactgtcatcagtgccaccaccctcacactcagctttcagtttatccaagacccaggtgtacttgaaggacccctttcccatcacagtagccttgtagagactgggtctcatcatgtggcccaaggtggtcttgaactcctgagctcaagcgatcctcatgcctcggcctcccaaactgctgggattacaggcatgagccactgcacccaggtgataaatggtattttgtcaagtggcaggattaataatatctgacatgggccgggtgcaatggcttacgcctctaattccagcacttgggaggccgaggtgggtggatcacctgaggtcgggagtttgagactagcctgaccaacatggagaaaccccatctctacttaaaatacaaaatcatcctggcatggtggcgcatgcctgtaatcccagctacttgggaggttgaggtaggagaatcacttgaatccggcaggcgaaggttgtggtgagccgagatggtgccattgcactccagcctgggcaacaagagcgaaactctgtctttaaaaaaaaaaaaaaaaaaaggtcaaaaggactgagttcagggggcttccagaaaggtaacctagaacatgttcatgtagtgagagggtggcacacctttctccaagggaattgaagctccttcaccattgtacatcttgcctctgtaactcttcatttgacggtttatttatatcctttaaaataacatttgtaagagcctagtaaccaggtttccattaattctgtgagcttctccagcaaattattaaaactgaaggaaggggttgcagaaccctgatttttagccagttggtcagaagcacaggtaaaaacaacctgggacttgggattgacatcttaagtggggagcagccttggggactgaaccctcactcaacctgtggggtctgacagtatctccaggtaggagacagagaacacccagctggtattttctgaagaattgattgcttactttttttttttttttttgagatggagtcttgctctgttccccgggctggagtgcactggtgcgatctcgtctcactgcaacctctgcctcctgggttcaagcgattctcctgcctcagcctcctaagtagctgggattaaggcatgtgccaccatgccctgtcaatttttgtatttttagtagaggaggggattccccgtgttggccaggctcatctcaaatgcctgacctcaggtaatctgccctcgttggcctcctaaagtgctgggattgcaggcgtgagccaccgcgcctggccaattgcttgcttgtgcgtgcgaaaaaaaaccccacacatctggtgttagaaggatgttgtgagagtattgtgtgagaaactgagtttgttggctgggcactgtggctcacacctgtaatcccagcacatttggaggccaaggtgagcagatctcttgagatcgggagttggagaccagcctgggcaacattgcgaaaccctgtccctacaaaaatacaaaaaaagttagccaggtgtggtggtgtgtgcctgtaattccagttatttgggaggctgaggcatgagaatcatttgaacctcggagtctgaggttgcagtgagctgagattgtgccactgctttccagcctgggagatagagtgagacactgtctcaaaaaaaataaaaaagaaaagaaaagaaactgagcttgtttattcctgtattctcatagctataaaatagttttgcccgtttgacaaagatatacttcagattgactcatttaaatttcatgttaacgttggaggagttgaaattactggaattattgcttttggagaaaacttatttcatcttagccagagatagtgatggtaagagacacaggaggcaaaaaaaatcgaaccaatatatttgatacaaaaagatcagaaaaaaatagagaataagcactataactggtatattaattttttcttttctttctttttttttttgagatgtagtttcgttttgtcacccaggctggagttcagtgatgcaatctcagctcactgcaacctccgcctcctgagttcaagcttttctcctgcatcagcctcctgagtagctgggattacaggcacctgccaccatgcctggctaatttttgtatttttggtggagatggggtttcaccgtgttggccaggctggtcttgaattcttgacctcaggtcatccgcctgcctcggcctcccaaagtgctgggattacaggagtgagccacagcacccgacctaattattacagtgagttaatttagttcttagcttcctggtagccttataagtgttcacttgtgtgactttgattgtttaaaaaaccagtttctttgacattgaattacagaaagaattttattataggaatcacctatttttacaagagatatagaaatacttcttgaatgattatttcagtgctgctcaatctataaaataaaatcatactttattttttgtttttatttttatttttttttgagacggagtctccctctgtcgcccaggctggagtgcagtggtgcgatctcgactcactgcaagctccgcctcccgggttcacgccattctcctgcctcagcctcccgagtagctgggacttcaggcgcccaccgccacgcccggataatttctttttatatttttagtagagatggggtttcactgtgttagccaggatatctcaatctcctgaccttgtgatctgcccgcctccgccacccaaattgctaggattacaggcgtgagccaccgcacccggcctttatttttatttttttgagatggagtcttgctcttgtcacccaggctggagtccagtggtgcgatcttgactcactgcaacctccgcctcccaggttcatgcagttctcctgcctcagcctcctgagtagctgggattataggcacctgctaccacggcaggctacttttttgtattttgtagtagagatggggtttcactgcattggccaggctggtcttgaactccttacctccagttgatccgcccgccttggcctctcaaagtgcttgaattagagtcagtcagccaccgctcctaacctatcattccagtatgtcgtgaacaagctctgtaatcccaggatcgtttactatgcacatgtgagctatgaccacctgtacttattgcgatgtttaaaccactaacaagtactatctctggtttaatgccttcttcgctatctcagaatcctaagactcctcggacggtgatgattacgttgcaatgattcaaataatagcaaacatagcttacagaaggtaagaacattcgctgtgaaccatggaatagggagaagatggtctcgctgctaatactcgcatcctgtagtatctacagggcgacattcagtgagcatcaaaggcaacatctgcctcctagacctccaccaaactctccttgcttgagcctcccaaaaatctttaacacgtttcagcagcactacataataaccaacattttaagaacacacacacatcatgacatgactgactatgaaaggcaaagcagacgcccgaactccaggacccactaggacaacacccagtcatacacactcaaactaacctatcgacacaaccaacggaccacggcaacagaacatcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttttgtccgggttgcccttttcgccggtgtttgttctcgggcctgtgtgctccccttcgcctcccgtgtgctgggtgtgacggctgtagccgttcaggccgtgttttgtttttattgcatgacacttagtatgcaaatcaggaggttttaattttaaatgtttgctttcactagttctaaccactgattaaagtcctcaaaagtacttggttgctctcatgcctgtaatcccagcactttgggaggccaaggtgggaggatcacttgaggtcaggagtccagcctggcctggccaacatggtgaaatcctgtctctactaaaaataaaaaaattagccagccattggcatgcacctgtaatcccagctactcaggaggctgaggtaggagaatcgcttgaacccgggaggcataggttgtggtgagctgggagatcgcaccaccgcactccagcctggatgatagagcaagactctgtttcaaaaaaaaaaaaaagagtataatactgctttgttactaattctaattttataattatagtttctgatgaactttaattttctgatttgatttatgaattataggccagaaatgctccacacatataacctgattgtttctttctgggctccagtgagcctttttttttaaaaaaaaaaacaaaaccaggtctgattatttaatctgtctccagggaagagtgttgcagattccctggtaatccctagtgccagagtttgccagcctttactaccattgtctgtttaatcaaaatccttgctgctataaattggctgtatttctcttggtttgttctagtgaaaataagacaaactgtcctgattatagagatgggacttccattttcccctcactccaaagacttcctttttcaatacaagtttagttgctgttactaatccaagttaatttttgattctatcactgaaaacctgggttttgccatttattgaggtgttaattgaaatattaatatatttagagcagaaatgtcgttttttagggaatctagagcaacagcaaagctgaggtcaaactaccgtaaggatggacaccaaggaagctgtgtttgggacaaaaagaaatcaagataaggtagatgcaaagtagagaaaagaactggaccctggggggaagggtggtagttgggagtgggttatatgcttctaagggcaaagaataggcagatttctgaagaggagggcccaaaaggaaatactgaggatttgtgttcaaatactacgttccctctgaatgtacaagtttttgcttttagctaacagagtacttcaaacattgataaggttaagtgttttgttggggtgggttctaatattctgggctagtgtttccttggaatagttgtggaagacactattggtatttgttgataaaaccattaccgaaacccagcttcagcactaatgcctgttattacttggaggtcaaaagggaatctgtgattgaagtgttaagctgacaaaatctgtacagaatatttaatttttccttttatttctgtgatacaaagattgtgtttcttttcatagcaacatgaaccgtgaagaccggaatgtgctgcgtatgaaagaacgggaaaggcggaatcaggaaattcagcagggcgaagacgccttcccacctagctctcctctctttgcagagccatacaaagttgtaagttgcccttctgtgaatgtttttttcccattagcatgacatttttgcttttaaaatgtttcacacttgaatgtttatattagaaaagaattactatgaataccacttaacatttttttcctgtcctttacatagaagatattttttggggataaacttttctttggagtatattatgcttacagaaaaatacacaacataggtattatggcttgaagaattttcacagcatcaacagcttcatacaactcagatcaagaaatagagcattaccagcaccctaaaagtcgttttccaacccacctcctattgctgtcctgtgttcttaaaaatgtggtctgagttggctcatacatttacctctattttcctagttgtgctactaaccatcggcgggtacttcaccattctgaattttgaattaaattagaattttgtaactcaatttgcattgtttgatttttcctaggtgttctttaagtgtgatatcaataaaaaatgaatatttcatagatgcttttgtttcttctcactgccatttgctacttagtttacaaagtttcagagattattagtatgtttgaataaatgtgtcttcagtatcagtctgatttctttttctgttgttatagacagtcatttgggtatcacttttttcattaaatttttgtttctgcttctaactataacattgagttatgaggaatataatattttcataaactgccaaaatacgaatgttagctaatctgctggactgtggaagttaattttttttttttttttttttttttttttgagacggagtcttgctctgtcgcccaggttggagtgcagtggcgcgatctgggctcactgcaagctccgcctcccgggttcacgccattctcctgcctaagcctccagagtagctgggactacaggcgcctgccaccatgcccggctaattttttgtatttttagtagagacagggtttcaccatgttagccaggatggtctcgatctcttgacctcatgatccgcccgcctcagcctcccaaagtgctgggattacaggcctgagccactgtgcccagctggaacttaattttataaaggcagattacttttctgttcttcaaaagattttttttttttttatgagaaggaatcttgttctttcgtctaggctggagtgccatgtcatgatctcggctcattgccaccactgacttctgggttcaagtgattctcctgcctcagcctctcgagtagctgggattacaggcgtgcaccaccttgccgggctagtttttttttttttttcggagatggagtcttactggagtgcaatgacgcaatctctgctcactgcaacctctgcttcccgggttcaagcgattctcctgcctcagcctcctgagtagctgggattacagacacccgccaccacgcctagcttatttttgtatttttaatagaaacggggtttcaccatgttggccaggctggtctccaactcctgatgtcaggtgatccgcccaccttggcctcccaaagtgctggaattataggtgtgagccaccatgtctggccacacccggctaacgtttgtatttttgctagaaatgggttttcaccatgttggccaggctggtctggaactcctgacatcaggtgatctgtccgtcttggcctcccaaagtgctgggattacaggtgtgagccactgcacctggcctttcaaaatactttgtgtatttaaaagacagtcttgctatgttacccatgctggagtgcagttgctcttcacaggtgaaatcatagtgcactggagcctcaaaatcttggaattgagcaaacctgcctcagctgcccagagtagctgggagtacaggcacgtgccactgtgctcggattatattttactatggttatttttaggcacttttcaatgattttttttttcactacagaaatgatatatttggagtttgcttcaaggtattaacgttaagatatgaggtaaagcctccctttgaaaagcccctttccattcgaagtttggaaaattagttcagaattatattttatttctgattatgctcattttataattttattttattttatttttttgtagactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgtaagtcacacatttagagcttttaacattgtgactacgtgaagcaattgactgatcatgaaattacgattgaacttgaacactgcttccttgccttaatagtaaggaatgtaaaagttgaaagatgaaaaaaatgtaaagacagacttgtgagttactcccaagtggatgcgtagatctgttaactcgtcctcttgggaaatggagaaaatgtcattcacagttttcaaatacttagatgacaagtcagttatagaataaaagaatgactaattgatatcttagatttctgcattttgattttatagaacaatatacctttgttgttgtttaaaaacaaaattaacttttctatgcttagattgatactaatgaatgagatgcaggtgatggtttatggttatgataaatgggacttttgggtctgtggaaatagtaatattgtatactttgaatgctatgatccttttctctggttatacttaaaggattaagacagctgctccaggttcatagtgatggtttgaaatttaaattgaattgcttaccaaagcattttggaacatttcattgtgaaatagctgaaattatatctttttttttcaagatgggtgtctcataatgttgcccaggctggtctggaactcctggcctcaagcgatcctctcatcttggccttcaaagtgctaaggttacagacatgaccatcatgcctggcccaaattttatctctctctttttttttttttgagttggagtttcgctcttgttgcccatgctagagtgcaacggcacgatttcggctcactgcaacctctacctcccaggttcaagcgattctcctgcctcagcctcccgagtagctgggattacaggcatgtgccaccatgcccggctaattttgtatttttagtagagatggggtttcaccatgttggtcaggctggtcttgaactcctgacctcacgtgatccgcccgcctcggcctcgcaaagtgctgggattacaggcgtgagccaccgcgcctggccccaaattttatcttttaatgtagtttgtgcaataaaaaaaaatttggaaagtgacgtcagtagccaaaaaattacaactcttagctcaaaatggtggaaggaagaatctgcgtaatgtaaaatgctgttttgcaaacatttaaaacatctttccagtggccttgggaaactcattttgagtggcatttgttatctgattactcctctcaagagaacagtaaaatggtaatttgttctttccttaaacaacatgatctttagagtttgacttgagttcggctctctaattcctgtttgtgccttagaataagcaatttggtttttgtgacttagaaagactatgtaaaatgtccatgttccagactagtaatctttcagtaatacttgtttaacccatttatgcttggtgttccattattggaatgctaagctcgtaggagttacttacgtcctactgctcaaggtcatcgctaaggtacgatttttcacacaaaaaatttgcagcctctggcataaatgggttaactttgtttatgtgaaatgatgtatctcagtatcatgatatgttttatatataggtaagattaaatttttagacaagctgcacacctgaaaaattacattctaaaaattatttctaatctaaaatataggataaaaaacttaaaacctttgaaaactataaagttcccccagctttgtatagtttggtgattaaaattttctggtgcttgaaaaatttatatttaaggaaattaatccaaagattctaaccagtgtactgatttagagtagtggggtcataaatacttttaataatgtttttaaatctgtgaagcaaatactaaaaatctactgataaaaatctaatgtgtgctgctttttctttcaaggcatcagcttctggtgatgtgagctgtgtggatgaaatcctaaaagtaagttttttaaaaaaaatcatttcaatttctttaattttttatgctctgccaccttcttaccctctttctacctgtatttcacaaaggatctgaagcaacagattgcttatatttgtaacttgattatgtccatcataaataatttactctcttctttgtttaccatttgccttcagagagctagttttgttctttgtgtttttttttgttgttgttgtttgtttgttttttgagatgaagtctcactctgtcgcccagcctggagtgcagtggcgcgatcttggctcactgcaacctccacctcccaggttcaagcaattctttaaccttagcctcctgagtaggtgggattacaggctcccgccatcatgcccggctgatttttgtatttttgcggagttggggtggccaggctggcctggaactcctgacctcaggtgatccacctgcttcggcctcccagagtgctgggattacaggtgtgagtcaccgcgcctggccgcgttctttgcttttaagtaaaataaattttaatcttaacacttactttgcctggaaaacattaacaagccaattataactgtactttctcatgcttaactgttaataatttgaagtgcaaaaaactcagtagttatcagtcaaaccattatgatcaaaataccttgctttggttcatcttgtacatactggtcaaatcttacagtaatagatttccttccagttttgcacatttattttttcttgatatggagtctcactctgttacccagtctggagtacagtggcattatctaggctcactgctacctctgtctcctgggttcaagcaattcttgtgcctcagcctcctgagtagctgggattacaggtgcccaccaccatgtccagctaatttttgtatttttagtagagatggggtttcaccactttgtccgggctggtcttgaacttctgacctccagttactccccactcccccatcctcctgcccggcctcccaaagtgccgggattatagcctgagccactgcacccggctgctttacacatttttttttttttttttgagccagagttttactctgtcacccaggttggagtgcagtggcgtgatctcagctcactgcaacctccgcctcacaggttcaagtgattcttctgcctcagcctcctgagtagctgggattataggcatctgccaccatgcctggctaattttttttttttttttttttttttagtagagatagggtttcaccatgttggccaggctggtctggaactcctgtctgcctgccttggcctcccaaagtgctgggattataggtatgagccaccacgcccagccaacattttgggtatttaatgacacatgtttaaaattgacacatgaccaaaaagtacattactctattggaaaaagagaaagtccagtgaattagtgaatgacaatgactactttttgcttagtagagaaaactgtcagtcacatattacttgtattttcttttttatttttttttgtgagctcctgaatttgtgtctatacttaaattcactgtgaacacctttgaaagactacctgcattggttgcttccactcttttctttcccattccttcctttagcccactataatctcccttttacctctgccattttgctgaacctgtttctctatggtcattatctttctccctccatccagaggcatcatttgagttcttttttattctttctgctatgtattttttccttctgcaaacattcttctttccttgactgtttttatgcttcattgtttttatttgccttccacctttcttgcctctctttctttgccctttttggaacccttgtgccttctcttgtttcttaagtgcaggtgcattcttctagcctctgctctttgacttgccttttccaccattcttggctttatctcttagacagctatttagtctttctgtcctacactggcctttgggttttggtttgtctcttaattgcttcttagctgagtttccatttggatttatttctctttgcctcttcagactcaacatgtctaaagccatacttatcagacttccttggattagtagtacaccgttttcccatgcttgtaactgtagaatcctaaatatctctaatttcttcctcatgttctatgtagttgcaaaactagatgtagactttaaaatttttgctttttaaatatccattcctttcttcccgtttctgccgccttgagcttcagtaattataacagaggcctcattcagcctttctgcctccagaatctccctactcatatgtcttttgcattgctacctgattctttacttcaggccctgtggtcttcataaattaatttttccctaaaaattttcagtggctctctaagattatagaaagaatagtatccaaatttaatatccgcaggccaatcctaacctctctcattactgactgaccgcttttgctaaactggtttccctaagccacatacattctttctcttttacctccttaaataaagtaagcttggaatgtatttctcctccctcttcagttatatatagattttttttccctgtaatcccaatgaaatacttcttcccccgtatcagattgtgagaccacagtgatagctctttcatttgaatctcattcatttcttagttgccatgtatataaaaagtgtaagggagcataaatattttcctctgaatcctcaacagttcatagaattattagtatgtggaagattttcttacatttaatgatctctttaatgttattgacatccatattttatatgtgcaggggcttggcacttggcctttagttaataggtgctcagtcattcgatgataattggagaattaaatcaaattttcagttgagagttttgatatttgagatataaaatgccaatgttaaaaacctgagtttatgaatttttgtttccttttccctttcctgtctgtagtatgcaaggaacttcaggtgtgtgttcccttcatgttttctttgtatttgtagtcatatcatttttaggaaccccatcatgaacttaaaaaaaaattcactctaaatgtatatttattgaaaaaatgatttattcaaggcatgctcattaagcacctactttgtgtcaaccactgggaatacagtggtcataatgttatgcctttgagctgatattctagagctggatgtaggaagcaatctattacataatattatttcaggaagtgaaattctattaaaaatcaaagcattttaagggaataaagagcaattatgtgcaggtggctgttttaagaggttcaagtagtaatatatcaagtgcccttgtctcttccttctgtcattctgttgcccaaagctaaacattaactaggacgtagactgatttgtctttgtcacttaataaaatactgtggacatcattacatatcaacagttaaatttctcattttaatgtctggtgttctattttatagatgtctggtaatttatttaatcagtactgtgttggtgtcaacctaaataacagaggctctctgaaagaaaagatgatgggaatagagcattgcagtggaaatacatgtgccatagtagtctatggtcatattcaaagaggtaaagagagacaaaggtttttgaaggaaaaaatgaggaagattacataattgtttttgaaataattatccttggctacaaagatcactagtaaggatgacaccagtctgaggtcggacaagctggacagatgtccttgtggaaatatttttttggtttaaggttttgatgacctttgtgcaaggttgtggtttttgtagatttttttgtttatcaggcatacaagcatgagaagcctttcttcatggtctttcccagctcagggtgttttgggtttttttttgtttgtttttttgtttttttttaaatatataaacattagtgactccattttgattctcacaactttcacattgactacctaggttgtttcagtttttgaagtgtgagccccttatacgtatatctttacaaaactgtgtggatattgctatgggataaattcctaggtgttacaccactgttaatttgttgcatttccttaatttacctgatggcttactttgaactaaatgccagaaataatatactctctccttattctgatacttctgtctccttggcttatctaacatacacattgtaatcttaccagacctcacccagacatatttggcattaagattaggcagaaggcattgaatgaaatcaaacttagggtcttgcttttctgttttcctcctcatgtgcttttgaaatttctcttctgatttcttcccctgacaaaatttttctacgagtatatataggctctatagccagacttttgaggatgaaatataatgttcattatttactaagtgtatggccttgaataaataacttttgtgcttcagtttcatcctaaatagaggtaggataataatggtatctacctcataatgtcattgtgagtactaaatgagtaataaacatgtaaaacacttagcacagtgtctggcccattcaaggtacacagtaaatgttagctgttttccttatcattgtcccttcctcccactctcctagcaagctcttcctgattagcgttttattatgtgccttgtatttgattacaggctgatttctgtaactattcacaggtttcataatttgaattgtaaactcctcaaagccagggagcatttattaatcttcttattacctacaccatagtgcctagcacacaattgtgcttaatatttattgactaagtatgtagaattttggaggagctgtcatgaaaccagtatttataaatacaaatctggtttttagctgtataatttttatccttgacctggttgaaaacaaactgtaataattacatttcaggagatgacgcattcatggcctccccctctaacggctattcatacaccatgcaaaacagaaccttccaaatttccttttccaactaaggtaagtaaataaaatgtatctttcataatgtaagaaaactctaaatggcttgactaaaatcatatggattaaaaattgtcttgccattcctattctagtgggagacagacagtaaataagtgaataaatagataaattcagatagtgacaactgttatgaagataattagcagggtaatggaactgagagcatcttggatcaagaggtattaagaaagctttgaaggcaatatgcgagagagatttaaaagacattaatacagccggacccggtggctcactcctgtaatcccagcactttggaaggctgagccaagagactctcttgaggccaggagtttgcgaccagcctggtcaacatagccagaccctgtctctacccaaaattggaaggaaaaaaaaaaaaaaaaaaaaaaacaagcttggcatagtggcacaggcccgtggtcccagttactcgggaggctgagatgggaggatcacttgagcctgggaggtcaaggctgcagtgagctgtgattgcaccacagcacgccagcctgggaaacagagcaaaattctatcttaaaaaaaaaaaaaaaagacagtggtatttattgcagactattatggtattgtaggccagaggtggtaagggcttctcaaactgttgttttaagaacctgtttccataagacatagcaaccatacttgtcccgtggaaagaggttcctcagataacagttccaaggttgtttaaaatcagcagattgacttttttttaaacttatacttaacagtattaatttacacttaaaacaaataatacagaaatacattctccttgtgaaagttttaccagtccccctaataatagcctttccccaattccgtccccttcatcccaacagagctcctttcctaagtacctttgcaagtcttttttatattcatgtaatacatatataatcattacatgtaagcattttcttatttatttctacgcaaatatattgttctgtatctttcatcagtcagcagtaggtcttggggacctgtccatgttactgcatgtagaggtatttcgtttctttttattgcatctttagtgttaatatatcctagtttatttagccatttctctttggtatttaagctgatagcaagttttcatttctataaatgtttcttcagttggtatctttgttggtgccttctgtgtgcatgtgattttctttagggtagaaagcaaaaagtagaattgctgagtgttgagagtatatatttaatacatacactcacaaattccttccatagttctattacaggatttgtaccagccagtattcccacttgtattacctgttgtttcacacatgcacaccaccatttgatattattaaacagcagtgttttgagtaaaaatggcattccatttgcttgattgctagtgaggttcatcatctttacatatttgttatccatttggtttctttgtgggtaaatttgcttattctcactgtcctttgggttgcattttttacctattgagttttaggtggtcttccttttttgttttgtgttgttttgtttgaattgtggattctaataatttcttatacatgctgaaaatttatctaccagttagattcttgtctttttattgtctaaagtttttaatttttgatgaataaaatatatctttctcttcctttatagtttttgcttttaatgtcttgttaaagaagacttttctttctctaggatcataaacataccctcttatttttattttaatgtggtttttagttttattttttatgtttacctttgtgaatgatgtcaggtagatttaaaaattttctgtctatatgtgtgccatatcactcttaccttttatatctttgtttacatatacaaaatgcaccggtatttatttatttatttatttatttatttatttttctgagatggagtctccctttgtcacccaggctggagtgcaatggtgtgatcttggctcactgcaacctctgcctcttgggttcaagcgattctcctgtctcagcctcccgagtagctgggactacaggtgcccgccaccacgcccagctgatttttgtatttttagtagagacagggtttcaccatgttggccaggctggtctgaactcctgacgtcaggtgatccacccgccttggcctcccaaagtgctaggattacaggtgtgagccaacgcacctggccaatgcactgttatttaatgtgcagtttgagttttgttttttgttagtttgttttgagatggagtcttgctgtgtcacctggtgcgatctcgactcactgcaacctccgcctcctgggttcaagcgattttcctgcctcatcttcttgagtagctgagattacaggcacacgccaccacgcctggctaattttttgtatttttagtggagacagggtttcaccatgttgaccaggctggtctcgaactcctgacctcaggttatccacttgcctttgcctcccaaagtgctgggattaacaggcgtgagccaccgcgcccagcctgcagtttgagttttgatagatatgtgcacctgtataaccaccaccataattaggaattagaacatttccatcacccccaaatttcttcatgttcctttgtagtctccctcgcctccaccactgtccctatgcaatttctgatctattttatgtcactctagataagttttgctttttctagaatttcatgtaaatggaatcagtacatcatgtgcttcttttatatatttactttcttttgctcagtatttagttttgtaattcttccatgttcttgattatatccatggtttctctttttctttttcttttttttgagacagagtctcagtctgttgcccaggccagagtgcagtggcatgatctcggctcactgcaacctccgcctcctgggttcaagcgattctcctgcctcagcctcctaagtagctgggattacaggcatgcaccaccacgcctggctgatttttgtatttttagtagagacggggtttcatcatgctggtcaggctggtctcaaactcccgacctcgtgatccacctgcgttagcctcccaaagtgctgggatcacaggcgtgagccaccacgcctggcccagtttttctttttttattcccaatcagtattttattatatggaaacaccaaaatttgcttcctgttgatgagcatttgggttatttccagatttagactgttaagaataaagcatctataaacattcatgttttcttttatcctgggtaaatactgggtcacatagtaaaaagtagaattgctggttcatagggtaagtgcatgttaaattttacttatttattttattttaattttttagagactgaggtcttgcctaggctggtcttacctaggctggagtacagtggtgtgatcatatagctcactatacccttgaactcctgagcactagcaatcctctcatttcagcctcttgactaccacgcactacaggtgcttaccaccatgccagacttacatagagacgggggtctcactctactgctcaggctggtctcaaactcctgacttcaagccatccttctgtttcagtgtcccaagcacaagctactgtgcccaccactaaatttatagtaaactgaaaactaactcactcactcactgactccctccctccttccttccttgctttctctctctctctctctctctctcctttctttcctttctttctttgcgacagggtctcactttgtcatccaggccgcagtgcagtggcgggatcatggctcattgcagcctcgacctcccaggctcaagtgatcctcctgcctcagcctcctgagtagcgggaactacaggcatgcaccaccatgcctggctgactttaaaaaattattattatttttttgagacaaagttttgctctgttgcccaggctggagtgcagtggtgcaatcttggcccactgcagcctctgcctaccaggttcaagtgattctcctgcctcagcctcctgagtagctgggactacaggtacgcaccaccacgcccggctacttttttgtgtttttagtagaggcgaggtttcaccatgttggccaggatggtctcaatctccttacctcctaatctgcccacctcggcctcccaaagtgctgggattacagatgtgagccactgtgcccggcccccattctttttaattactaaggtaatattcagttatgtggcatcataatttacctaattatctactaatggacatttgggttgcttctagtttttggttttttttttttttttttgagatggagtctcgctctgccgccagactggagtgcagtggcgtgatcttggctcattgcaacctccacctcctggtttcaagcaattctcctgcttcagcctcccaagtagctgggactacaggcacgtgccaccacgcctagctaatttttgtatttttagtagagacagggtttcaccatgttggccaggatggtcttgatctcttgacctcgtgagccgcctgcctcggcctcccaaagtgctgggattacaggcatgaaccactgagcccaacctcatttttggttattaaaaataaagctgatgtgaatatttgtgtataaatctttgtataaatgtatacttttatttctttctttttaagacaaggtctctgttgtccaggctagagtgcagtggcatgatcatggctcattgcactcacgaactcccggactcaagcagtctctcacctcagcctcccaagtagctgggactacaggtgcatgccactatgtctggctgatttttgtatttttttgtagagacgaggttttgccacattgctcaggctgctcttgaactcctgggctcaagcggtcctcctgccttggcctcttaaagtgctgagattacaggcgtgagccactacatctggcctgtttttatgtctgtattataaatgcctattagtggggtggttaggtatatggtaggtgtctatgcctcacacctgtagtcctagtactttgagaggttgatgtgggaggatcacttgagtccaggagtttgagaccagtgtaggcaacataatgagactctgtctccacaaaaaattaaaaaaaaaattacccaggcatggtggcacaggcctgtagtctcagccactcaggatgctaagctgggaggattgcttgactgcagctggttgaggctgcagtgagcagagatcatgccactgctctctagcctgggtcacagagactgaccctctctgggggggaaagaaaaaattagaaaacaactgtcatgctgggcgcagtggctcacgcctgtaatcccagcactttgggaggccaaggtgggtggatcacctgaggttgggatttgagaccagcctgaccaacatggagaaaccccatctctacaaaaaatacaaaattagccaggcatggtggcgcatgcctataatcccaggtacttggaggctaaggcaggagaatcacttgaagctgggaggtggaggttgcagtgagccgagatcgtgtcattgcactgcagcctgggcaacaagagcgaaactgtctcaaaaaaaaaaaaagaaaaaaaaaagaaaacaactgtcatactattttccaaagtggttgaaccattttttattcctgccaatggtatatgagagttccacttgttccatgtccttactaacacttgatattgtcagtcttttaaaactttagccttctagcagtattatagtggtacctcattgtgatttcaatttacatttctctagagacagagtatcttgagcatcttttcatgtactgatttgccatttgcttatcttctttggtgcagtgtctgaatattttgcccatctttggtgcagtgtctgaatattttgcccatttttaaatgggctaagattctttttttttttttttgtgacagagtctcgctctgtcgctcaggctagagtgcagtggcgcgatctcggctcactgcaagctccgcctcccgagttcacaccattctcctgcctcggcctctcgagtagctgggactgcaggcgcctgccaccatgcctgactaattttttgtatttttagtagagacgggatttcaccgtgttagtcaggatggtctcgatctcctgaccttatgatctgcccaccccggcctcccaaagtgctgggattataggcgtgagccactgcgcccggcctgaaatgggctaagattcttactgccattatcatatatgtgatttgaaaattttgttttcttgctctgtggactaccttttcattctcttaatagtgtccctctaagaacacatgttaacttttataaagtccacttcttcagtgttttcttttacgggtcatgattttggtgtctatgaaatctttgcctggctgggtgaggtggctcttgcctgtaatcctagcactttgggaggccaaggtgggtagatcacttgaggtcaggagtgtgagactagcctggtcaacaaggcaagaccccacctctacaaaaaatgtaaatattagccaggcgtggtggcatgacctatagtcccagctacttgggaggatgaggtgggggatcatttgagcttgggaggttgaggctgcagtgagtcatgattatgccactgcactccagcctaggtgacagagtgagaccttgtctcaaaaaaaaaaaaaaaaaatgtttgcccgctgggctggtggctcacacctgtaatcccagcactttgggaggctgaggtgggcagatcacttgaggtcaggagttcgagaccagcctggccaacatggtgaaactccgactccactaaaaatataaaaattagccagacatggtggcgggcatctgtaatcccagctactcgggagactgaggcaggggaatcacatgaactcaggaggcggaggttgcagtgagccaagattgcgccagtgcactccagcctgggcaacagagcaagactccatctgaaaaaaaagaaaaaaagaaaaagaaaaatctttgcctaacccaaatcctcctatgttgtttcctagactttttttttttcttttaaataagagaccaggtctctctgtgttgccctggctagtcttgaacttgtgggctcaggtgaccatcccacctcctctgcttcctgcatagctgggactctgctctcagttatcctaggctttcttttctgtttttgaaagagtctcactctgtcacccaggctggagtgcagtggtgtgatcttggctcactgcaacatctgactcctgggctcaagcgattctcatgccttggtctcccgaatagctggaattacaagtgcatgccaccacacccggctaatttttgtatttctagtagagatggggttttgccatgttgcccagcctggtctcgaactcctaagcttaaatgatccacctgccttggcctcccaaggtgctacagttataagcatgagccactgtgcccagcctttcctagtttttttatagttttaggttttacatttagatctatgatttatcttaagctaatttttctatattgttacaatatatggaatgaagttttatcctcttgtatgtacatatccaattagcatctttatttaaaagccttctctttccattgaattgcctttgcagttgtagttgactctgtatgtgtgatgcatttctgacattttatgtttcattaacctgtttgtctgtcatggtgccaatatgagcctgtcttgatgatttgactttgagacttactgtaaagtcactacaatgtaaatcctcaaattatattagtgtttttcaaagtagatttgacttttctaggctctttgcattttcataagaattttaggctgggcacagtggctcacacctgtaatcccagcaatttgggaggccgaggtgggtggatcacctaaggaggagtttgagtctagcctggccaacatggtgaaaccccgtctctactaaaaacacaaaaattagttgggcacggggcatggtggtgcacacctgtaatcccagctactcaggaggctgaggcaggagtctctgggaggcagaggttgcagtcagctaagatgatgccattgcgtgtgctccagcctgcgtgacagagcaagactctgtctcaaaaaaaaaaaaaaacaaacaaacaacaccttgtcaatttcaacataaaagtcttgtgggattttgacagggattgtgttggatctatagatcaatttggggagaattgacgtcttagcaatattgaatcttctgacccatgagtccttatttctctctattttggtctaatttaatttctttcagtattgttttgtagttttcaatatgtagattttggacatcttttgttagagttatctttttgttttttgaaagagtgtcactctgtcacccaggctggagtacagtggtgctcagtgcaacctccgcctcctgggttcgagcgattctcctgcctcagcctcccaggtagctgggattacaggcgcccaccatgatgcccagttaatttttatatttttagtagagacgaggttttaccatgttgacgagggtggtctctaactcctgacctcaactgatccacctgcctcggcctcccaaagtgctgggattacaggcatgagccactgtgcctggctgatttttttgtgtgtgtgtgagacagagtcttgctctgtcacccaggctggagtgcagtggcacgatcttggctcactgtagcctcagccttctaagtaggtgggattacagaccagtgccaccacacccagctaatctttatactcttagtaaagatggcttttcaccatgttggccaggatagtctcgaactcctggcctcaagtggtctgcccaccttggcctcccaaagtgctgggattacaggcatgagccacagtacccggccctgtttgatttttttagtgctattataaatggaattttataaaaatttcagtatttgatttttccttgctaatttatagaaatacatttcatggctggatcgtgcgctcatgcctgtaatcccagcactttgggaggctgaaggaggatcacctgaggtcgggagttcaagaccagcctggccaagatggtttagtagaaaccccatctctgctaaaaaaatacaaaaattagctgtgtgcggtggcacacacctgtaatccaagctacttgggaggctgaggcaagaggattccttgaacctgggaggtggaggttgcagtgagccgagattgcgccattgcactccagcctgggcgacaaggtgagtctctgtctcaaaaaaaaaaaaaaaaaaaaaaaagaaaagaaaagaaaaagaaatacctttcatgtataattttatgtttcatcttgtaattttgctaaatttacttaatagcatttttgtagataccatatatttcctagacaatcatttcacctgtgaataaagattttataatgtttgtttcaaatggatgccttattttatattcttgctttattgcactaggtagaatctctagtatgatgttgaatgccagtagtgagattagacattcttgccttattttttatcatagaggagaaagtatccagtctttcattattaagtgtgatgttagctgcaggctttttgtggatgtcatttattacattgaggaaattcttctattcctctttgcctaagagttctcattaggaatgaattttgaattttgttgaatattttttaaatctattggaatgatcataagattttcctgttttgatttgtattaatatggtgaataacattggttaaatttggctgggcgtggtggctcacacctgtaatcccagcactttgggaggctgaggcaggcggatcacctgaggtcaggagttcgagatcagcctgaccaacatggagaaaccctgtctctactaaaaatacaaaattagctgggcgcgtggcacatggctgtaatcccagctactcgggaggctgaggcaggagaatcgcttgaacccaggaggtggaggttgcggtgagccaagatcaccccattgcactccagcctgggcaacaagagcgaaactctatctcaaaaaaacaaaaaaaaacaaaaaacgttggttaaattttaaatgttaaatcaatattacattcctgatgtaaactctacttggtcatgatgtatttttttatagtgctgaatttgattttaaaagttttttctaatttttgcgtctgtattcctgggctatcttggtctgtattgttcccttcttaaatctgtaaccataacaggtctgttgtctgatgcacacagcaagtcaataacagagacactgggttgctgcagagaaggagtttaattatagggcctccaaacgaagagatgagaggaaacctcaaatctgtcttcccaaggagttgagaccatggcttttaaggattttggagtgggctgaagtattaagatcattgatttgtcaaagaatgctaggtgaaattatgggataggaagatgtacaagcagtattctcatgctgattctgttcccctgtggagatctttaaactggttggcttcagctgttccactgtgcttaagcaactcttgattttaaaaaaaaaaatttatggaaacagggtctcatgatgttgcccacgctggtctcaaactcctgggctaaagcagtcctcctgtctaagcctctcaaagcactgggttgataagcatgagctattgagactgtcctgcttaagtgatnnnnnnnnnnnnnnnnnnnnttcttctttgtcgtgttttgttgtttgggtgttaggtgcgtgtttgtgtgtgtgtgtgatttggtttggtctgtggtttctgtgttgggtgtttgtgttgttggtgttgttggtgttttgtgttatttgtgtgtgtgtgtcggaggcgagaaaaagaggagacaaagagggaaggaatatattttttttctagtttttagaaaaacaggggcgattgttgtcctagtgtgccctttctgggctttccgcttggtggctggtgggagagttgttgccggtctggtcttggatagatgccagctttcgagcgatggtccctgggaacctaactgtgtgttcagctgttccctggctaacacttggatgtggcaagagagattgtggaccaggtttcagatgtgcccacgcgggtccaaactgctgggctaaagcatcctctggtctaagcctttcaaagcactgggttgataagcatgagctattgaagactgtcctgcttaagtgattcttgttgttgttttgtttttttttttttttgagacagcatcttactctggtcacccaggctagagtgcagtggcatgatatcagctcattgcaacctccgcttcccaagctcaagtgattctccctgtttcagcctcctgagtagctgggattacaggtgcccgccaccacacccagataattttttagtagagacagggtttcccagtgttgcccaggctggtcctgaactcgtgatccacctgcctcaccctcccaaagtactggggttacagatgtgagccaccacacctggccttaagcaattcttaaacaaaagccttaagtttctaatgtcagaaattctatctataggaacaatggggatgctgatggtcagtatctagtgttagtgacttcctgttacaaagaagtgagtcagccgggcgtagtggctcacttctgtaatcccagcactctgggattacagggtcaggagttcaagaccagcctggccaatatggtgaaacccccatctctactaaaaatacaaaaattagccgagcgtggtggtgggtgcttgtagtcccagctacccaggaggctgaggcaggagaatcgcttgaacctgggaggtggaggttgcagtgatccgagatcgtaccactgcactccagcctgagtgacagaacgagactccatctcaaaaaaaaaaaaaaaaacccaaaaaaaagaagtgggtcaaagtgcagtataattaatgcttaattataattatatttctgtccagaattctgtttaaccctgtgagggtggtttcatatccttgccttgttttggtatctgagtaatgatggccttatagaatggattgggaaataattgcttccccttccattttctggaatagtgtgtatagaaatggtattttttcttttttcttttttcttttgagacagtcttgctctgtcacccaggctggagtgcagtggtgtgatctcggctcactgcaagctccgcctcccgggttcatgccattctcctgcctcagcctcctgagtagctgggactacaggcatgcgccaccacgcccagctaattttttgtatttttagtagagacagggtttcactgtgttagccaggatggtctagaccatctcctgacctcgtgatccgcctgcctcggcctcccaaagtgctgggattacaggcatgagccaccgtgcctggccagaaatggtatttttttttaagtgtttgttagaatttatctctggttatgagctttctttgtaagatggtttttaagcaaaaattagacttctttagtagctatagggctactcatgttatctatttctccttgaatgatctttcgttgtttatatctttcaaggaatttgtccattttatctatgaattaccaaagttaacaaattgctgtaagttttttataatattctcttatacatataacatattctattatgatagcacttctcttattccctattccggtaatttgttttcttgtctttttcttgagtgtcctggctagagattgtcagttttcttgatagctgttttttctttctctgttgtttttgttttttattgcactgatttccaccctgatctttcacttttctgctttcttatggtttaatttgttcttcttttttttttttgaaatggagtcttgctctgtctcccaggctggagtgcagtggcgtgatctcggctcactgcaacctccaccttccgggttcaagcgattctcctgcctcagcctcctgagtagctgggattacaggcacatgccaccatgcctggctaatttttgtatttttattagagacggggtttcaccatgttggtcaggctggtctcgaactcctgacctcatgatctgcccgcctcagcctcccaaaatgctgggattacaggcgtgagccgctgcgcccggcttgctcatctttttaacagatttcttgaggtggaagctaaggtcatttaattgagatttttcttattttcttattttatttatttatttatttttagatggagtcttgctccgttgcccaggctggagtgcagtggtgagatctcgaatcattgtaacctccacctcaccggttcaaaggattctcctgcctcaggctcccaagtagctgggattacaagcatacactaccatgcctgactaatttttgtatttttagtagagactgggtttcaccatgttggtcaggctggtctcaaactcctggactcaagcgatccacccacctcggtgtcccaaagtgctgggattacaggggtgagcctccgtgtctggcctaatttcttgttttttggattatatctaactgtgttggttcccaaatatttggagattttctgcatattttctgttttgatttgtgatttaattccattgtggtcatgaagcatacattgtatgagattgagacttatttcatgttccagattattgtctttttttgctaatgttttgtgtacacttgaaaagaatgtgtattccagccagtgtggtggcacacgcttgtaatcccaacactttagaaggctgaggtgggaggatccctggaggccagaagtttgagaccagcctgagcaacagccagacctcatgtctgccaaaaatttaaaaatcagccgggcacggtggtgggcacctgcagttgcaactactcaggaggctgaaacaagaggattgcctgagcacaagaggtcaaggctacagtgagccatgatcatgccactgtactccagcctgggtgacagagaaagaccctttctcaaaaagaagcgtattctgctgttgttgagtggagtgtcctgttaggtcaagttggcttatagtgttatactaatcttctatatccttactcattttaattctatcaattatctattattgagagttaactccaactataattttggatttgtatatatgttcttgctttgtttcttcatgctttctcaaactctgtttttaggtgcataaacatttaggattgttacctcttaatgagttgagtctttattactatgaaacaaccccttttaaatcttataatattctttgctgtaaaatttacttttatattaatatgatcagctccagctttcttttatttaatgttagcatggtatagttttttccaaccttttgcttttaacctgtttatgttcttatacttaaaatgcatttcttgtaggtagtatatgattttgttgtgctttttaaatataatctgacactctgctctttaattagggtgttcagaccacttacatttaatgtgattatttatacagttgggcttaaatctactatcttgctttttgatttctctgtctcatcagcccttttgtgtgtgtgtgtgtgtgtgtgtgtgtgtgttgtgtgtgtgtcagcctctatcttcaagtgattttataccatccttttctgctgtataagaccctattgtcattatacttgcatttctcccgtcgtagaatctgtatgattgttgtttatgttttacttccacataaagtataaatggcacaatattgttactattttttatttaaacaatatattatcttttaggctgggcgcaatggctcacacctataatcctagcactttgggagtccgaggaaggaggatcacttgagtccaggagtttgagaccagccttggcaacatagtgagaccctgtctctacaaaaaataaaaaaattacctgagtgtggtgatacgtacctgtggtcccagctgctcaggaggccgaggtgggaaaatagcttgagccccggaggtcttggctgcagtgagccatcatcactccactgcactccagtctgggtggtagtgagaccctgtctcaaaataagtaaacacagtttgttatctttacttttttttgagacagagtattgctctgtcacccaggctggagtgcagtggtgcaatcttggctcactgcaacctccacctccctggttcaagcaattctgcctcagtctctggagtagctgggattacaagtgcctgccaccacgccctgctaaatgtttttttttttttttttttgtatttttagtagagacaatctcgaactcctgacgtcaggtgatccgccaacctccacctcccaaagtgctgggattacaggtgtgagccaccgcacctggcccattttactattatctggaggactttctttaatatttcttttagtactttgaaaaaatctttattttgcctttccatttttatttttaaagtgtttttgccagctatagaattctagattgaggaccttgcccccttgcaactatctgccagcttgcattgtttttgatatgtacatcgttgtcattcttttttttgtatgtaaaatgtccttttttttttttggcggtctttaagtttttttttaatcattgcttttaatctgttcagttatgatacgttctcctgtagttctctttatctttctcgtgcttgaggtttgttcagcttcttgaaattttggtcttatagtttccatcaaatttgggaaacttgctattactcaatttttttttttaccctcttctccccttttgtcgtcgtcttcaaggactccaattacatgtatattaggccccttaaagttgtcccagagttcactgatgttctgttctttctttttttttctttttttttgtgggaggtcttatactgtattgctccattttgcatggtttgtattgctgtgtctttaggttcactaatctgttgttctgcgatgtctaatctgctgttagacatttaatacatatttttatgttagacatgttatcaataaaaatttgatagtgcttatatatttattaattaaacagatatttattaacttcttactatgttcctggcatgagatttgacaacttgttctttattaatgacaaagatttttagtagaaagatgagggtaaaagactagttgtactagtctcaaaagatatcagagtgtcttttgaagcaaacagagaatgtgataccaagaactgtatggtgatgtcggggagtgtttttataagatgaagatattttgttatttttataatgctgatggcttagtagaaagggaaaaacaaatgatccatgggaaagagaagaggtaaccttaggaaatcttcacaagagtgattgagattcagtgcccaagtagaggacagtagctttagaatagaacaccactacttcattggcaccagagggaagcagagaatatgggtatagttggggatagcttgggagattttccagtgatagtttggagaatattaaagattttgattgcctttgcacttactcaccatgtttggaacaacctccagcagtgttcttgacactggagatagaacgctgtacaatttaaatgttcttgctctaagatgggtatttaaagaacataggaaaacgctgtgccaatgcttagaatagttctggcacaaagtagctgttcaatgaatgtttgttaactgaatttggatgtatatactcaagtaacagtgtttagattttggtgtttgtgagacacctcagctactgactgactgttgctaaggtgggttgcttcttaccgatagcttatctcattctccaaatttaagtgggtacaacttcatgtgtaatatacctaaaagctctgtgtgatactttaataggtacttactctccatgtgcactaactatatgtaccaagtccaatgagaggacagagaagggagaaagttgttatacctagggaatttggggttagcatcctacaggaggtgacaccaattagagtttgaaggagaagtataggagtgctagcaagatgtgggttgataaggaacacatcagaaagcacttcacaccattgacgagtctgaaagagcagttcacaggcggcaaatggtgctaagtttaggatcatattggggagctggtttagtatattcatctctctccttgaattgatcccatttaaaaacaaaaacaattcaatccctctgttccatgtgattcatcagtcactccttttgtttagaataaaacttactaaagattgattcatatttgctatttttccctggtattttgctgggtgttataaggaagtgtgaaacaagaaatgtgttttgcctgtaccaaacatttggttgtagaaatcaataatacaaaagaaagcaataggaattatttattagtgtttaattggatgtgtagttgtgtgcatcacacttagacgtaagttgtcttctctttgtattctgttctttacctagaacctctttacctaggtgcttcacaaatcttatcttctcctccccatctccttccctctttaccttccccttccacctgttgatacagtagctgctttaacaggaattacaaaaaggaacccaggacaaggcaagagtaatggcaaaagtgcagtttatgcacagttgcagtgttggaacaatgatgttgaagccagaaatgtctggaactgtgaatatcttcaactcagttatagaatcatgctctgtacaatatattctgtaatgaaatgaggagtgaatctgaatattttttacactaacatagaaattgtttcatgatatcagttatcccacttaaaaatgagttagacacctctctctttttaatctctctatctcacacacagatacacacacacacacgcacaccaccacgaaatatgctatatgtatcttttcgtaatgtatttttaaaaaataattaaacccccttctctcttcagagtaaagatgatgttggcctattgtggtggctcatgcctgtaatcccagcacctggggaggctgaggcgggtggatcacctgagatcaggagttcaagaccagcctggccaccatggcggccccatctctactaaaaatacagaaattagctgggcgtggtggcatgcgcctataatcccagctacttgggaggctgagctggagagtcatttgagcccaagagatggaggttgcagtgagcagagatcatgccattgcactccagcctgagcaacaagtatgaaacatcctacaggagtgtgaaactccatctcaaaaaaaaaaaaaaaaaagatgatgttttaacaatgaatgaagtaaccgcttccctaaaagatatgcttgagcggctgggtgcggtgcctcatgcttataatcccagcactttgagaggccaaggtgggtggatcacgaggtcaggagttcgagaccagcgtggccaacacagtgaaaccctgtctctactaaaaatataaaaattaactgggcgtggtggcaggtgcctgtaatcccagctacttggaaggctgaggcaggagaatcgcttgaacctgggagctggaggtggcagagagccgaaatcgcaccactgcactccagtctgggtgacagagctagattccgtctcaaaaaaaaaaaaaaatatatatatatatatatgtatatatatagtgtatagattatatatgagtgtgtgtgtatatacatatacatacattcaagctaggaaaataacaataatattgtcattgtttatgtatttttagttttttgttaccaaaaaaccacagttctaatatgaatactgtaaagagctgaaaaaaaatttctaatcagtggtttgaacctatttgctaaaaataataaaatgcatccttctaatttatttttctaaatgatttacaacaaggaacatggaaatctaattcaacttcaatagaattctttacataattaatgtataggactgaaattttgttactgtgatttaataagcatggtatttcttccatgagtataactatatctttgtggcatccagtgaaaccagatatcaaaaataagtccatcttagcgtcatacctttgaagcattatatttttgtgtgtaagaaaggttttgttgtcattcataaatatatttaaaaattactctaaaaatggtatttaatttttgttatgcttttgaaattgcagtattttaatcttatacataagtagtaatgcatattctatacatattttggagatacaaatggaaaaatttcttagtaatggagtatatgattaaaaaaaaaaaagctggaagacaaacttgtttaagctgtagttatctcctactggtactactccagtaacctcattttgtatccttaactccattctagctttcttaaaactgttctccacttagtaggcgagatgatcctcacaatgtgcagatgtagttgtgtaactctcctacttaataagctgcacacacacaggtctttaatatggtctataagtctgtaaactgtgtgatctagcattttaggtcttcagtctcatatctcaccactcttccacctttactttttcctctctgtgggctgcctttaagttccttgtacaagccatgctcttccctttaagctggactttacacgttttctctctccctatggcacttagcctatctcttcctttcccagtttatttcctatatatccttcaaatttcaatctgaatggcagttcctcagggaagcctttgctcatcttcctggctagatcatacacacacacacacatatgcacacatgcatacaagcacacaggtacacatgcatgcacaattacaaactcaatataattatgtgtatttgcccttcattgtgtttattacagttgccattttactttgatttgcgtgagtacttgcaaaggtagtaattattgacattcaaataggtgttaagctccatgggggcagggcccttgtcagtttttgcttatcattgttttctcagtactttgatacatgagtaagtgtgttgccagagagtttgggtttcatccttaggaaaaaacaaagagtcattgggaagttctatgaaaaataggagagcagtgatgacgcatactaagacttgggctgtagaagggtaaacttctacaggctgtagaagggaggctatagctgagtaaaggagataaactagagctaggaagatccattagaaggccattgtaggtaaacaagatgaagacctgaagtctttccggttcagatggtctcgcctttggtggatgtttaagagacagaatccagtagtatttgtggacctgctgactattgtcagatataagacaaataaatcagattatttggaatatggggctattaacttttaggccatttaccaagtaaatgaatataagacaataaacaatttgagggggtaaaggaatcttcattttattttatttttattatttgtacagataggatcttggtatgttgcccagtctggtcttgaactcctggcctcaagctatcctcattgcttagcctcccaaagtattgggattacctgcataagccaccacacccatcctggaatcttcattttaaacaaaagtcacaaaagtgacctcttgcccactgctctatatacagttttttaacagcagtactgagatgtgattcacttaccatgtaattcacctacttcaagtgtagagttcagtagttttgagtttatttataaatcatcaactcaaaaagaaactgtaccctttagctgttatccctctttccctctaccttcctagccttaagcaaccactaatctactctatctctatagatctctctgttctaaacattttatataaatagtataatgtagtatgtggtcttttgtgactatattctttcacttaacattatgtttttaagattcatctaagttgtagcatgtaacagtacttcattcctttttatggccaaataatattccagtgtataagtatatatcacattttgtttatacattcatcagctgatggacatttgagttgtttccactttttggctgttatgaataatattgctataaacacttatgtagaagtgtttgtgtggacatatgtttacattttgtttggttgtgtacctaagagtggaatggctgggtcatgtggtaactctgtgtttacttatttgaggaactgccagaatgtttccaaagcagctgtaccatttcgcattcttaccagggttctgatttcttcacatacttgtcaacacttgttacatctgtctttttgattctagtcatcctagtggttgagaagtggtatctcattgtagatttgtatttccgtgatgacaggtgtgagaaatcttttcatctgcttattggccatttatatgtcttccttgggtaaatgtttattcaggcccttttcctgttttttaattggcttgtcttgttattgaattgtaagagctctttgtagtatattgtggataccagccccttatcagatacatcatttgcaaatattttctcctattctgtgagttgtcttttcacttttttgataacaatctttgaagcacagaagttcttaattttgattaagtcaagtttatcttgccaaatcccaggtcatttagatttggcattgtgtttttttctaaagattttatagctctagcttttacatttataggtctttgatccttcttgagttttttgttttgttttgttttgtttttaatatgatgtgatataaaggcccagctttattttgcccatggatattcagtttgtccagcaccgttgttaaaaagactattctttcccatataatggtcttggcatcctcttggaaaatcagttgagtgtagaaataggtttttaatgttttttaaccgcaaaactatattttagctttctaactatttggattgttctttcacagacaattctgtaactaaaggaagattatgcttatttttaagtaagcttttaggaatatttgtataattttagtgctacatcttgtatccagatttaattttgagaaatgcatagtttgcacatatggaacagctgttctggtcatgaaaattgagtttggaaagccatgtttcactaagggtgacattctggcttctttctattggtgcttcctgagtgctggacactatgctgttatagggcttacatggaagtaaatgaccatctcttcctcacgttgctaatgtatataaaatattgggagcagggagaaggagggagtaaaatgacatggaaatatccatatgggatttttttagtccataaaagtggtatactttttttttttttttttttgagatggagtctcgccctgttgccaggctggagtgcagtggcgcgatctcggctcactgcaacctccgcctcccagggttcaagtgattctcctgcctcagcctcccgagtagctgggactacaggtgcacgccaccacgcccaactaatttttgtatttttcgtagagacggggtttcaccatgttggccaggatggtcttgatctcctgacctcatgatccgccagcctcggcctcccaaaaaagtggtatacttctaatggataaaggttatacagctatcttcacctggtacactgtcttcggtattacctttagttttaaatgaagtgttttcttaagaccaagaattttaaattgaaattagttattttataaagggctctaaataaggatatgactacaatggatgctgctgaaagaattgaatgataaagattattaggtggcttaatgctttttgtattaatctctgggaaagtccattattgatcccaaaattgccaaggctgatcagacaggatcattacattctttctgtgctttttcaagtacttgaagtgtttttatgtaatttaagcatttttcactaatctttcttttttagtgtaactttgtataattttatgttcctttttcttaggagtctcagcagtccaattttggcactggagaacaaagtgagtatttctttccctctttgttttcaaattaagctatttattgaacattcagttttcatggtcacaccatatataactttagtaatacctttacatgtcatatcctttttcatttttgttttctttttttttttttctggagtgtagtggtgtggtcgtagctcactgcagcctcgatctccagggctcaagtgatcctcctgcctcagcctactgagtagctgggactgtgggcacatgccactatgcctggctgattttttaaatttttagtagagatagggtctcactatgttgcacaggctggtctcgaactcctgagctcaagtgatccacctgcctcgcctcccaaagtgttgggattactggtgtgagccaccatgccctcgtatcctaatttttatgatctaatgggtagtagtgggttgagctgaaaaattgttatgctttaaaaaattcaagaactgtaagtcattggagatcaaaatacactacttttattaagcatttgaactaatagttcatgaatacaatttgatgggcacctcgtaaactcaagagttattcttctttcttttaacttacttcatgaagatacttggctctatgatgataaaactccgcacaagaagggtcattttatttagctgaccatggcccttttcttcttatatttgtacagtccctgttttttcttccttggttttctgatctgggtagaaaatctgctgcctgctataccctcacctttacccttactctcttggcctgtcagaagaattctagggaagatagtcttatggtcccaagagattgtggttgtgtagattgagagtggtaagatcaggaaccaatgcaaatgtctgggctttaccatatacctctgtaacaaaacaggtattctttttgccaagagcagtaacttcttaattaaggtagatttgtactagtcataaggtattttggaaatgaaaatgtggaactttttgatccttagtttatcttcagtgatcttaatgcagggataaaactagaagaatacctcttttgatgttatgctttctttatctgtctatcaatttcttagttccaccttaaaggccgtagcttacaggaaaaagggatttgacattgttaattatgcagaaaatgttaaaatgcagaaaatagctaactataggccagagaatttacattttctctcttctttttgtttccttttttttctcagcttgttttccctagtcgtcatcttttaagaatgcttcatccttctactcttctctcattctcttttctgaaagctgttcacaaatgggatcataagctgcctctactcattatttgtgtttttcactttgttttagagctatttctatatcagcataaagctctagctcattgtttaaccttaaaattatgttataatatgaaaatatcttaatttatttcactagtcccctatcgatggacatttttttccagtttttgccattacaaaccaggctataataaacattcccaagtgtgtgcttgtgtgttcgtgtattcctcaagattatacctgtaatgtaaattcctttcattggaattattaagtcacttagcaatataattacagtactgagaaggtattaccagattgcccttcaagaagatcgtatgagtttatagtcctaccagcaacatatgcacatgcttatttcccctgtagtcaccagtatctcatattattgggcttgaaggtgttaccagtttggtggttgaagaattatatttcattgtttgatttacatttatttgagggtattttacatagacattttacagtctaaatagccatcctttagttgctcacttcattctttttgttccagaaagatataatccttctaaaacttcaaatgggcaccagtctaaatcgtaagtttattgcttaatgagtttaatatttatcatttttgctaaaagttacctgtaatatctaggtattttgaacagtatttagaaatattgaggctgggcagggtggctgacacctgtaatcctagcactttgggaggccaaggcaggcagatcacgtgaggtcaggagttcgagaccagcctggccaacgtggtgaaaccccttctctactaaaaataaaaaaattagccaggcgtggtggcgagcgcctgtaatcccagctacttggaaggctgaggcaggagaattacttgaacctgggaggtggaggttgtagggagccgagatcgtgccacttcactccagcctgggccacagagcgagacttgatctcagaaaaattaaaaaataaaagaaatatttaaggcatgagcatgcaaatttttatgtaaagggtcagatagtgaaatatttaggctttcagagccacatagtctgtgttttgactgctcagctctgccatctgtagtatgaaagcagctgtagaccctaagtgtggcagtattccagccacactctttaaaacaatgtggtaggttggatttggcttgtgggccacagtttgcccacctttgctctgagatcatggttttttctcatctgagagttgtatgtgtatgtttttgtgtgtatattcctaatttatatttaataagtcataaaataaagacaggattcttctttaggccaagcccttcatttaaccactagattaagtaacatacatagtttgtactgtctttaagttttcttatttttattttgttggtagaagcaggaatatatataaaaatgtaacagggtaatgtattggatgaaaataaattccaacttaaagaatgaactcctgaactcctgagaccacaagttaactcagtgattaaagcaaagttctaaagaagcagtgactacagtgccagctttctatgccatagtcacagactatactgtgatgaccctagcctggtagcacttcagctgaatataagaactaagaatgaaaatacatgaacacaagaagtacccccttcactgctgaaaaattcaaattatactcctattcatcatacttatttatatgtaaagaacggatgtggtcttaccatatatatacctatcactttgattgtgagggaacaaaagcgtgcagggccctgagcagtctggtaaaagctttgacatattcacatgtgtaaacaagttcattgagctgccattgttaaatcataaaggccgagagaattcagactaagtacatttccttagaggaaaatcagtcgtagagatagatgcactaagcccctgtctgaaagaaaactcttttttccctgttctgtttaattgggccagtcttaaaaatcatctggttactttatttcaaggtggtgtttaatatgtaatattttgaacttagggtcagatatagaaatgttggttaaactttgaggaggaaaagtacaagtagttaatagagtgaaagaagatttccttctcactgattggagattgtaatgaaattttaagaaaggtaatggaattactgataatgagaaattagacattttcctagttgtagttctccctaagctttgtattaatttttcctcccatgtaaaaagacaaggaatgttttgtggactgttacatagaaaattttaagtttaatggttttgattttatggccttaaaagaaaatttacatctttaattttgctttcaaaaacaaattccagaaactgtcagcttatagtatttgtgtgtatgtgttttaattgatttgaagtttgatcaacggagattttggaacttgggagttttttttgttttgttttgtttttttgagacagagtctcgctctgtcgcctaggctggagtgcagtgatgggatgtcggctcactgcaacctccagctcccgggttcaagcaattctcctcctacctcatcctcctgggtagctaggattacaggtgcccaccaccacgccaggctaatttttgtatttttagtagagacagggtttcaccctgttggcctggctggtctcgaactcatgacttcaggtgatccgccaacctcagcctcccaaagtagtgggattacaggcatgagccaccgcacccagccagaacttcaaagttttaaaaatatatacatagccatttctgctatatagccaggacttttacccaaaatatttatttctacagagggcactttgtttcatagcaaggcatttatgaactagaactttggcttaggaaaccgttctggttttcacagttacccagttgtcaacagttatactaacctctctttatggaacatgggggacaaaggaagaattgcttgatgctttcattttatcttccttctttttaggaattatatctctctagtggattgttgggtatgactttgttaatttttaataatgaatgtgtgtgtgcaactaggggaaaagttagagattacagaactgaattatgagagtttatagaaagtagcttttgtttaattagaaaaggtgaatattttattcatgggaaggatagagcttaggaatggttaaattcctccattctcaattttgagattttgaaccaaaccagatagaataagacttactggtgttttgttttttggttaaatttttggctaccacagtgattatttctagaatttttagtagatatttagtactctggcataccatgtaaactgttccaaaaataataattctttgtcttttccctctagtatgttaaaagatgacttaaaactaagcagcagtgaagacagtgatggggaacaggtgtgtctactattgtattattttgccagtctcatatagtattttcattgtattttataaaaatgataattgaataatgcatttattacttaaaataagtttcttataagctttctgacactgaaatgttgtagttttcttctctgtttttaaatctccatttttttcttatttttttaaaaaattgggttttcctcaacatttattatggatcaaaacatactcatgaagcagtagattattgacaataataactattaacaaagcttttgatcttattctggcaattcagttactcttcaggtaaaaacagtataagtgctaaatattgttgcatacattagagaatccagttttttctgttaagagttcagatattattcacactaagcaaatagaatactgtttattcattcacagattctttcttatgttttaattttaggattgtgataagacaatgccgaggagtacaccaggaaggtgggcatccttttcttttctgttttattggtaagagttgggtcagcctgataacattgcagggatataataagtggccttataagtaaatattaattttgataatggttgtacaattctgtaaattaagtcattgaattatacacttaaagtgggtgttttgtgtattatacctcaaactgtttttaaaaggtgagtattaatagctaagtagcacatcagaaactttaaaaagaattactcatttcatttacagtgaagctctggattcatagaattatagcagtctaacacatagtaaacattttaaagaaagttgcagccgggcgcggtggctcacgcctgtaatcccagcactttgggaggccgaggcgggtggatcacctgaggccaggagtttgagacccacctgaccaatatggtgaaaccccgtctctactaaaagtacagaaattagccgggcgtggtggtggacgcctgtagtcccagctacttgggaggctgagacaggagaattgcttgaacctggaaggcggaggttgcagtgagctgagatcgtgccactgcattccagcctgggccacagagcaagactccgtctaaaaaaaaaaaagacaagaagaaaaaaagaaagttggttgtcgatttggatgttttcctgttgtcaatgtaaaataaactttggacatttgtatatttcatctcttttagtaactctgaaccttcacaccataatagtgaaggagcagataactccagggatgattctagtagccacagtggatctgaaagcagctctggatctgactcagagagtgaaagtagttccagtgacagtgaggcaaatgagccatcccagagtgcatctcccgaggtgagacagaggcggtggggtaccttccacaggccctctcagggtccttggtgatgtccatttaaaacctgatccaaatataaaaggagaaggaaagaaggttccatagtctgacaaaaagaaattgtactgtgtacgttggaggaaatctagatggttccttgttgtttgaacaaattcggtctagattaggaactgcttggcatattacaggtcactaaaatactgtgtacctttagtttggtcttttatttttatgactcaacatggtaattgatgttctgtggttacaaagaacatcatgttgttgataaaaagagtcttatgtaatacaattttggtatagcttgttaaattgcagttaaaaatctctttgtacctacatcatttgtttactttctagaattaaatattctgtacggtaatttgtaattatgcctttgaaattggattcttgaataggaatatttgctatttaaaggtcatatataacattaagcttatctttttttttttttttaagatggagtcttactctgtcacccaggctggagtgcagtggctcagttttggctcactgcaacctccgcctcccgggttcaagtgattctcctgcctcagcctcctgagtagctgggattacaggcgtgcgccaccgcatctgactaatttttgtatttttaatagagacaggatttcaccatgttggtcagactggtctcaaactcctgatctcatgatccgcccacctcagcctcccaaagtgctgggattacaggtgtgagccaccgtgcctggccacttatcttcttattcagatgataagagctaatagtcaatactcagccctttgctttggttcatagagaaccatttgcttttgttgcattaggcattgtggtttttcctcttctttgaggttgtaaaggagggagaacgaaaaaagcattcagtatcgaaaaaagcatacatatttctctgtttttcagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataaggtttgtgaagggtttttgttgtttgttttgaaacatcagaatctgaaatgcggtggaaatctcagtaagccacaaagtaacaaggtgggtcataagctgtgaaggaaaatagtgggtaaacccaaggcccaggcgaggctacatgtggaacagtctcttgaggatttctgtgcttctgcctgtgtccttcagtaaagcagaatagttgctaatgaaataagaaatgagtcagtgcttttcagcatgtgctggccagtgtagaggttagagagcagcagcttgcaaattggcatttgcaacattctcaacattttggttttaggtgtttttagtttggatatgtactccccgtattgttataatccctaccattctcttctgatgtacacccagaccaagtcacacttaaataactaatctgctatgcacctctatgccccagcttattttccttaacaaaggtcagaactaaaaatattgctggcttatagccagctgtcatccctaaatacttccaagataattttggatatagaggcaaaatttgtatatttaaggtctgcttttcttagactaaggaaatgtgaaaactcacgcatgtctgtgattggaggataataatcgtacaatgaagagatctgaatcactacatatatagagactgtgggaaaaacagcctgatcttttcagctctagtgaggaatttacaggagaatgtaaagttttaagtagtctatatcaaagaatactataatttcttccgatacatgtctatgattgtgaaagaccagaagttaagcttgagtaggtgaacagataggtaccagaatggccttaccaagtaagtaaacttagaacacaaacaccactccagttgacctgagaatcacatatactacagggagaatagagcactttcttaaaatggagtgagatattttcctctctccttttcataaaaccacagtgccacgtgcagatgatatatattcagacaaattagaataatacatgacttcttttttgaatctttaaaaattgaaattgtccacattatttaaatttttagaaaaccaaagcttactactctctatactatacctaatgagtttccattatcatagtatagagatgttttgctcaactagtaagctgtttagggctgctggcccctgtagcccacagcctcagatcgctggacttggctgtgggatttaattcatagaataatgtggaataagagcttgtgtatgatagactctgctcttttggaagctaggactttttttatggaattttaaaaaatggtccttttgtgcttaaaaagtattactttttttgtaagattttattttatttttcttacttttagagacagggtattactctgtcacctaggctggagtgccatggcattcatagctcactgcaacctcaaactgccgggttcaagtgatcctccctcctcagcctcccaagtagctaggactacaggcatgcgaccccacacctggctaattttttatagagatggtatcttgctatattgctcaaactggtctcaaactcctggaatcaagcagtcctcccacctcagcctcccaaagcactggcattacaggtgtcagccaccacacctggcccttctataaggtattcagacatttaaaatataaagtgtcaagggcagtacctggaggtaaagcaggtagtactaagagaagacccagttaagggtaataaaggatgtagatttctttttctcatgttttcatttgtctgtctttattcatttgtataggggaacagattcttttgttatggtagaatatttgcattctcgtgccctgatatttgaagcaaaaggaaaacttagattcacttagaaaagtaacattggcaatggatgggcccaccacttgtgttttccatcagaaagttttttgagtcactaggctgtgctatgatcaaaagtatggaccataaaaaatgttggcaaagttgtgaaaaagttggaactttgatatggtgctgatgagaatagaaatgataccactgctttggaacatagtttggtagttactgaaaaagttaaacatagagttaccttttgatctgcagttgtactgctagttatatatccaagagaaatgaaaacatgtccacacaaaaacttgtacttgaatgttcatagtagcattattcatattagccaaaaagtggagacaacccaaatggccatcacctgatgaatgactaaacgaaatgaataaattctatgcagtgaatactattcagccataaatgagaatgcagtactaatccatgctgcaacatggatgaaccttaaaaatgttacactaaatgaaaggagccacaaaggccacatatattgaatgatccattttcctgaaatgtctagaataggcaaatctataaagatgaaatgtgattgccagtgtctgggggaggaggagatggggagtgactactaatgggtatagagtgtgttttcaggataatgaaaatattttaaaattcattaagccgggtgcagtggctcacacctgtaatcccagcactttgggaggccaaggcgggcggatcatgaggtcaggagattgagaccatcctggccatggtgaaaccccgtctctactaaaaatacaaaaaattagctgggaggctgaggcaggagaatcgcttgaacctgggaggtagaggttgcagtgagctgagatcgtgccactgcactccagcctgggcgacagaacaagactccgtctgaaaaataaataaataactaaataaataaaattaaaatttcattgtggtaatggttgtacaactctgaatataccaaatgttatggaattgtgcacttctaaagagtgaattttatgttatgtaaattatatcttaattataatttcacagatactacctcccaaatcattacattgaaaagatgccatcttagagactgtaggaaatgcgtttcagtctctgggttttgtgtatctaaaataggtgacctcagccttaaaacctcatcttcttgaatattatttaaatgaattatagtacttctcttttatcttctttctgatgcctaatcatggataaactctttgtgggtagctagtgctggaagctgaagttagttgaataaaaatcagaccacggtttctatttttcatctagaatgaagatgataaccgagccagtgagagcaagaaacccaaaacggaggacaagaattcagcaggccataagccatccagcaacagagagtacgttcccaaaacatgttgcatgccagtgttgttaatatatgtatatcatttgatagtgggtactttctgacatgctctgagtgttccttttagtaagcaagtgttatataaatgcatacacataacatatgccaaatagtgggagctttcacttttagctaatagggatggaaaacatttaacatttaattagttcttcctttattcattttttattggggtaggggtgagtatggggggagaattaaagtaaagctatgccactttctggttagatggcaaacttatctgtaatttccaagagactggttgccaacttaaaagtggtaatctcttcattcaccattcatcaatttgttcaatcattcagccaatatttattgagtactactgagtggtaggtcagtttttggccctggatttacaaccacgggaataaaaacagagaagatgcctaccttcatggaatttacagtcttattttgttttatagaaatcatgtgtcctagtaatcaaatggggaaaaacagatttgtcttgaaagcagacaaagagaaatggaaaaatcaattacccctgtattactgtgtggagaaatgaaggcattcgtttggtttggcaggtcatctaagcagagtgctgcaaaagaaaaggatttgttgccttctcccgctgggcctgttccttcaaaagatccaaaaacagagcatggctctcggaagaggactattagtcagtcttcttccttaaagtcaagcagtaacagcaacaaggagacgagtggcagcagcaaaaacagttcctccacatcaaagcagaagaagaccgaagggaagacttccagtagctccaaggaggttaaggtaaagtgttgggggcctggggcttttgaaaatcattcaacttgccatgtgacttttccagggtgacactgtgctttgaaattattgtaacatctcagtaaatatataggcctatgtcttttaccctctatatgtaataatcctgataaatgaatacagtgatataagactgtgaaggcggtaagtcagctggtcacatacatattgaaagaaaaacccttgggtacagtggctcatacctgtagtcccagctatttgggaggctaagatggaaggatcatttgaggaatttgagtccagcctgggcaatgtggtgagaccctgtctgtaaaagaactttaaaatttaaaaaaaaaaaaaaaaagatagaaaccagtcattggaaaagttggttatggaagcttttaaaataagaactaagtggttctagttgctaagattgagttgttgtatattgtttgaaataggctttgagtttctcagaattatactttacaaacaagttatattacgtaaagtgacaaagcaatcatttgactttgattcatgaaatagaaaaagaaatctttagctaagttagcactgaaattatttctaattattattcctaggatactcacaatgcaggggagtattcttcatgtttatagttggagatttggatcaaaggagctttttcaaggctgtactttaatagtcactcaacctcaatttgtttaccaggttgtttgctttctaaactgttctgatcaggagcaaatttacttaaatcagaaaatacctattatttagtaagcaaaggtttgagagttgaaaaataagactccttaaagctattatatttattaactggtaaaattaaaattttttaaattgagattattttaattaagaacttctcaaattaaaatacacagaaagctttttctctagctgaacaacctctttctttagtagtttagtgttagcacaaggtgcttaggaccttgacttttatattggcctgctttattgctccagttctccatctgcctgctgatggtttttctccatttcccatcctttaactgtaggatttgaggcctctgtgcttgcttcttgaaacctgctattgcttttttaaattattatttaatttaattaattaatttattaattaatttatttatttgcttttaaataagtgagctctcctgctcatttggattctgctatctcgtaggtaaaaatcactgtgtatgcttctatcacacgtaagaaaggagtttcttcaagaagttcgtcagcttcttgaaagcaggcatttgtgtcttattttgtgttttatccggtgcttaacttgctgggtaatgaggaaatatttgttggatcaaatgtagtcatttggtactctgttgttttcaacaaaatatggaatagggccttaccactttgatttcaatagctcttggcacttaacagttactgaagttagtatttgttagtcttgacaatttccaagttaggcagtgacatttgagtttattagagaataatctgtaatttagttaggaaatatgctattttttattctatcaactaaagaaaaaattagatctggaaaatcaacattgcacatagtttttatataagaaaactgtgtttaaatatttggaaacttattttcagaaatcctctgaaaagcaaatctgaatgtaggtccttatgggtctatttataaaacatagagggggccaggcatggtggctcacggcctgtaattccaacactttgggaggctggctggaggatcgcttgagcccaggaggttgaagccacagtgagccatgattgcaccactgcactccaacctaggcgacagagtgagaccctttctcaaacaaataaataaataaaacagaggaaaagctatcctagtaatgttacagtacaacataatattcagaaagccatttcaaagtataattatatatttaaaaattttatatttttatataaatataaaaaattttatatggggtaaataggtaaagtaaaattatatattattgagttttctaatgttgaaacatccatgcattcctggaataaattccacttgtttatggtgttttattatggaaaaatgtatattcgttttattaaagatagggctggatggaaggcagttgagagagagtcatagctctttcataaagggctatattgataggaggcagaatagacatatagccaggtgcagtagtacatgcccatggtcccggctactcaggaggctggggtgggaggatcacttgagcctaggagtttaagatcaacctgggcaacatagcaagactcccatctcttaaaataaaaaaaagacatgtggatgagaggcagagtaaagtttaagaaagtaactaggcttttgaagtctggcaattctgaatttgaaactcaaattccaagaatgccatttaaaacctgtttgaacttaggcaagttactcaacctccttgagactgctttttcattttatcttaatagcagtacttatttcataggtttgttaaaggattaacaataatgctaagtacttagttaacttagtgcctggtaagtagtaagcacataataaatattagatgctattaatattattgctgttttcattgaccagtaactaccaataaatgttgccgtaagtagtgctgccattttcatactaggcttttgtcttccttatgttttaacaactgcctaggccagtgcctggcatatagtagacccttatataaatattagaatgaatatttcagttatataaaatggaccctttttttttttaaagtttacattatgaagtttataaaagttttgtaacaaggaaattcattatgaaaggcaatgaaattttgtttcctttttaccagtggctgaagaaatgctattagtttcatttttaatctccttacggttttcattgtagttatatatttttttggtcaggaaaaggctccaagtagctcctctaactgtcctccatctgcaccaactcttgattcttctaagcctcggagaacaaagcttgtctttgatgacaggtgagataatatgattttttgtatctgtatttaagaaatgattccagtcagcatataagaaactcattttcatttctatcattggccgggcgcggtggctcacgcttgtaatcccagctcttttggaggcccaggcaggcagatcacgaggtcaggagtttgagaccagcctgaccaacatggagaaaccctgtctgtactaaaaatacaaaaattagctgggcgtggtggtacacacctgtaatcgcagctattcaggaggctgaggcaggagaactgcttgaacctgggaggcagaggttgcagtgagccgagattgtgccactgtactcccgcctgggcaacagagcgagactccgtctcaaaaaaaaaaaaaatctatcattgatcagaaggatatatacttacgtatgatctgcagaatattcaggtttcaatttgaaaagtacccactagtccaagtacggctcctttagcttaactccatgactcccatgagggatgtgaatgatctgccttccagtagaagaatcttactactgctgatatcactgttaaaatggagggtttcttaaatgaggaagagcaatattgttttttcctctattttaataaaaggtaatttctcctactcacattttatttatgcttaatcttacaatcaacttgagtaacttagtatttgatactagggagcttgatttctgttttcctaattaggtttgccatgagttggtcaaaacaacttatgcttttaacctgatataaacatttgtcagaaaatactgaaacaaattcttagtaacagctcattttctttgcttgaggacataaaaactgagggatactagatactgaaatgaactagtattatgaaaatatttactattctatttataatgaaaatttgtcttgcagaaattattcagcagaccattatttacaagaagcaaaaaagctaaagcacaatgcagatgcattggtatgtagatattctccttacacttacgtatttaatcaaattaacttaagtaatcttctgatgtttgtagccatagtagatcattactcattacttgcattctcctttcttcagtctgataggtttgagaaagctgtatactatcttgatgctgtggtatctttcattgaatgtgggaatgcattagagaagaatgctcaggaatccaaatccccattccctatgtattcagagacggtggatctcatcaagtaagtggaaaaacttggcagatcattggcaataacattatttctctggtccatcaaggaagaggctgatatatagtaaactgaagagggtgtataatcctttaatgtccttggataaaggagaagtagatacttcaatgagtatttttgcttttatttaggtttgaaattctaatgttttgaggacaagtgaaatcataagatcaaggtgaagtattctgtttgtcatttgtttgttattgtaactcaacagatacactatgaagctaaagaattacttggcaccagatgctacagctgcagataaacgactcacagtactttggtgagttttctgtgttctagcctctgctagatacaggaagttctataataaatagtgctgtgtgtgctcttctgaatgttttccttgaatcagacttctgtaatcctgtcttaaatctgttcctgatgggtcaagcaggaagtaactcaaaattcctactgaaaggtttgagttgttgtcagtctctgatccatttccctcttgatgaaagccttggctttgtgagactgatagtagaaacctccatggtcttgaataatcacttttccacactcttcatttggtacccgctctctccattcacatatacttttccttagggagcaagcatctagtttgttcagaataaaggatgtgacttgtttgcttcatcccagtgagatattatcagttcgattgttacaggtctttactttacctggcactgtgtttaacactgggaatgcagctaagaagaagactaacacagccctattcatcatggagtatagtctagtgtgagaagacagaaatcaaatcatcatacaagtccatatgaattaagtattttgaaagaaaagtatatgtaactgtaacagtagagggtagggagacctactctatttagagggaacaacatgtacaagggctggatggtggaaaggaatgggaaactttcaaggaactaaaagaagaccagcgagaagtgggtgtgactggagagataggcagggatgatcctgcacggtctttataagctatgttgtggtttgtaatatttgcagttcagtttcctagtttttgttttttaattttagattgtttacactttggtttggaaattctaccccttcgtaatttttaaaacttcatgacatgttggtgtcctatggataaggtttggattttggaatgtcagcaaataatgagagcctagtcctaggcttcttagccatcttcccctccctaggatgtgtaccacaataagaacacatctgttggttttgcctaacggttaatgttgtggcctatgccatggtcacatgagccagtctcctgcacaatgcaaaggctgtctgtgcaaatctggccagagtttgctgtcctggtaaataagccgcccttttccattggctagcctgcgatgcgagtctttgctgtacctgaggctgttcaaactgaagaaggaaaatgctctgaagtactcaaagacactgacagagcacctgaaggtaagtatgcaaaagcacaaggtccgtttcctaggagacagaatttgtagtctcccatccccatctgagaactgccctcatgtttatgcaaaacacaccaggggaggagctactgtttgggacttttcaaataagtttgaggtttctttgagttttttaatctacgtgtatctgattgtagaactcttatagccatgtgcagcggctgtatttactttttaaatgatcttttgttttcggccgggttcggtggctcacgcctgtaatctcagcactttgggaggctgaggcaggcagatcacgaggtcaagagattgagaccatcttggccaacatggtgaaaccccatctctactaaatatacaaaaattagccaggcatggtgccacacgcctgtagtcccagctacttgggaggctgaggcaggagaatcgcttgaaccctggaggcggaggctgcagtgagccgaggtcatgccactgcactccagcctggtgacagagagagagactctgtctcaaaaacaaacaaaaagtcttttgttttcatgccatccttttctgactactatcttagtttcctaaaagattttcctatgtttcttcaggccagtaccacataaatcctcctaaaatctgcctctgattatgacttggaacccttcagtagttgcctgctgggtcaagtttaaactccttaccctggccccaaggggtctcttgttccttgtctaaacctctgctttaggcaaactgcatggggcacatacactgtcttttctgcagcctttgtgcatagtatgattcatctctcccctctccccacccacccacccacccaccccttttttaagagggagttttttaaaaaaaacgatcatggctcactgcagctactcccaggtagctgggagtagctgggatgtatcccccttccctttatccatgtgttactcattatttccttgcctcttctgtgaagtcttccagaacacccagctctcacctaataatttatttcttttgtacttttacacacacacacacacacacacacacacgtattttggtgtcttaaatatttacagctgctcacgatgagctcttgcccaaagcttttaaatatatttagaacttcttaaagtagtggtggtttttgttgttgttaagtacattttactttttccacagaattcttataataattctcaagcaccatcgcctggcttgggaaggtaggtaaaattttattatgtaaaatattattgtggcaataaaagtgaaatgagtatggtccaatttccaaaaatggaaagatgactactttttaaataagtaaaaccatctctgataaaatatttttagaagttataattttttctctgtattttttaggaattgaaaatataaatgaacataatcataaagattagatatgagacgtttcacctgttaagaaatctgagtttttactagcactcaacccttttcacagtttgatttccatagttacttggacttatcacagcaggcttatctttagtcagatcttggcactgccagaatttagtaacaatgacatgattgtgatttctccttcatctccacgtcactttcatcccacctatctcccaaaggataaaaaacaccatggaaccttttaaattgtatctgttcagttattatgtttataagaattgacattctttgtcctgtgtgtattttcttacataagtttataatgctaaaagtgcagataaaaatacaaacaagccgggcatggtagctcacgcctgtaatcccagcactttgagaggccgaggtgggcagatcacaaggtcaggagttcaagaccagcctggccaacatggtgaaaccccatctgtgctaaaaatacaaaaattagccgggtgtggtgtcgtgcgcgcctgtaatcctagctactctggaggctgaggcaggagaatcattggaaccagggaggcgtggaggttgcagtaagtcgaggtcatgccactgcactccagcttgggtgacagagcatgagtgtctccaaaatatgtatatatgtgtatacacaagtttatttttaccccaacttttgatttttcctttcttttagtgtgtgatcatagtcttgaacatttcacaaattttaatactcctgaaatgaacctgccagatttcaacatgtatgttttctaagaaatatttaattggcaggaagcttggggtgattacagttgcttgagagagctgtacctctttgttacctctgagtaatttggttaaactaggaaagtgtcagaaattgtggagttcaataaaagatgttcccatcttctaccacagttttttaggttaaatgtgaattccaccaaactttctacaaaacagtataaaaaatatgtaattatatgcccgaacagatggaaagtgttgagcagagagtgaggggatctggcttttaagtctttgaactgtaacaaggtacatgacttcttcagttattgtccatctcttgttttgttgttattcattaaaacaaaggctacagattctaagataacaagattatgaattacaagattatagtacttatttagaagaaattgtagttctctgaaaacccatctagtttaagagaatctttacattttaaatgctttcatgtagaaagagctagtagtacttgattttataatgcttaccatgtccatatgaacaagcttcctatttctgttgtgtagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaaggtaggtaggtttctggataaacttcaagggatggaattgttagaaggaacttttataatttagttaagtaagcgtttagtctgtatttagttttattatttagagttaatgataatctgtttgttaatagtcttcattgcttagcagttaaacaataaatgaaactgaatttggtcaaaagatacctctcatgattctggtgacaaaactaaactgaaaatagttcttggactaagacaaatgtgcttatattctggcacattaaatgcagctcataccataaaagtaataaaatatatgtcctaccctaggatggttaacagtaaatttggcaataggcataagattacatccaaacatctgtacatctgagaaggttaatgtataagaaagcatgctcatactggatttttaggtatattggaagaaacctgtgaaataaaggagactagggaatgaatagaaatttttttttttttttttttgagatggagtttcgcttttgttgcccaggctggagcacagtggcacgatctcgactcactgcagcttccaccttccggtttcaagtgattctcctgctcagcctcctgagtagctgggattacaggtgcccgccaccatgcccggctaatttttgtatttttagtagagatggggtttcaccatgtgaaccaggctggtcttgaactgctgacctcgtgatctgcccatctcagcctcccaaagtgctgggattacaggtgtgagccaccacgtccggccagaattcttaacattctttaaaattaggttgtttgaggctttgccctttaaaagtttattatttcccaaaccaaggacatggagaattataaagtctttgaagaccttagtggaaagtactgtataaccaccattttatttagtagatgttattagcaaatatgtgcatgcagcttctctttaggcagatcctttacagagaaacactacattagccaatcaagtgtcattttgtcacagagtacatttaaatacttacagcgtgaacaggtaatcagatgaaaatgaaagattcctatccctaaagagaggcaatggtgaaaggtaaaagtggaatcccaactttttttttttttttttgagacagggttttactctgtcacccaggctgcccaggctgtggcacagtcacagttcactgcagcatctacctcttgggctcaagtgatcctcgtgcctcagcctcctgagtagctgggactacagatgtgtgccaccacacctggctaatttttctactttttgtagagataaggtctcattatgttgcccaggctaggaatcccaacattcaacataaagctgtatttataaaaacataatttgtggccgggtgtggtggctcacaccttgtaatctcagcacttcgggaagccaaggcgagtggatcacccaaggtcaggagttcgagaccagcctggccaacatggtgaaaccccatctctactaaaaaaaaaaaaaaaaaacttttttgtattttatatttggctgaggcagcagaatcgcttgaacccaggagaccagggttgcagtgaaccgagatcgcgccactgcactccagcctgggcgacagggagactgtctaaaaataaatgaaaataaataaaaacatgggatttagttatcagttggttcatggcatatgatggtagccgaaagtttgatataatcttaagtgtctaacctcacagaggctgttacaggaaacaggcaaagaatgtcctcctttttgtgtcacttgcttcttatacaaaagcaatgcacaaaatgttttgagtaatcagtagcacattatggcattaaatcttcattttaataatatctactgcataatagcaatttatcatttccattcatggaatcctgcttatatataacacttaatttctgaccatacattctgtttaaaatgttgcatgacttagggaacaaatgtaacttgagagactatggaatgatttgctctaaaacatggacagtaagcattttagtgtaggaggaggtattttttgagtttatgaatgctgttttataatctctactcatagttttaaagcagtgattcaaaagagtatatatcatttaatgaatgtttttggttttctagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtagacatttttatttatataccttgggagctttattacctaatatctttttgtggtagctgttctaagagtaagaattggttcatctaaaataaggacatattctttctacacctgctacctgacctgatatttgaaatcttaactccaattttattattgtggaatttacagttagtattaaggatattcttctacacatgaaaaaatcacttaaatatgagaaaatggcattctacatgtatgtactatgaaatgtgtctgatttggtatgcattatttcaaaaactgtgaatgtgtgttaataacactacagcaatcacacagtgactatagcttgcatttaatgcattacaaaagagggaggacaaactttctagaagaagcatttcatgttgaagggtttcataaaaggacaatcctgaacgttacggattttattaaaaccatatgttattttttgttgctaatcatttgacacttaatcgaaacagaataagttactgtggaaaaaaggatgatccaactcctgaggattgccgcctgtgtgtctttaattgattatctttgatagttagagttatttttcagatttttccccctcatactggattgtgatgctctgatatgagcatgcaatgactgatacagaaataggctggagcttcggtgtgtgcttttgctatacagcttacagttctaatgcctgatgtagagatgatgaatttctcctttttaaacctatcttctgtttactccttttgcattatgaaggccctcttcaatgatgtatgtttctgatggaatcagaaaatttcacactagaaaagtgtacctaacttgattcagtgtgagctcttgggacagggaggggagccaggggtagagcttaaagaagctggctctgtaagagttgtatatcaaagtaccttttgctacaaggtgcatatagaagtctaagataagaaatgtaccctctatactttatttttcatgcccctatcatgtttggtgtgccttaaatcttacctttaaatgaagactctatggattgtttacaaatgaagttttacactaggaccagatcgtccatacatgattggtcttctacaataataatgttcaattctttcattttaaatctttctttagggtcatataaagattagttctttcagaaaagctattgctttggtacatgacttagtctaaccagttgggtaatgctgctttgaaaaatagtttgtccctctccccattccaaaaatgaatccattcagtcagaaaaaaagattatcctactatttgtagatgattgctaaggcttgaaataggaaaggggaaagaagggatagaaaagtttcaagtccagtagtgcagtgaatcctttgtgtttgagacttttttacacttatttttgaagttagtgaactttcattgtccctgtggcctcatatttatagagcttcttaactgttttgtacctcagattgtttttagatgtcattgaagattgagatgtacaaattatgttgaatttaacctgtttctcttggagaaattgcctctgatatctttctaacttaatcttagtgtgttctaggaacagttttccataagaggacaacttctcaatgatcatgatagttatttagtaagaaataatggttgttaatcaaatacatgttatgtcttgtccttctctgatttttctgacttggattccttaatttgcagtgatgtcttagaaatggaaaaagtatcctctgggctttcagactttcagcaacaacagccagtgggatacctctgagttcttgtgttctagtctcttgtatgtcctgaaaggcagcaggagcatttttggggtcacactgatattttgttaaagcagagtttcctgcatggtttatggtgctgctctaatattttctctttaaaactgtgtcaatttttggagaatgaatttttcaaccttttcattgtggaggatttttcccacaag

SEQ ID NO: 13805 - DNA, 6946 bp, Human
gtgggctgactgggtgacccgtaggtgggaggtgccttggaggccctgcccgggccggtggggtggagcctagcggaggacgtcggggattgaactgactttgggggacagtggacaggcggaggcgctcacacttctcctcagccctcggcttttctgtggaatcccagtcaggaagcggccgaatgcgggaggcgggggagggaacaaaaaggtgacgaggaaggggcctgccgacctccggggcagcgctggccaggagcttggggcctgcgagtcttcccagctgtagacagagcgcctctgagccccgaggccgggccgccccacagcagaggagcacgaggttttatttggccttggccagtagctcaaagggggcttcgttattttcaggccatgagcgaccccagcaccaaaatcagggacacatatcgaaggcttctcttggactctgttttagagtcccctggcaggctgttaacgttcccaagagataatacaaacgtttcgtcagtttcagccacaaaaataatcaaataatcgtcaattgatgaatgctgaggccgcctcgacagcagccagcgtcctccccagatggtttgcgtggggtggggggaatcacgatgccccagttctttcttctccccacgtgagaagcaaggaaagtcgggtgagaggccttattatgttttccctgaagtgcattctgcttgacgatgctgttgtcaatgtacagctcgccctgaggtgtcttgtcagtgttttgttaatggaattgctggccatattttatctaggactaagctctcattcaacagttggctgtgttttataacactacttacggaccacggaggctcggcaggcagtcaacttgtattttgcagacataccttagttttctcatgtaggtactgcacaaactggcttcgtatcttgcactatgagtgtaggctgactcttccagcatagtctccttcggggtggcgctgaatatcccctcatttcagcttttcatggtgctcctttgcctcatttttttaaaccataatgtctagcctggtctcagctccaaggcaagaacagaaatacaggtaaggacagaaatattgtggcaaattctaccaccatttggatgaataataataaaacgttcatttattttatagcatctgcaaacatcccaaaacctttcaaccaaaatatgtatagatgagtgtgcagaccaaagtaaggacatcagtatgttacatttaaaaataagtcaaggttaaaggcggtgtcctcttttaagaacatcgcaaatacaattccagtactccaagtacgtattctgtacccagccacctgggaggactgagagacctaatggttttctgctttctggaacttctatgccaattgtgactttctcacccaaatttgtaaattcgcaaattaacatgcagcgaataattacaattgtaaacacctggaagtggaaaaggccgtgaggataaattgagaggaagagtaaacctaataccataagttgcataccagcagatctgagtatcgtcatgaataattggttagcttttccacatgccttagaagtttcagcaagcacctagcgaacatcttaatccaaatttctcaaaaaatgagagattttatttaagatcattcctcaatttatcttagactttcagctacatagttagtccggtagtgtaacagtaacgggttttacgtaaatgccaggggaaaagagaggaaagctaaataaccaagtaaatctgtatctaattaacaaattggctaaataaggtgttatcagctgcttgatatagagctgataaaatcttcagctaggcatacttgaggcctgattacagaagtgaccgtagtccacccacacacctgaaatttatttaagagaccaagctaggctcttcctggcctttaggaagaggactggcatggagaaatatgttcctcactagttctcccaagccatggcacgtcccaacaaattcctcctttggttttgctgctttgcctggctgtgttttcctattagccttggttctcaggcttctgggggagaagctcagattgctgctagtgctgagttggaatctggggctatgccttggtccttgctgcagcatatagatgagagagacagagctggcctccttcccgcgcttttcaaagttctatctgttgggcgaggtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggtatgtgaaagcagattggttaactgggtggagggaagatgatagacacttctgcatttcaattacagaaaggagctgagcctagttccttgaattgtattttattttgcataaaactcaatatccagttgaaacaaatctgggacttgagcttattgtttattcctaacgctctcattggttaaggtgggctaatatgatggaattttaaagcaacaccagagacttaatggctttcaaggctgagcggaagtgctgctagagaatgttagcacctctttctgttccaccaagcttttggcccagaaatggaccttaaacatctcttacagctattggtgtgatgtgttaaataggatatttttctcttgtttgttactttctgtgagagaaaagcttaaagttcccgttttgaacagttggcccttacaagaacaaagtatcagtccacagtttgactcagcagttgggtgtggtgctttaaaaaattataacatggtgaaaccccgtctctactaaaaatacaaaaattagctgggtgtggtggtgcatacctgtagtcccagctactcgggaggctgaggcaggagaatcgcttgaacccaggaggcagaggttgcagtgagccaagatcgcaccactgctctccagcccggcaacagagcgagactctgtctcaaaaaaaaaaaaaaaagtatatatctaccagctcttgatttaaaaccattctaacccaacagggcagttgtatctgcttccttaatatcctattttaatatagtggttttagagcatctgtttttaatctcaagtgttctaaattaactaggaccaattacattgttttaaattgactttcttcactagggcttagaatgtcatcttagtaagtctgataagtgtttctattatggttttccctctagagattatccaagagaaaaatactactttccttatcagctcagctgcttctgtgtttggagcaaattactcagaatgaagcttcaggctgagcacagtggctcatgcctgtgatcccagcactttgggaggttgaggtgagaggatcgcctgagcccagaagttcaagaccagtctgggcaacatggcgagaccttgtctctacaaaaacaaaaaatcagctgggcatggtagctcatgcctgtagtcccagctacttgggaggctaaggtgggaggatcagttgcacctgggaggttgaggctgcagtgagccatgatggtgccactgcactccagcctgggtaacagtgagaccctgtctcaaaaaaataaaaaataaaaatgaaacttcagaatgtagtgattccctgttactttgattcaccaccaaatctgactttctggagataaaatgtccagtaaggttgctgggaattagtaatgataccaattgccttccttttctatattaacccccatttttttttttgaggcttgagaaagtggggaaaagagaagggagaaagcatattatgaagtactaattctttgacttgactgcctgttgtgttgactgattttcaagcactactggtagattttttttcttcttaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcataaattttgtgtgtgttttattaaatattgcttttaagctgatcatttagtgggggagaggaagtgtctaaaagctggccatagctcgacttttgatcctttttcagagtgaaagggaggctaatgtcaccgaaattctcatgaagttaagactcactaggactagagagcaggcagtgtaacccatttccgttgctttagtgtgattggtgaacagtatactaattctccttgttaactagcatatataaatcaatcgagtcacacagaacaatataacatttgtcccattcatgtaaaggaaattgccttgcatgtttttccaagaaaacctacgtacaagactttgtaagtgtatttttttctttatatatttaaaacctctgaccttatgaaaggcagccagggaaggttttttgttttggtttggtttttgctgatttgcttagctccctccactccacccccacaggtttttttccagatagatttataactgttcctactaagcttgcagtagtgactggttatgttattgactgggtcttatgtggatgctagggtttttatgtaggttttcaatatatctattttgagagagccctggaggcacagaggtagggttgatatcgtgattttgtgtttgagtttctaaaaccttgatgtataaaccaaaagtaactcctagatgtaataagtactttttattcttgtaaatgatcttttcttggtgctatttttagcttcattaaatatgcacataccatataatttacccatttaaagtgtacaattcagtggtttatagtatatttataaacatagaacaccatcaccatcatcaattttagaacatgttcatcacctcaaaaagaaaccctatatgctttagctattactcccatttcctgtcttgccccactcccagccctaagcaactacgaacttattcataggtttctgattcaggactttcatatgaatggaatcataaaatagactgactcctttcacttagcatgttttcaaggttcatctgtgttgtagcatgtatcagtacttctttctagtgactatatttcgttgtatggctataccaaattttgtttatccatttgtggttggacatttgggctgtttccattttttagctattacaaataatgctaataaaattcatgtagaagttttatttctttggggtacatacctaagagtggaattgctaggtcatatggtaactctacatttaatcatttgaggaactgctagactgttttccaaaccagctgcaccattttacattcccaccagcagtgcacgagggttctgatttctcagcatcctttcaacactcatctgacttttgggggatgtttttattttctatgggtacataatagttgtacatatttatagggtacatgtgatattttggtataagcatacaatgtataatgaacttactgttttattctagctatccaagtgggtgtgaaatggtatctcattgtggttttgatttgcattctcttgataatgatgttaagcatctcttcatttgcttattagccatttgtgtatcttttttgaagaa

SEQ ID NO: 13806 - DNA, 17226 bp, Human
  misc_feature (1)...(17226): n = A,T,C or G
agtgctgggattacaggtgtgagccactgcacccggccaactccgtctcagaaaaaaaaaaaaaaaaaaaagagtctcactgcactaagcagaattatgtagtgaagagagaatgtatgcttgtctttgcttgctggtgaccttgtgctgcacccgcacctcggtgccttatctataagatggaggtgagggccaccttgaagcatggttcagaggtaaacctatgcaaaagtgccagcacaagtactggcagacaatcattactcagcagtgttagcaatcttttattgttcaccttaccaggtctttctaagcccaaagacctcagaattgagtccctccaactcaaggctttggtctgtgatgaggaaccagaggggcaggctgtggcagggcctgaccatcttccatgacttcaagcacaaagccaagagatatgctccaaagtcccataagatcccttttcacccttcctttagtggcctgtcccaagcatattcccctttccccatgaagtaaaacttatcctagaactacgtccttgaagattccaatatcaataaaaggccctcagtctggaattctgggatataactaaaaaggtcttcctactccctctccaaagccatatccacatcctgaatgatattagaagcttgcaagtgggtacatattacagacgccacactgacccctcccagccttcatcttttcagattccattctttgattctcaccccctgccccaccaaccctaccatgtggcagaagaggccggctcagtcaccagcactctcccccactcctggagtttaatctttttgcagggatctcttttctccaaaaagagatctgcacagggagtggctctctgaagccagttgagaacctgccctgctggatttacacaaactgaaatctcaaatgcccacagggtcagagaggtaaagtaaatgaattaagaaggggggcgtaattcagtggagaatggcagggactgtagtgaacaggagagcacacttcttatacaaatggcaagggcaactcacctctgccactgtgggcatcccagctcttcccattttcagaagaagccagaaatccaatttctttacaggtgaaatctcctggtttaaaaatgctcctttcgaaatattttaaaatataatgctctaaacacaaaagtctgcagccccctttccagcagcttgtggtcctggcctgtgccatgctttagtgccctaacgatgagccccagcaattcccagcgcctcctgcttctccaagtctggcctcttttcccctctgtaccgccgcttctccccactctccgcagctcggggtcactttctttactgatctcccctctcttctgggagaggcacttgctgaacatctttccgcccggagcctccccaggagctgcagaggggcagctggagagatgctttctgacgtagcatctcccacctttctccttggggaccctgaggaaggggacaagggctcgctctgcaggtcctcactgtaactggaaaaacacgacctcgccctcgggaaggctttctgtgcgcctcacctcaggatgagggtgggtgtaggggacacctcccagaaacccctaacctcccagtcggttaaagaagaggggatagggtcaagggatgcgacagagctgtgtggtttccggatgggaaacctcagtcgtttaggcacccctccgctcgagtcacttccgaagcagtcgattcttggggagaagcgctgcggaaaggggcgactccgatgcagatggccctgtcccggcgccccaggtcgtcgcgcgcgcagctgcggtagtcactgcgcctccccgcccccactcctggatgccccccttccctctcccggccagactctgagcaggagctccgcccccagcgcgccgccccagccccggcgccttaaaagccgggcgcaccgccccgccgcgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggtaagggccggggctgggcgtggggaggggtgccctgccctcttccgcgcgtaccctcttcctctggtaaaactgggccccaggacttaaggggagggcaaaagagaggagagaagagccgcggctggaggcgctggttaacaaaaaaccctggagtctttaatgttaattttagggaacgcccctcatttatgtccctgccccagcccttcaaacaaagaagcccttaaatttatttgaggttcgaaaacccaactctgcctgtctgtcagcaagcgggcctacacacaccggcgacccggagaacagtgccccacccaaagtaagactgagcccaacggggcaggttacgtgggcggtgctgtctcggctatctggcttgtttggttgactttgaaaagctttctgtgcgccctagaagttatttatggagtatggtctgcttcagggctgaaggaagaatgcgatcctgaactgggaagagtcctatcccattttcttgactttcgcgctccaaaaagtagagattgggagccaacaagctgagcgatgcttgagctagtagtaaccaccctgctctacccacctccccaacacacacacacacacgattcccttgtccaccagcacacacacacacacacacacacacacacacgattcccttgtccaccagctgacatttcctccttaagaaagcgttcgccggttggcaaaacgtgaaaggtcggggcgctgtccacggtgctgatctcgagttcttcccatctcagaaattatgtctctcctgtctcgtgtcccagttatgaatctctaggcaattaactgctttgattttttttttcctgcaacaccaacacatcagtcttggctacctgcaatcaaaggtcacctcatagacaacatcagttttggctttcatggatggcttagcactaaacaaaaaacacttaatttgctcagcagctgtgaggtcccacttgaaaattcctgttttgttagtatttttttcattgtaagtgcatgtgataagtcacagagatggtttttctttgttctagtgtatgtattttttccatatttccctgtcctctaagctcctgtgatggtattgattggctatttcttcccaacaaaggccactgtgtcttcagttttactatataagaaattctgggattatgaccgcaaatggcacagaggcaggagacagggtaaatggaaggtgtagaaaagaattggaatagtgtggttcggtttcaaggtacaataaaagctcctttgaatagaatgactataattcagaaacttgcaataattctagctaggattaaagtttacatttggtgagattaatagggcttggaacattggtaaaatagaaccaagaaaggaatgaaatctcaaaagtaacattttaatcagaagctaaagaattcttattgatgtgcaggtatttgctgtttgttacaataacttcctttgataaaggaaaaaagcctgcttggactgtttaggttagtttggtattgcattatcattcaaataagtacttccatttctgcctcaaaatccataacttgaacttttcattatgtaccctaacccctggatggcctgaattaatcacatttggctaattgagacttcatttttttcttctagaagcctccaagtacgagctaggtggtcttctggagggctagcccagtatttctacaaaaaaaggataacttactcagagctgccagctgaattgggcttctccattttctctgcttgttatagcccatacattctaagaagtagtgacagttttgcctggcttgtttgctgtaaaaggctttcatcattagacaatggtagcgtcatccagacatggtctacaggaaacaaacaaaaaacaacaacagagaaactgcagcatctgcagctctgcggtgctgcccccatcagcttgagcctttagagccacagaggacctgctgatgggagtggaagaggaggtcagacaacagagagctggttccctactccttgggacctaaggctaaggtggagctcaagtcttacctgcagatcctaacggcctgatgccacaagggtgtctctgactgttctaacaatcttagcagtgctgaccaaggtgaaaagcctccctttctacagtgagatttagccattgttttcttgccctctcatctcatccccacctttcactgcagtaatgggaggctgttctccttcttctgctacagagattagtggtagggccatttttcttttcaaacttggcaccctctatgaaacataggaaggccccattaaagtcccatcttctctgccccagatagctgatagcctatttaaggagagaaagcttcttacacttttgaaagggtaaaaaatgattcacggtgacacagtaagtacacaatagtggatgagagagtctgaatcaggcaagagaagagattaggaagagctaaggctattgtcttcaaaagccaaatgcaactcccctctgcataaaaagctgatggggtttccatttctgacatagggcaatgctggtgcctacatagccacttcggcaccattagagtcctagttctgttaaagatgtccaaagacattcttggagggtactcagggtctcagacctctactgtggtcagtcttggaaagttgaagctttccttgaaagaccttgctgaatgatcaagatcaccgcaggttaatgctctccagggagacaagccaagtcttctcttttttctccattatgagattggagtacagcctaattaaatagcaggaaggggctggccccttggagactggaggtgacagtggctgcatataaatccatagcttgatagatccatttctaaaattagctacatttgatcttttttaagctcttccacctggtttttgtttcattttgttttgtttgcccctccctatcttactgtattactgtcacctgggctaccatgatagcatctttatagaaaaaaatttaaactagtggatcctaaacccagtgacactctaaggtcaattgggggcttaaaaaaattatcaggcccactcccaaagatatggattcagcagttcacaggtagggcccgggaatatgcatttttcaataaaagtgctgcatcctgttggtcctcagactgactttggagtacattgatctaaaccacttcttccagtaaagtagtttacggagatacgtataatacaggattttcgagtgtggtggaggaaagaaaaagatggggacaaaggaaaggtaggagtgagaataaagcacgcatggtgaaccacaaataaaaatcctccgtccccactcaagttgattatgcagagcagtaattctaaatagcctctttcaatcagactgtggggcactcactactgcctccctgacccagggcccccaaacgtgctgaaatccacagctctgtcgttcttcttcaccactgcagatgttagtgtggccattcatttctcttactccacccggcatccttccagccacgggctgcgatgctcagacgagctaagacgatgctcagcgtttgtcttagctcctccaggagagaccccagctggagctgggcgtgccgctctccggttccctcaggctaagccggcagcagctgcgtggttgggggaggggacagactgcagcgctctgctcagatctcgagctggaggccatctttggcagggcttctgaagggcaatgcaagacacagcctgatgtggggaggagagcacaaacaaagagaccagacattgaagagcaatcaatggtcagaacacagcacacttccttctgaaaggagcaaagttgtgcttttctctacagtgatctgtaaaatagatatatgaaatctgcaacatagaagttcaaggaaatctcatctgtctagaactcagctccccaaccacctcttattcagaaaacacagctgtgaaacaaaaataatgttttaagcaaggacctaattaacctgctgatgagacatatcatctatctctaagccaaacattaggaacttggcacctctactgcccccagcctattcattcttaacacgatttcaaaatgcttttttatttggtttcaagactgcagcaagatggagaatggggaccactggagtcaggcattgttaagaatgagcagcagcagatccgttcatctttcagaacaaagaaaatcaatgagcatcaacactaatccaaacaccgcactttggggccatttagggtagaattaaacagcctgatatacctcgaatgacctaaaagatgtcaccgaattatttttaaaattgattattatcatgacccttaattgctgtggaaggtggcattatgtttagtgtcctgattgtgagtggtataagccactttagaaaggctttttattcaaaattgttattaaaaaaaaaaatctggtgctttaaggtatatgcctccaactatccaatattaaagtgttgttatatgttacttttcgtagttatctaaggggttggtaatagtgagggcttgtgattaatttgtctatatcatcaaaaggatagagggccatgtggtatgatattatcaagaataaaaatcactaacatttattgagttcttcctgtgtgccatgctgttctgatgcctactaatttaacagataatggactcatcatatattaatgtatatgtgagatatattaaattgaaatcctaatttgaggatctcagaacaccttagaaaaagagtaaacataactttccgtatgcagaagtagaagattggaaggaactaaaatgtagaaaactggctgaggtccaatggatgttagtggcagagcaaaaactgcaacccaagttcctgatgaaatcctcctcttatcttcatatagcattcctcctccttctttgcataatcatattttcttctttctcctttttccctcactctagactcttttccctcttaccacagtaatattgattctcttgtcagtagctagagggtctatgtcagtgattctatgtcagtagcagaattgattataacctcaaataggaactatcaggtaaaatttcttggtaaaaatctctttaaggcctcatgatctcttaacacactttgaaatatatgcatcacggtccagtataatacgtatttttcctactgactgtcattccttgttctgtacccatcagtcaattgagactcctctttgcagtattcctgtcaatatttatagaacaggtaggtggtatgaattttaattctgcaaattctcttgatttggaagtttgtaccccctgatgtctcagccctacctttcaccattgctttatcattctcacacaaggggagtttcaagggcctgtcaacacttactttcttgaggtttctgatatgtttatctgcatcactgtttctttttttttttttttttttgagatggagttttgctcttgttgcccaggctggagtgcaatggcacgatctcagctcactgcaacctctgcctcccaggttcaagtgattctcctacctcagcctccagagtagctgggattacaggcacacgccaccacgcccagctaatttttgtatttttagtagagaccatagtttcaccatgttggccagcatagtctcaatctcttgattgacctgaactcctgacctcaggtgatccacccgcctcagcctcccaaagtgctgggattacaggcatgagccaccatgcccggccctgcatgactgtttcttaaaaataacccccaatcattgtgtctttttttttttttttaagacggggtcttgctgtgtcgcccaggctggagcacagtggcgccatcatagctcacttcaacctccgcctaccgggctcgagcaattctctcagctcagcctcaagtgattcgcctgcctcagctacccaaagtgctgggatgccctagagatgttttcttgttatcgcaactgggagagggaagtatgtgcttctggcatctagccagggatgttactaaatatcccgcatttcacaataacaaataattagccagcctaaaacatcaacactgccaaagttgtaaaactctgttatagaggaaagcaacagaaaataaactagtataaaccagtaaattgccggggccggacactgtgactcatgcctgttatcccagccacctttgggaggctgaggcgggcggatcacgaggtaggagttcaagaccagcctggccaacatggtgaaaccccatctctactaaaaatacaaaaattagccaggtgtggtggtgcacacctgtaatcccagctannnnnnnnnnnnnnnnnnnngtgcacacctgtaatcccagctacttcaggtaggctgaggcaggagaattacttgaacccaggtggtggaggttgcagtgagctgagaattgcgccactgcactccagcctgggtaacagagcaagactccatctcggaaaaaaaaaaaaagaagaagataatttcatataatggtaagagctgagagcagggtggctgcattcaactgagtgctttttttctaatttgcacaaggttcctgcatgggccagtagctgctctggcttaaggtaaaataaagtgctgggttggtcgaggatggatacttaaattggatgcaaatgaagacctgtctgaggagaggacattatattttattttattttattttattttattttttgagatggagtttcattcttgttgtccaggctggagtgcaatggcacgatctcggctcactgcaacctccgcctcccagattcaaacaattctcctgcttcagcctccctagtagctgggattataggcatgcaccaccacgcccggctaatttttgtatttttagtagagacagagtttctccatattggtctggctggtctcgaactcccaaccccaggtgatcctcccgcctcagcctcccaaagtgctgggattacaggcatgagccatcgtgcctggcaggagaggacatttgaactgaatcttttttgagacagagttttgctcttgttgcccaagctggagtgcggtggtacgatctcagctcactgcaacctctgccttccagattcaagcgattctcctgcctcagcctcccaagtaggtgggattacaggcgcttgccactgcacacagctaatttttgtacttttagtagagacggggtttctccttgttggtctggctggtctcgaactcccgactccaggtgatcctcctacctcagcctcccaaagtgctgggattacaggcatgagccatcatgcctggcaggagaggacatttgaactgaatctttttttttttttttttgagatggagtttcgctcttgttgcccagctggaatgcagtggcgcgatctcgtctcactgcaacctccccctcctgggttcaagcgattctcctgcctcagcctcccaagtagctgggattacaggtgcatgccactgcacccagctaatttttgtatttttagtagagacggagttttgccatgttagccaggctagtcttgaactcctgatctcaggtgatctgcctgcctcagcctcccaaagtgctaggattacaggtgtgagccaccacacccgggtgaactgaatcttctatgacaaggagtcggccatgtaaagaccggcattttagatagaggaaataacaagcctgaagggcctgggacagcaatgaacttggtatagttaaggagtaaaagaaaagaccaggctgggcatggtggctcatacatgtaatctaagcactttaggaggtaaaggcaggagtgtctcttgaggccaggagttcaagaccagcctggacaacataatgagacctcatctttacaaaacaaaaatcttttttaactagccaggcatggtagtgtacacctgttagtcccaactgcttgggaggctgagacaggaagatcgcttgagcccaggaattttgaggctgcagtgagctgtgatcacaccactgtactccagcctaggcaacagagcaagaccttgtctcaaaaaaaaaaaaaaaaaaaaaaaaaagaattccttctggctgctcaaggactataaatatataaatataaagcgatttctcttccatgcctcggtgttttaaaaattctgtggagtatttctgctttctccttacctataatgtaaaatgctctcagtaaagtgactgattagcaggcttctaggaaatcatcaaaatgaatggaggcagagaggtcttcctggaaagctctctgtgctttccacattcggaattttctgaatctaagctgctaacctgaggctttgggttttggaaagcacatgctacaacagagttatttagcagcaacacaacaagcaagggagggatggtaagtgtaaaaaaaaaaaaaaatcatctccatgttcagttcagaactatatgccgtgtggctatcctgaaaagggcaggtgttcacttgccctctgggtaaaagttcccagtcctcaccatgagtccaaatctcctggggacctttatgaaaaaaatgcaaatgctgggaccccaccccagaaccagtgaatctggatctggactcagggacagacctggatataagcaagttataagttcattagatgattttaatgtgtagtcagggctgggaatccttgccttctggaaatcttgaggaatttcagctggtttggcctaactattttggatatgttacttttcaggatagcattgggcagctggagaatgatctgaggaacaccaagagtgagatggcacgccaccttcgggaataccaggacttgctcaatgtcaaaatggctcttgacattgagatagcagcttacaggtactgcaaaggacctgcttacccgagtaaatccagtcacctaggggcaatgctgcccaaataagtggatctagtctctctggcttctgactggtgagggagggaagaagggcatcactggcccctttcaggtgagctgactgctctgtccctctacttagatataatccagctccatctgactagtcccagagtattctgtgtacctctgaaaggatttaaggggataatgtgagtacacagaggttaaaataaaaacccatgagactcgtaactttaaaaatagggtttggggccaagtgcagtagctcactcctataatcccagcactttgggaggccaaggtgggtggatcacttgagatcaggagttcaagaccagcctggccaacatggtgaaacccagtctctactaaaaacacaaaaattggccaggcgtggtggcacacacctgcagtcccagctactctggaggctgaggcaagagaatcgcttgaacctgggaggtggaggttgcagtgagctgtgatcatgtcactgcactccagcctgggagacagtgagactctgtctaaaaaaaaaaaaaaaaaaaaaggataattaaaaactattaagagttatgagaaacatggtttggggccactcttttataagactgttttcgtcacgctgataaaaatctgttatctgaaacagtgtcattcactggtttttgttattgctggttctattccctttgtacccgtatacactgaaaaagtacaaatctcaaatccaggttgagtaagacagtttctaccacctttgtggacatctcacctccttatccctattgcagctaaggtgttacttaggaaaagtacttctccctagagctttgttgctaattgccaaaaatgggtgtgatgtggccaagtggagttgcaggttttcctcctggaatatatttgtgaacaggataggttttcctttgacaatgctttaaacatagctggtgctgaaggggggtgtgtgtgtgcgcatgcgtatgcacgtggtccaaccctttgagctttgaaattaaatatttattggtttcaatctcatgaagaaactccaaagtcctttggaatctctctcaaatgaatcaggattggagggttgagttctgggggggaaaagttattgacttcctaagagtttttctctgttgaatttacaggaaactgctggaaggcgaggagacacgttttagcaccagtgggttaagcatttcggggctgaatccacttcccaatccaagttacctgctcccacctagaatcctcagtgctacaacctccaaagtctcatccactgggctatcacttaagaaagaggaggaggaggaggaggcatctaaggtagcctctaagaaaacctcccagataggggaaagttttgaagaaatattagaggagacagtaatatctactaagaaaaccgagaaatcaaatatagaagaaaccaccatttcaagccaaaaaatataattccattgctttgaaaaagttaatgcttaagagggaatgatatgcatttgacttgttaaacagcctattcctgaactataacacctgccaccactataaaatgtcttcaaggcttcagtctcatatttagtattgaatacttacattctctaataagaaaaccaccccttagattgaagtaaactgcagtcctggagcaatcacagatgagttatctaagaatacagctttctgaccttcagctcacgcttcacagtgatcgatgattcaggtgcagaggaagtacaaactaaggtgctaaatctgcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatccctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaactattaaggatgtagcttttcacctttactttagaagcacagtaaatatcccaaactgtgatgaagccgaccttagatttagtagtgtaagctagaagaagtgagtgtttctatgagtggaaaaagccaaggtgtcatttatgtgtcagttcatttgtggtgatatagaattagctttttcatccccttacccttagaatccacgtattccccttcccactagcctaggtcataaagaggcgttgctttcactctcctatgccttttacgagtgctaagtgtaggatattttgtcaccagaacacaatgctaccgccccaaagtaaaagaaaccacttctggtcaatcaacactaccagcgtatatataagaaagacatctttctcttttctaaaagacttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgtgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttgaaaaatacttttccttacctttaccccatccctgtctttactcctcacacttactgtaagacattagtaacataataaattaaaagtcacacgaatctcaccaacataattcgtgttctgtggttcctgccctttcactgagagaagcactgtttgggttcagagtcagtctggctctgactgatttgtatcttctctttttagtgagccaccttaattgccatgaacttatttatagaagaaagatattggccaagcgtggtggctcatgcctggaatcccaacactttgggaggccaaggtgggggtggtggggcagatggcctgatcccaggagttcgagaccagcctgggcaacatagggagacctcatctctcaaaaaaatacaaaaattagccaactgtggtggctcctgtagtcccagctactggggagctgaggtgggaggatcacttcagcccgggaggtggatgctgcagtgagttgagatcacgccactgcactccagcttgggcaacagagtgagaccctatctcaaaaaaaagaagagtaacttacagagttgaaaaatgattaattcagaataatagataacatggaaaatgttcagaatcaaagcagagaggtcaagagaaggaaagcaagtgacatcaactgttacctaaacaagacaacaaaatgaatccaagagatgaggggaaagccttcctgcagcatgtgctaatgatatcccatatgactttcagattcattagacaattatatcccctgcatccagagacttcataatagctaaactttattcagtacctatttactatgtgtcagacactatatgagctagtaaacagaattgtataaacctcacaactactcgttaggtatagtatttgtatccccattttacaaatgaagaagtagaacctcagaataacaaggttaataccctggtctgatatcacacaggaagtggcagagctgagctttggacccttgtcttctgtctgactctacaatacttgcttttcttcccttttttttttttttttttttaatgagatggagtcttgctctgttgttcaggctggagtgcagtggcatgatttcggctcactgcaacctccacctcctgggttcaagcgattctccttcctcagcctcccatgtagctggaactacaggtgtgtgccaccacgcccagctaatttttgtattttcagtggagacggggtttcatcatgttggccaggctggtctcgacctcctgacctcaaatgatccacccgcctcggcctcccaaagtactgggattacaggcgggagccaccacacctggcccttatgtttcctttctacataaatccccttgctgaagggagtagaagtctttctttttatcttgttccacctctttctcaccatgttttacttaaggtttctctgtcccagaaaacttttgcaacaccaaatcctccaggcaaactgctgcactcgcagacttcctcagccgctgccttcctgcattgccaggaggtggtggtatctcaaaactggactttgggcccaggcaaccacaaatcacctctgcttctgccaaaaattacatagacttgggtactcgttttctattaaaaaaaaaaaaaaaagggaggtggggtgggctttcttataatttagcaaaggaattctgtagcttcccatcaaggggccagaaaatgagggcgtattacagaagggacaattctacaagaggtggtcaatccagggcacttagaattcattctaccgccttggctatcaaggcaaaatctgaacaactgtctggaggctacagcccaaagtttagctccagagttaatgtaagtcacaaataattgtggggataaacttctagaacttacttgtgaactcgaacagaggaccagtgccaccattaatggctctaaggacaaacatgaaatagcttttaaaatgtatttaaggtcatacgcggtggttcacgcccgtaatcctggcactttgggaggctgaggcaggtgaatcacttgaggtcaagagttcagggccagcctggccaacatggtgaaactccatttctac

SEQ ID NO: 13807 - DNA, 168971 bp, Human
  misc_feature (1)...(168971): n = A,T,C or G
tttttctatcgttgaaatgaaacaaacaagtttgctttcagagctacagaaatgcccaactgttaggaaaaaaaaaacaaaaaaccgttttccactggccgcttgcctctcttatccccatgcaaccttgcctattggcccctttccctaggagagcccctggggctgtctgatggaactgattgtaaaactattttgtgcagtaaaaaagtcgtttcttcaaaatctgagaccacccagaacatgcccaatctttggcaaatatcgactggtttcctcagtatttgactagctgtacaccgagtaactgtcccgggtttctgggtctttatctgagaagaaatgagggggaaatgtttcagaagatgaaaaaaggaagaaaacctctcatccaaaatctgttcaaaattcattttgtgcgtttcgaagggggaggacaggagaatttagtgcaaagacggcctccaccaaacgaaaccgtccaacatttgcaaaagcttttaaaataaactgctcagggatcaggggtttgctggaaactcccggtcgcttgaagccctgtccctccactccgggcaccctggcctccccagggtgggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgcgggtttattccgacccactaccacatcgcgtttcctgaggtaacccggcctcggctctgcggccccagcggctggagagccacggagaaggcgggctacgggcgacaagatggagagccggcccgagagggacagaggccgcgctggcagcgagctggggggcccacctgaccgtcctgcgggcagcccggccccgcgctcccattgacaaggaggtccgcgccgccggcgcgtgggggcggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccaccccaccctctgtcgggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggtaaggaccgccgctgctacccccatcccccgaccccggccactccgcaccccctgccaccagctcccccaccccactcgcgcccgggagacctggtccccaagttggcaccaccatgtgcccaggatcgcccaccccctcgcatgccttagtccccccctccccctgttcccttaagctgacactcaccagtttttccccactgtctgtgtcccaacaggggctggagaatcaggaaaaagcaccattgtgaagcagatgaagtaagtccctgtggcattgggattcgtacttttattaagaataatttttaaatcgtttttattacattgcttactccacattgctctccaggcctgttttttaattcgtgcacacacacacacacacacacacacccctatatttgactcccctcccccactccctacgttggttctgggtcctccaccctaactcctgggtgggtgttttttgggagggggaaggggagcgcctgtagttgtatgaatgacagtgtccgccatattgatcagaacatcacactattggcatgattatgatcattactcttgcttgtggaatattttctgtgtctcactgcctccatttctgtctgtgtctctgtttcattctgtctctatttctttctcctcttccctccatacctccctatcccccaaggtccgtaatcccacttccccctgctcttttcctggggcagtgattttgaacttggctaacatggaggggacccagccctagactggggtggaggatcaagtgtctgctgttcatgcgtttggtgctgaattggaggctgtggtttctacatcccctcgcaccccctcccccgcaaaaaaagagggccagggttaggggaggggtcgtgtgctaggggaaggagtgggtttccaaacgtaggtgacgggcacagttttatccaaggtagaggtggaagggggagggaagctgcctgtgaggctgaatgtccgccccttgctgcccccagctcctctcctcccccaccctcccagcattgctctcctgacacccgcagttttcgttcgctccgtggcctttatcagtgtatttatttacactctgcataggccgtgttccatgtaatctacccacaatgcggatttcaggccccacttgccgccgcccccttctgccttagctatcagtttcccctcctaattaactgggggtggatttgagtgatggttgaaaattaaaacaaaatgggatattccttcccttccacactttctcaataaggagcctcgcccctcctttccacttgcaggctcgcttcttgccctatccactcggcagttcctggtgatcccacaggcaggtttgcttggggagggggtggccggcagcgaaggggtgtgcgccctccgggcctcctgtttcggttggcctgtcagttcgagacggaggagttcgtttagaccgtttagcgaagattccacgtcgctttgctgtgacaccttcgtgcacacacagctcctaattaggggttgctgtgcagtaaacaaaaatgattatttttcaacttgacacaatagccgaaataattgcatcgcgtagggaaacaatggaaaataaaaacccctttcgtgggaaggtgggagtgggagacgaagcatgcttgcggtttcagaaccaagatgcaaaaaatcttggatgtgtaacaggcatgacaagcgggttctaggcggcgccatgatggtagggagtagcgactcggagacaattttcccatctgcttgacatgttcttatttttgttcgagagctccctggggctttcttcgcagagccccccttggctcgccgcacccttctgagccaggggtaatttagcttggggcttctcttgagcttgtgcaacccaaattgatggggaggcggggcctggggaattgccctttgcaacaaggtgcatgttgcatctgtctggagcccttgcagatctgtaaatgcaagccgcgccacccctttctcccgaggggggacgttttaaaacttcagaagtctgtaatcagcagtggcggactcggagcccagtagaagccccagccacctgagctggatgaggtttcaggcgttgcaagtggtggacagcgcccagccgaggccggaaaagtcgatggggctcagttcggcgacgctcggctaggttcggtgcggtctgggcgcggggctcggagggagtcggcggtgttcggagccgagtcggtgctccggcggagagagccgagccgcttcggagggggtcgaaagcattcggaaatactcgggggaggggagtgcgcaggaggggaaggaggagggggagaggccagagtctgcaaattaactttgcatccgccaaagcaactgcttttcctgaacatgccccataaattaggttgatttaatgagaagtttaaaaatatatactgaatcccccaaaggggtgcctcgcctttttttattcaaagagagctgagctctctgaggaaataggtgtgccactttaggatgaaaattcctaattatgtactgggcaggaaatcttaaatgaaggctggatgtagacttccccaggaaagtcctctgtgtcttgtatttggttacaccgaggaggggggaaaatgaagtgagtgatgtttgagattgttaaatcagaaatcagagcatttcttctctttccctttacttctcctttttttttttttttttcaaccttacaggacacctttttcaagaaaaatgtcaggaaaacagattttgtaggtaaaacaattttttttttaaagcacaatacaccaactctctttaggaagtagggtaggtctgttcaaaaggtccatcacaaaagtttctggttcctggtttgccacaagggaccctggcgtcctgtcctcctgaagcattcatgaatggcagttttccctgtgagccttccagcttggcttgaaatacatcagatcagggccttgtgccaagctgaatgcaggacttgttttgttaaccacaaaatgtgggattggtgtcactgtatcctagtaacaaatttttttgagtcctcccttgcagagatggtttttgagatggccacttgactgagagtcactttgagtcaggagaattctactgtggatggggccaggcccgaaaatctaggtggcatttatagaaagcagtttccaacttccttgtgcaatacaattggtgaccaacctatcaggccatatgtacaggttaattaggaagctgtgttgtttcacctggacagatgaaattcagcagaaagccctctttaggttacaccctgtgataacccagtgatttcctaatggggggctgcagtctaatagctcagcacattggattgagaggaagaatgtggatattcagacatcactgaataaaactccttttatttagcatttccagaagagcaaagagtcattccattgagcctgtgttctcatccttgttgtggtgtgctaatttgaagaaactggcttccatatatttccatagtaactgaagtgaaataataaaggaccggctggcaattgctgtttagaacaaagggttaacatcttcatcagcctaggaacattgcagagatactgacataaagttcttctgcttgataagtgttgtaaggggaaacgtgcatctgcttaagagataccagtttagagtgtcatttgaaaagcctgattctcagtacttatattaaaatttttatttgaacatagtgttttgggttcccccccccttgtgtgtgtgattgtgaattcgtgtgagggagctctgtgtcagacaatccaaaatatttcagtactgagaaataaacagtgataattgagacagcacaaatataattttatacataccatgtgtgagtaatcagtgactctttttttgcatggcattttaaataattttgcttgttagggggttgtgacctcacctgtgatacagcctcatcattttgtagtcagtcaataagactctgagttattcagactaatcagaaaatttttaaagaattgtcaattttatttaattgccaaacccttacaaagaaatcccataacaagttgtaattttatgaggtgtagaattgacagaatatcactttaagtgacttcccagttctgaacaaatagtgacacccacttggaccatgtacctggtgaaaatgtaaaatggactgcggaattgctctgggagccacagtttgccctcattcgaggtgctgaattttctgtaatgttgagttcaggctatctgtctctggagcattaagtggaatttttagaaagggagttcgaaggtggccatgaggcattgcatgctagctggtagtctttaccgaaatgggcacaataaaatcgagcactttggttgtgcgtccattcccacagtacctgcttagtgccattttaaaacaaatttaagaatttgcctgatgaagatgtcattgctcatacaaatattccagcctgacaagtgggatgtgattcagagaacagaccctaccctgtcaggaaaggctgtcttaaaaggtcacctgtcaccaaaaagctgatggctttttcctcccagctgaccctgactttgtaattagggtatctactgtttggtatgggttcagggcaagcttgcagtcttcacttgatcttagccaaaaggctgagaagcagtcaagcttgcattctttcagcacaatgctcttcagcacctactaaatgacaggcattaatggaggtgaatagcaacctacagccattactccatgaaagtgcgtccgtctaaaaggacatttcccacactggcccccagggtcgcacgttgggttagtattctactgagagccactcttctagatttgtagacttgttatttctgcagtcatctcaatggctgctttgcctccctcccttcgtccctctctatgtttattcaaatggatgcaccttgctctctggagacagcaagagtgcgaacggaatgtcagatcaagtagcagatgagttctcttttcctgatggatggtgctctctccctccttactgtgcactgagctgtaaataccagcagaccttcctgccagaagagtggcaaatagtccacccgatctcctcaggagtcagctgtggaattcttgagcctgggttacctattggattctaaagtagaacctatatgcttgttgaaaagggttgttgccagttagattaaatgggtgaagcttcatgagaaccaacatggctggaaaagaatgcagaacgtctgttctatgtgtgaacagggctggattagatttacgatgctcagagtgggagtgtgtcttgtttcttttaacacatggaactcgcagattattttgtgcttcttcacatgccacatctgctaaagataggacaagatcactcatgtttttcagctgctcacaataccctatctccgttaacactggagatttaatatgagtagaatgaggccctatttttccgatatgtgctcagcccatctggatactgggacttgactccctgtctcctagggtgttttcattctcatttcttatggagccagacaggccattatcaccagaatacatcttgatctgaaagacaacagaaaagctggtgaaggggtgattccaaactgaaaaaaacaaaacaaaacaaaaaaaaccacattttggaaagagttaccctcagaattgacactaatagagaaaacttttgattctgaaaaaagaaagtgtgcctgtttgtacatacccacagagtgtgggtttacaaatggcagatgttgagaagagcactcacctcactttcttactgattgcatcatcttaaaaagcttgaagatgctcaaatgaactccatcctaagaatttcttcaaatctgtgtcacattcttattttcttccatccctctcattcacacacagcattggtagaaaggaagctgtccaacagatctgtgattagcactgaggggaaggagaggagagagcagtggcttgttaactggttcagataaataggtagtttcttgtgtttagagaagcagtttagcatgcttctctaaaattgagagttggttaagagcatagactctgcaaacaggctgcctggcttcaaatcttggctctactgctaactaaatatgtgaccttacacaaggcccataacatttggtgcctcagtttccttacctgtaaaatgggactgataatgaaaataactactaataggattgtggagagcatgaaatgagttaacatatgaaatgtgctttgagtagtgtctagaatgtagaaatcattatacaaatgttagctctagtttttattcctttgattagtgggtgttcccttcccatgtggagttctcttgtcaagtaagtatgtgggacttagccaccctgagaagcagaaggggggtgctgtggttcatgttcatggcttcttccccttgcctgctctgcagcaccagttatataacaaactgtgttgtcataactgatgtgacatttttgatggcgcagctgcttcagcccaagagctggggtgacatttcaaagggtgggaaagagcactgaaccaggagtccaggtcagtagctctgcctctgcccctccgagggctcggtttcctgaaagagttggaccagggctaccccaggctcccttcctgttgtcaacggtgtatgaaattgggaattccctttgttttcagggtcttgatgttctcaatattaaagcatgaattatggttttatcccatgggggtgtagggtatccatgaaagttcttttaagactaagttaattgcagaatagcaacctcagccacagagctttgtcagccaggaaatttgtagttctgagagtcaatttgagaaaaacacctctaaccaaacttttcatgcagacatggttcttaaaccaaagaggaggatctgaaagtatctcattagtaagaaacaggatgtttctgggaggagagagccagtgacattagaagagaagtggtttttccgtggcttccaggatgctcagaagtggagacagccctagcgttcaccagaaatggctgcatatgaagaaacttgcctgggttaaggtgcctaaaacccagggagcagagagatttgcagactagtaaaaggggaggctcaggagaactgtattttaattttgattcactctctcatttaactttgggcagatcatttggccaccctgggcctcaatttgttcatctgttaattgggatgtgggttttcaccatagaatttctcagggctctttcgggtttccagctctaagatgcagtaaatgcaaagagaaacttagaagcctgaaaggcggtggggaatagtgggagtatttaccacccacagcttttatctgctgagccatctttagttctaattttctttacagagaagaggaaaaacattgtgcttttcatagcaccaaaaaattaaagtaaaataaaatcttgcaaggctaatagttggtgccctgaatttggccccttactctcttgatttgtcaaccatcctagaaataagtagaatggagaaaagagaaagggagaataatacataagactaggatttcatagctaacaatttaccttggattctctgcctgtgtcttagccaacagataggttttctgtagaatattgttacttatgagaatagcttctccatgctttaaaattgatcctggggtcacctgaccccagggtctcagagcactaatgcatattgcacattgtgaattaattaggtgtttatttgtctgtatcccttgctagcctgggtgtcccttcccaccagggctccctgaagcaaggatgttacttatttttgctcatagtacagcaccatgcccaatgcctggcacaaaggaggtcttaataaacgttagttaaagaaaaggaagaatacgaggtatataaggaatgaaccttattattctccataaaccaaaataatcatgttgaaagcttttggtggccatggaatgtgttcatcattttcaatctattatattcatttgtttatcaacctgtgagcaaatatagtcatcaattccattttacagatgaggaagtgaggttcaaagaagtaaggtggcttgctcaaggccacacagcttagtaggtgacagtgttgtattcagacaatgatttgtctaattctaaaacctgtgttcttttcgttgtaactccacacctttcttactagaccacccccagtatgggcagtagagacctggcagtctacgacctcacacccagatgttgatggtgccagctgtggttgaggtcagtggctgagagaatagaaagtgcctaattggtgctgagttccttctggaggtggtagtaatggtcatcatatatcacattgatttggataccagagtattccctagcaaccatctggacaggccttgaaatgatttttcattaccgcctcaaaaatgggggccattttcagattgcaacagagagaaggctctggctttggtggaggcaggtgtcttggagaactatggaaagacaggatggtaggggatccatccatctgtccatccataagcatttatgattgcctattttgtgggtagcatacacacagtgtcatggaagtagagaggaaggcctcagtccttgtcctgaaggaactcatggtctggagggagctacacaaaaaagactcttgcacttcaggtaggaagggccacaatgtctgtatacacagtgtgctatggtagaacagaaggcaccttctctaggcaggaagttcagggaagacagccaagagacaatggcatgtgaactgagcctttaaaacaagtggtagttcaccaggtcgaaaaaaaggaatgccaggcagagggactggcatgtgtaaaggcattaagatgtcaccacatggaacatgctaggagtgtaaaatagtttgatttgactagagcaaaatatgtaagaggagtgttaagaaatgaggaatgaaagattggacagaaaccagatcatgaaaggccttatctattgtgctaaggactttggattttattctgaagataatgagatgccacctgagggttggcattagatcacctacgtagactggaggagatcagctctggaggttgggagaccagatggaaagttacttctgtgacccagttgggaaaaagattaagaactaagttaaagcagtggtagtgtgggtggggaaaggaaacagattcaagagatatttgggcagtggaataattgaacttatttgttgatcagttggaagagcattgaggaggagataaattttaatgagtatggacaaaaatgagtccaggattcctggtttgggctactggtggatggtagttaaatgcaggaggaagagagaagacttggggagaaaagtgatgactgcatttggtcatgttgacgattcttgtggatcatctgagtgcagctcctggtagtgggtcagataggacacacctggggagaggggtcaatttgaaattctgtggtgcttttgagtggcgagagccatagaagttggtaaccttagtaggctgagtgagaaggagagagaaggcaggcatgcgtctcccatcacacacacattccagctccaggaaatgagaataatttaggaagaggaacctgtgagggaaactgagaaggggtgatctgagaaatgaaaaagaaaacccaaggcagagtagcatcatgaaagccaaggaagaaaagactttcaagggcaggaagtggttagttgagtcagatatttcagtagacaaataagatgaagattggcaggtgtccatggagtctggcaagttgttggtgaccttggcaagagcagtttcaatagactggtgggagaaaagccaaattgcagtggagttaagaaatgtgtgggattgaggaaatccatgaagaacccccctcccagcccaaaagaaatgtgggctacagaaaaaaaggagtgagaggtagggagggagagagccctcctggaagggctttgcttttattgttcatttctacatgggagtagctggatccattgagaagttatccagatccctgatgaatggaaaagttgaaggtataggaaggaggaagtggtagaaggaacacaaccccttaggggatgggtagcttgagcttgacatgaacgtgcatctccttccctaagacagacaggaggacagtaaggatgggaagtctgtagagaaattctagggcataatgatgaggacaggaagttgagggagctcctgccttagcatttcttttctctgtgaagtgagaagaattaaaaagcagctgtgcttatttactggagcaccaaagaccaataacatttattctattaaaaccactcatttattcatttatctaatatttgtctcacacctattatgcattaggcactgttctgggtgctcggagtgtcagtgatgaacaaatcaagtcccagaggaaccgggtaataacctcatacacaaacaatcggacgcagtaattgcagactgaaagttttttctggggttacacctttaggggaggcctcgtactgatcacagagggatccaatttctgccttcagagagttgcaccagttggaggagacaaattcaattctcaaaggtgcagaagaagcagtgatggaatttaatttggacacaggctcaggattaagctgggagggaactgggtggagaagtgaaagttgcacagacactgttgttttactccaccgagctttactcatcacaggctgctccagtggggctgccagtcactgccccctgctgcttgaagagagaagtaggttcatgactcaggccttgccattcacagcatctcattcctctggccacagtgattggcccagggatgggcatgtgactcaagtgaggccaatcatcatccttctctggaattttatagtcactatgagaaaaaagctcttttccctgggatcccagcaaggtcctcactgggctggaatgatgaaagcttgagctagctgtctgtggccatgtttccacatctcaattgccctctgcaaggaggaagcgtgcttatcatgggagagactgaggctttgggagactggaggacaaaagagagaatggagagaagaaacacaaagagagagggagccagaaagacatctgatggtgatactggtatctctgaagcaggttctatggagctgacagttatgtgaatcaataaatctcttcttttacacaaactaatttgagctgggattctgtcccttatgaccaagatcacgctgacgaaaagcacaaggccttccaggatctgaacaactagtatgagctaaagtacagaagtaggcctggaacattcaggacaccaccagggagtagtgggcaggctcatgtggctgaagagctggggtttgtgggaatgtgaagagaagtgactggaaaggaagagtagggctagattatagggttccctgatagtttttctaaggggtatatagggtgccaagtcaggagagcctaccagtaggaggccagagatgaggctttagagcaaagagatttctgtagtctgacctaaggaattggtaggaaaggcaatgagaagttggatgggggagagattttggaggcaggagagatgacccctggtgtctagttgaatgaacatgagaaggagagagtatatcagagaactcctccccattttgaacctgtgagatgggatttagttatgccatcaagttaggaaacacaggagcagggaagagatagcagagaggatatggcaggtgaacccataagcatgaatttcaggtccttacagggtaacaggaaatgttgagttgtttgcttgggaggtagttctggcatttagaagagagatctgggctagaaggaaaagtgggcttagctgcccttgtggtcgggccatgagagtggatgtggtgtccctggggtgagcatacatatggccaggagagggagggcccagggaaggggtgcaccattgtggcagtgaggaagggaaccttccttcagtagacccacaggtagctccaactggcaaaaggagccagagagcagagtagcaggaggcaaacccagagcgccctgccacagtggatccccaggaagggaatgtgcttcaggaattctgggtggcgagcagggttctgtttcatggcattgccaagttagatagtactgaggaaagaccattgtatttgaagctattgcgggcttttaaaagtgcagtttcagtggagggagagggataaaagccaaactcaaaaaatttttatggtagaaataggtctggactgggagtcaagaacccaagttctcatcccagctctgttcctgtttagcttgatggtccccaggcgagttccttaacttccttaggacttagtatcctcacatataaaattaggaaactggatcgcgtgatctataagcttctactcaagtcttgaggtcataatttatatctttctctccagcaaaacagatgttcttgtggcaaaggaattcccctccttctcccttggccacccccaactgacataataaattataaaaaaaattaagctttcagaactctagtgctaattgagaaagaaaactgggacatcagctcagggaattgtggacaccagtgcatgttgtgtccatatgtactctccactgagaatgtggggccctgcgatgtaggaatttgtcttgtaatactgtcagagttatgagacctggatggtttgacgctgttccacagggagaagtgctgaaggtggttccacagtacaaagacaaaacaactcctggggtccctctctgaattcacgtggaaagaaaaaggaaggctgtgaatctgagctggctgtgtgcaggagctccagccagggcagacaacaagagctggagggacccatgcattaggagatggacaagcctgagggcaccagtgggcaagggcaggagaggcacccactctatctccctggtactctgtggcctcattggtgggaggaccttggggaagggatggtagaatggtgatgtgtggagagcctagttctgagctgtggccattcttcctactcttaattccccatgtgctatggaaggcctgtttcttctttgaatcctttccttagagtttcgaccacatggcccttgctattccctgtcttctttggtgtgggtttgttcattctgtgaaggccattggaagaccagccatagtttggcactttctcagtttctaggaatagattctttactaagatagacaagctccctgcctcaaggaccttacagttttagagaaggaagatggtacaggaataattgaaggcaaaggtcatttcatatagtcatgcgttctaaaggaggaaactgggattaaataatggagagggattggaggacatgaggggtaaaaaagcagatcaggaaagatctgaggaagagggaacagcagatccaaaggctgtggcacagacatgagcagaaagaaggccagtggagctctagaccacagggagggaaaaatagcacacaatgaggttaaagaggcagttagggccgggcgtggtgcctcacacctgtaatcccagcactttgggaggctgaggtgggcggatcacaaagtcaggagatccagaccatcctggataacacggtgaaacctcgtctttacaaaaaatacaaaacattagctgggcatggtggtgggcgactgtagtcacagctactcgggaggctgaggcaggagaatcacttgaacccggtaggcagaggttgcagtgagccgagatcacgccattgcactccagcctgggcgacagcgtgagactccatctcaatttaaaaaaaaaaaaaaaaaaaaagaggcagttaggagccaatgttcaaggaaggcctgttggctatggaaggacatttgggtttcattttgaatgccgtgggagattgacaacttgacctgacttatacattaaaagatacctctgcatcctggaaaaggcaaaaccacagggatggaaattacatcagtggtttccagggaattgggtgtggatggagcttgcaaaggggcacaagggaacttttgtgggtgatgtaaatattttctctcgtaattgcggtgatggttacactactgtgtatgtttatcgaaagtcatcaaactgtatacctaaaaagggtgaattttactctaagtaaattatacttcaataaacctgacttacaaaatgcatattttttaatcaaaaaaagaattgcagtaaggcttaacagaatccctctggccgtcctgtggaaggtacatggcagggagcaagtctggaaacagggacggttgcacagtccaagccatacgccccttcaatgctgtgcttacaattcagcctgtattatttgctgatcccagtggcttccttacaccagcttattgatgtgtgttcctagttttcctgtttacctagcttttccttcaaaactggtttgaaacctcagtgtggatagaaaccatctgcttcttttgtatgtgcccatgggagatggcttattacatattactctccttacatttaagtagtctttaacatttgcaagcaattcatgatctcctttgagccttacaacatcaggctgcacatatgttaccatgttcccattttacagatgaagaaactgaggcgaaaataattcagtatagcagtgtgaaagaagcatgaactttggagattttggctttgccatttgttggctatcagtgtgatttgggaaaattattcagtctctctgaacctcagtttactgattgttaagaaaagaccaaaaaaataaataaataaacacactgcagatacactgtgaggagtaagtgagataacacagctaaaagcaggtagcagataattgaaattccctaaatggtagctatttgtatcatttttgctatcagagaaaacatgatttatttaaggtgatgtggccagtacgtggtagaactagagcctagtttttctgattctaggtgtgtttctctttccatcacaccactcagaacattcttaattgttatcaattaattgttccagggctaactactttttaccaacttggatgcttaaatacaattgttgattattcagcaaatatttattgagcactcaccatatgttcaacactgttgttgacacaggatataatagtaagtcaaaataggctccacctctgcccctacaggtaataaagcagaatggtgagggagcacctacctcggtgtggggtctgggaagacttcctaggggaggtaacattgacactgtctttaaaagaaacatttttgttgtgatgtagatcaatatacatgcaaaatgtacattaatcttatatgttttacagatttttagaaagcaagcactcaggtaaccatcactaggtaaaaaagtaggacattgctagtgcccaagaatgtccctaaatatccctttttgatcacagctccctgcctcactccttactaccttaactttcgtggtaagtttcatgggtccttgcctttctttagagtttaccacctacatatgcatcctctaatcatttagtctagtttctcctggttttgatataattggaatcatgctatttgtatcttttcttcagtattacattcataatatcccagttgtatgtagctggagttgattttcattgctatatagtattctatggtattcattttatgaatatttttaattttcctatgtagcattcataaatattagtgaatattcatgaatatgctatatattattcttcacctcattgctatatagtattctttgttacacaccagctgtgactatactgtaatttatttatccattctactgttgatgtggcattttatcattttgagtttggagcagttataaaagatgctgctatcaatgtgtgtgtgtgtgtgtgtgtgtgtgtgcgcgcgcgcgcacgtgtgtgtgtgtgtattctggggcacatgcatttgtgaagggttctttgaagaggaattgctgggaatcttcaactgcattagataatatacagtgttttccgaagtggtaattccatctttatattcacggtagcagaaagaatttctgttattataaattcttgctgccaatatttggtactgtccaattttttcaattttaccaaaccaataggcaagtagtagatctcattgtggttttactttacatagtctagattgctaaagaggttgaacagcttttcctatatttattggacatttggatttcctcttttgtgaggtacctgttcttttgccactttttaaattaggttgtaattttctcattaatttgtaggtgttctttatgtgttgtaaatactagtcttttttgtttttttgttttttgttttcattgcaaatattacctcccattccctggcttgtcttttcactttgttaatggtgttttatgctaaacagatatttctcttttttaatgtagtcattctttcagtctccctctttttggttagtgttttttttgtgtgtgtcctatttaagaagaagtctttccttatcttgaagctcaaaggctaccctctatttcccgcctctttaaaaagctttggagatttattttattttctatttaactgtttaatttacttgtagttgattcttgtgtatgatgtaagttgttttttctctaatggatactcattggttccagctttctgtcactgtttctgtggggccaccactgtcataggttaaacatgtatgtgataagcatgcagggacctgtttcttagctcatatagcatcccattggactctattcttatgacagtgccacactgtcttgattatgatagctttgtaacatgtcttgatatttggtttagcaaatcccactccccttggtcttcatgagtgtcttggctgttctcagctctttgtgcttgcatgtaaatgttagaatcagtttttgtgatgcatgcacacacacacatccctattaggatattaggatctgttgattagtatttattcgaatccactactctgagtagaattgacatctctaaatcttgagtcttcctgatccatgagcatgatatgtttcaccattatttatcataatttcttttaagaaatatttataatttttcccatgaagagctcatgtactttttgttagatttataactagatacttaatgtttacaatggtcttgtaattgcttcttttttttaagagcagttttagattcacagcagaattgagaaaggggtacagaaaattcccatacgtccctccccacacacatgcccagcctcccccttatcagcagttctcaccagagggcacagttattccagttgatgaacctatactggcgcattataatcacccaaagttcatggtttaccttaggctttactcttggtggtgtacattctatgggtttggacaaatatgtaatgacatgtatccatcattttggtatcatacagagtattttcactgccttaaaaatcctctgtgctccacctgttctttgttcttcccccaactcctggctaccaggaatgtttttactgtcgctatagctttgccttttccagaaatgtcacatagttggaatcatacagttggactcaaaagacttctaatatgtagccttttcagattggctttttctcttagtaatatatatgtaaggcccctccatgtgttttcatggcttgacaacttattttcttttagcactgaataatattccactgtctggatataccacagttgtttatccatgcacctactggagaacatcttggttgcttccaagttttgggaattatgaataaacctgctgtaaacattcacgtgcaggtttttgtgtggacataagtttttaaatcctttgggtaaataccaaggagcacaattgctggattgtgtggtaagaacaggtttagttttgtaggaaactgccaaattgtcttccaaaatatatagatatatcatcttgcatttctaccagcaacaaatgcgagttcctgttgtctgcaacgtcaccagcatttggtgttgtccgtttttggattttgtccattctaatatgtatgttgtggtatctcgttgttagagaaatttggatttctctaatgataaatgatgcggagcatcttttcatatgcttatttgccatctgtatatctcctttggtgaggtgtctgttaagggctttggcccactttttaattgggtcatttgtgttcttattgttgaattttaagagttctttctatattttggataacagccttttatctggtcttttgcaaatattttctcctaacctgtggtttgtcttctcagtctctggttaattgcttcattttttgaattgcattttgtatctgtttctggtatatagaaatacagttgacttttgtgtattgatttttaaattgatccaccttaattgttgtataattctaatagttaatttgtagattctaaggcccagagaggggagtgatctgactaggttcctatggctagctagtagcagagcaagcatgaatgtggtcctatttctgctgacttccaaggagagaatattcaggaagggttagggaaagccaggtggggagtaggaaataacatttattgaacacctgttatttacaatgcttaatatgcagatcagcttaactctcattggaggcagattattgataacccctttttatagatgaggaaagtaagattcagagagatgatgaaataaacgtgttcaggcacatcactgaaagaacagtctacggttggaggagtgctgttgctctatcaagcatacaccagactacatgccttctgcatttgagcatagacacccccagaactccctgggcctcctacctccagctatgccgtcctccagggtcccctcccagcccagctctggggctgcctctattaaggctctgctagcatctctagacttgtgcaggcctggttactgtcaactcttgggttgagtttctgcccaaagttctgaggtcagtctccacccctgcccttctacatagttccctcccaaccaaggaaatgagttcacaacttgttgagttctaggaaccaaattaggagttgctctgggcatcttgtttcagtcgcgacttgaaaatgcggttgaggttttatgactgctttgttatacagtggcctagagagaatttatggtcgcagtgcttcccagcaccccctcccgcttctcgttgattgtccagagctggctgcatacaaggagagggtttgcttctgctggctgtgcaaaggcatggggaaatgctctgtgtgtgaacacagcccagcagtgctctattcagcgtgacaacttcctactttggaacacatggctcttcacagggtgactgtaaattatgcaactccagagtcaaagaatgaggaataatgggggaaaggaagggacaaactgcaaacttcagcctggatctgaaatgtgagtgtggagacccaggctgcttggcaattgatgggaggagagtcttcaacgactgagaaaaaccaggaagtcctgtcgggactacttgtgagagtggcttttactgtttaaaaaatgtaaatgttcttttcaaactctgtttatcaattcagggagagttttagaaacttggagggacatttacaaaagaaagtagtcacatgcgttaccaaaagtaattgaatgccatacatggtatgtaacctttgtcccgatggctccaactcgtccttttttattattgcttcatgctaaaaattggtgctcctaagggcaattgtacagattctcaccttctcctccacccgcaatggtcctggaatgcagtgaactctgcttcgataagctttgtggaatgttcctgtctcttggctgactgtcatctctcatgacttgctgctttcagtggtcccacctcaagcattattccccttctcttgttctgctctgaatctgcgatggcccagaaaactaaacgaccagatttgtcacaatagtgtgtagagcaagaatgaataggatataattgaggacctgaggaactcttctagaagtagagtgtttgtgctttagtgcttggacttgtctgcatttctgcctatctatgacacaggattaagtatgtaaaaatgaattggcagttactatacagatgtaagtgatggtgacaaggtcgctgttgtgctatgtgggtgctcagagttcttcattgtgcttgtccttcctggctcctggtagggtttcgattcacagaaattactggacaggtagcttccagataagagtgatgaactatcatttctgacaaaagatgttggacaggctgtggcagcaaggaggtgatcagaagactccctagagcacaggggatctggcaggctttttctataaaatgacatggatacacacagggtcaggctgcctgtgggcagagacgtccccaggagccctgcccggtggccagcaccacggacatctgctcacctgtggcagaactcggagtctcacagctaagccaggccagacccagttgctactttttggtcaagacccgctctaggaattcttccagggaagagggaatgtgaatttgtctgttttcagatatgtgtagcctttacacaaaagtgtttgaaattatttggttaaaatgctttccatcgaggttattctttctttcttcttttttttttcccactctgcagatatccattgagcttctactctgtaccgagcaccatcttaagtgttgtaactgagcaagacacacaaaatctctgccctcctggagtgttctgacattcttgttaggggagacaggcaataaataaggaaaatacatagtagtattatacatcagctggtgacaagtgctatggagaagaataaagcaggcaaggggcatgagcgggagggaatgttagttttggttttgggggtgtttttctgagatgggatggcggaggatgagtcttgccatgttgtcaaggctggttttgaactcctgagcttaagtgatcctcccaagtggctgagattacaggtgcacaccaccatgcatgccttgatattacagttttttaagtcgtcagggagggccatactagaagatgaaattggagaaaagccttgatggaggtgaaggagccagccatgtgcacttgggggaagagtgctccaggcagccagaaatagacagtacagaggctccaagtcccgagtctgcccgtgtgcaaaccacaaggaggtttatatgtctggagtcacaaaaaaaaactggaacaatgggtgccctcatggagtcagtagtttctctgggtgtggtctcactaaagacaggggcgggaaagaaatccccatcacagactcgtgtagacctgtgacttgtgggcattcagactgtgttattccgctgccaggcctagggcttgggggtggtgtcctgtggatgtgtgtgtgtatcctgacaaaggagggacatggaagggaaggatcccttccatgaatgaagggggttgactctggcataatctaggaagaattctaggaagactcagttatttctggttggtttacaggagacaaacactgaacatgttgggctgccttgccttgctggtctcctagtggaggaggctctcattgctggggcttcccgttggccctagctctgcatctgctctcccatatcagcattaccagaccatgagcactgaggctgtcacaggacaaggagcctggccccagacctcattcagggctgctgacccagctttgggctccaccgtagacgtgctcagtaagcaagcctggggtctaggggcagacacctgggagcagagtcacaggggcaggtttccccaagtgtagcctgaaagtttagtggtatacaaatacacactttattttaatgtgttttaggacaaaaggttcctaacacatcaaaaccatagttttacagataattattgcttaggatgaagttaaagtaaacaggacgtttttaaaaagacactaaaaatcatgtgggtggcacaaaaatcctatctaagtagtgctaacctcaagtctgccctcagcatgggagtaccaatttctgtctaggggttcccatctcttagggatgagaatgccttggaagaagtcctcctctgccatcctgggaacacagtagctgtccctctgtcccaaccccaagcctgtgagctgtccacaattctcacttcttcccaacacttgcgtaccgggtgtttctgtcccatggcctgtgcctggcctgggccccctcactgccatcacctcccagccttcctctgggtccggtgcataaagtctcctcagctgccttctagaaatgctgtttctgcccttcactgccatgctaagtcaccctctgcattgggtctgggcattggcttggcttggaggacataccatggtgtagtgcaccacactgatcctgagttggctccccctactacagaacgccttctccctggcacccaccacctcctgcctccatacccatagctggtggctgccaaagcatgcttcctcctctttctctgtagatctggcctccaagggccgctcaagtctcatctggtccatggggtgttcctctggaagctgaaccacactggtctctccagttctgtaattcttttacacaggatgtctgtaccccaccattaagagtttttatatgccctcaaggtcccatagagatgacttctttgtctatctgagtttcgtagacacacgagcaaacacacacatgcactactaccagaacagaatagtcttgctcaccatgagcctgacacagagctctgtgcgggagccaattgaagagaagcggtttcagcacaatgaagggtaccagcctggcttgaatcctggcagtgctaccttctagttttgtggccttgggcaactaggtttgaggatgatatgaaacagtgtagaaattactgagcccagtactaggaacataataagataattgtggttgttattgttcactaattggcaaacatttgctatatgtacgtttggttccttgtctaggctgtaaacctcctgtggattcttggggcacagtgaatattcagggtacatttacataataagtagagtggtccatttacattgctgtgggttctctcataaattggctgttaggtgtagaagtttttgcaagcttatatgaaacttcagtatacatacatgatatgtatcatttgtgtgtttggttcacagtgggttaagaattgttgagcttatcaaaccacagttctgtattgagtacttactgtatacaggtgagagggaagtgtatacccccactctcttcctgatgagaagactgctgtctctgactgtcccatctcctttctccacagcttggatgtgtacctctgctccctatctctacagatcttggagtttttagctctccagcaggtgctaggaccaggtttcagcaatagaggagtgggtggcagggttgtagtgctaagtgcaccattctttacacttatttctactgctaggagcaaaaaaatccaaaggaaacatcatcttggtttaggcagtggttacacaggtgacacagctataaaaatccactaaaatgtacatttaagatgtgtatgttttactataggtaaataatatctccattttttaaaaggtgatcataatgctttttgttaagcaaaggaagtcccagggaattaagcattgcccctctgagttcaccagcctcaattccactgggagggccactcagccgggggaggtatttgaacccttaaaagtcaaggatacaccccaggcagcctagttttccctactcaactcttaggcattggccatccatgaaccttcttcattcttcacatttgcaccagggaagagatgccccagcacctgcttcaggccacagctctttctttggcacaaacctgcctgccattgtgaatcattaagtgttcaagtcttgtctctgccaccttggggttttttacccactataaaatggcgataagacctgatgtggctgttaggagtatcaaatgatataatggatgtgaaagtctcacaggactgtaaaatataagctgtcaacaaagtgcacctccaagcccagcttatttccacagtattcaagagccacaaggtttggaagagtagtaaagtctagtggttcagcaggtaggctctggaggcagacagcctgagttcattggtcctggccctgccacttaacagctgtgggacctcagccaagtgcttatccccttggtgcctcagtttcttacattgtcaaatgggaataatgatagcacttacccacaggattgtagtaaggattagatgagttaatccagataaagcacttggcttagggctcagctatgcagctaatattgctgggagcaagggtctctgctgagccttgagagaggacatctttattgggcagaaacagacaaaaactgaacagatctcatttggatataatgcttcatgtcctggctatattttccataatttggagctcaagattgattggtaagttttttcatgctgaaaccattcatctttcgagttttcctaataaataaaggtccctgtgacatgttcttgccttcagagttttgctgcaccatctatcgtgagccctctgatttacaattcagcaaaaaagtgacagactgggtattcttgttcaatccaaggtgattgctgcatagtcatttttaataagacatcagatttagctaaacgcttgcagtgaggtattgtgcatattaaattcaggatgctggttatacgggctgaggctctgcatctttctattgtgagttgtgagtttaaaaatcacataaaactgacatagtggattctttgctgcctaagggggcaagagacccttgttattagagtcaagtgttgactctttctccatctagtgaataaagtaagtgaagtgaagtattgaatgagtgtttgtgaggccctgggtaagggggttacatttgttgaagggctggtgagtgacaggtgttttagatgtaagattatttaatcatcaggcattataacatgagttaggtattatgactccctgtctacagatgggaaaactaaaactagagaggttaagtcaggtgtccaagttcactctcttagggttgagccaggatgtgatcctgagagctttcctaaagccccatattgcactattttagggttaccattaacagtatgttatgtatgaacgatcttattcctgagtagcttaaaatcaaataggagagacaaaacatgtaagcaaattaacagcaatgcatggtaaagtcccataagggacagagaatgtgctgtgtatgttcctaggaggaaagaggcatttgttcagatggaggcaaggaagatgccaaacaactcaccatctgaaattcattttgttgggcctagcatttttatcctaatgtccaagtatgtatttctgatattctaagaattgccaaaaataattatgaagctgtgcctagccccaggtgggcgagagatcctctcaaatgtcccactgtagcatgtctctttatttcctttctgtcctttgctgaaaatgaaaaatgtcccattgtactgagtagagctgctctctccctaagctcaatggccatctggctcacaccttcctgaacaaagaggtgagttgtatctgggcctccactgccttgtgtagtagttgaggacagaccatcacccaccagtcttttggttcttgcagggatgttgaggtgacagtatcggtggagaaaacccaagtggagcacacgtgccctgctgcagcaggctcggcaggagagattttcggcagataaaatgagagatgacgagacctggtgaacttggggcccaactataccatcaccgtgatacttggctcggtgggccaccagcacttgagcagggcatgtactctgcccctgtgagagcttgacagcaacccgctgcccagtacttcctgcctggtgtgaccctgcctgcccccacccagcttcttcccttgcccattgccatgtctctctctatgctggaaccacactggtcttccatccgtgtttgtaagattttgtgtgtgatctctcactcatctccaggcctttgtccatggtgtgccctattcctggaggcatcttcaccctgctttttgcttggccaaaggctactcacagcccatgcctcagcatagatgtcacctcacggaagccttctttgaacccatagaccgctggtgtttcaattgcacattgaacagaccgcccctcactttacactgctccttctattatcttttcattgtgggcatgcacccacacattttttaaaatgtgaaacacaccactttaggggaatatgctcagttggagctgttcttgccctcaccacacccaccccccaacccagctgctcttctgagttggcccattgtggaaagaagccattgcaccctaggaatatcatggggcatgaccacctaatgtcaaggacacgtgccaacggacatgttagtgcaccccgggagtgtactggtgcccaatgaccataccttttccatcccactgggtcttgtttgaaaccaccacattgggtttaggtctgctattgttaacccttcctattgccctgccttcttggagctccaaagaccttctggcagtgagttctcacctagccctcccctctctggcaagaccctaggtcagggaggaaggtcctgtgtggcaagaaagcctgtcaggcttgggaagtcaaggcaccccattgcatctcttctcctgcttaccattctcacagcagaaagcttcttgggggagtccttagtttgtcagctcatcatgactgtatgtcctccagaaaaaccagggtttttaaaagagttttttttctttggtatcggatattaggaaatgtatccttcacctaccctctgccccttctcccagaaaaagagactaatgcacagagtggaactttagattttcttaaggtgtacagcaaaccagaggtcaagacttgaacccacatcttttgacccttgatacaggccctgtccattgtcccattccactttttgtgtggctccttcatggctctgacctcccccattctcgggaagaagcctgaaacccccggcctgcaaaatagcccttgagagagaagcatctggaagtgtgtgctaaagctcccagagcaatggggggattctgccacatggctgctgtcagtagggtaaggttctggactctctaaagtctgagaatttgaattcctagaactagagaaggcccatgtcagttcaaaagtcagagcagaggaaaattaggaatcttgtttttaatgcagaggaacaaaaggagtggaaccatagccccagaaatgtcaacagaaagggcagaggtgaaggtggcccctgacaaaacttctccatacctattatttttgtaaaatctccccatagctctttggacagccatgtgaacagatatctttggcctctttttgcaggtaaagaatctgaggttggaggcaggctgggacaaggctcctgagtcctagcctgggggtctgccatcatacctacctgcttacaaaaaaatcacctctatatcctacatataccctttcctcccacgtatgctgtttcctcccctctgaaaaaaagtacctcagaatgtgctttcagagatcattctttcaaaaattgttcactagagcctactgtggccaggttccctggtaagtccaggcttccagtataaaatgacatatggactttctcctgcaagcattcacagcattctggagaagtttggggtccaaaactgaggttcttaatgtcttttgggtcacaaacccctatgagaaactgatggaaactatgaagaatttccttagaaaaatgctcctgcattttttaatttaaaaaacaaatgtttgcgtatgggggttgctgtggtttgaatgtgcgtcccctacaaaattcatgtagaaacttaatctctaatgcaacagtatttagaggtgaggcctttaggaggtgcttaggtcacaagggttccaccctcgtggatgggattagcgtgggttttttgttgttgttgttgttgttgttgtttgagacagagtctcaccctgtcacccaggctggagtgcagtggcacaatcttggctcactgcaacctctgctgcccgggttcaagcaattcttctgcctcagccacctgagtacctgggattacaggtgcctgccaccgcgacctgctgatttttgtagttttagtagagacagggtttcaccatcttggccaggctggtcttgaactcctgacctcgtgatccacctgccttggcctcccaaagtgctgggattacaggcatgagccactgcacccagccttggattagcgttttaataaaagagctcaagggggcaagttcaccccttccatgcccttttgcccttctaccttctgccatgggaggatgcttcaagaaggccccactagacactgaatgccagtgcctcaacgttggactccccaacctctacaactgcgagaaaataagtctctcttctttataaatgcctaatctcaggtattttttttatagcagcatggacagactatgacaggggttagcagtctcccagaggcagtctggggacccaccacaccctgcctcaagtgttcaccgatttcagatgaagaagtcatggggccaggtgcagtggttcaagcctgtaataccaacactttgggaagccaaagtgggtggatcccttgaggtcaggagttcatgaccagcctggccaacatggtgaaaccccatctctactaaaaatacaaaaattagctgggtgtggtggtgtacacttgtaatcccagctactcaggaggctgaggcaggagaatcgcttgaacccaggaggcagaggttgcagtgagccgagatcgcgccactgcactctgcagcctgggtgacaaaaggagactgcatctcaaaaaaaaaaaaaaaaaaaaaaacatgggaccagatgatgcagatgatgaaattatagtcttgttcttgagaacagttgttaattctccaaaggaagcttgtaccacggggtacaaggataaaagcatgggtatgatttttctggtcatcgtcatcattgtttcaggagtcaaagttgtacacatgtcaatgtcctgtggtctttgattttttcccaggttggaggggaaaccaaggcaggaggggtagccagcaccagagccagtaatggtgtctggagagaatgtagccatccaaccccagtgctctgcttctatgcagggatggcaagaggctaggtgggatgttgagggaaacttaggaaaagagctggaagtcaagcacagaagttttgcaatggagtttacaagagtttttaagataactcaactttgagatgaacaggagattgagaaagcctttataaggtcttcctaagtgatgctgacagctaagagtggcatgcccctgagagtctatgattatctcgcaggagagatctttatgggagccttattaagaacagagcatgtcagtgggagggagggagggagcagcagcgtgttcacagctctggagggcaagtgaggcagcctccttgatttgcaaagtgctttgcagtcctttttcattatttctgcaacagacccatgagatgggtagagaaccaccctgctccccacaaattgtagaacactaggaggtagtgggctgtccatctaaaggtgtccttataataactggatggtccctgggtttgcccctctacaaccaacatgatgtgataacctagattagaatgcctccccactccccagaccttggagtcttgtgattgcttgtatcagtggcctcttcagaacaaaagcatacaagcttgtccttctatgagattgtaacccctcaagcatgctcactagttggaggaaattctgacagccctactccaggcttgaggctcgccctggagcctggtaacttgagcctccatcgtaggtgtgtgtgagaaaggaaatgcagaaatggagtgagccgaggaaaaacccaggggcgacagatcctcggagagcatttcatccagtcctttcccttgacacgtgggagagcaatgtgacacggctttgctgctagatggtgaagactggcgatgaggtgataatgatagctagcatgttttgagtgccatgtcccaggcatggtgcctgatatcacctgtgcaccctgcgagatgagctttgcagcgtggttgagtatctgtgttatatacagagaccctggtgctagagccccagcacccagctccagcaccttctgggtgtataactgggtttcttattgtggctgtttcaattggccacagattttgtggtttaaaacaataagatgtattgttttacagttctattggtcagaagccccattcaagttcaccagcctaaaatcaaggtgtcagcaggctgtgttcccttctggggcttctaggggggagaatccattccttgctcttggagattttggcagaattcaatgcctgccgttataagagcccccttttcatcctggctggaaaccgagggctgttcccaggttctagaggtggctgccacatatcttggcagaggcccctgctttcctctatcttaaaagccagcagtggcaagttgagtttttctcaggcacatctgactcttcctccattgttatatctctctctctttctctgatccagccaggaaaggttctctgcttttaaggactcatgtgattagattggacctacccggataatccaggataatctccacatctcataaccttaatggcatctgcaaagtccctttggccctgtaaagttccagggattaggatgtggacctctttgttgggagagggggcattattctgctcatcacagtgacctagggaaatttgcttgacttcttggtttaagtgggaaagatgatggtacccacctttgggttatgaggatgggatgtggaacccctcatagcacctggaatgttggtaaatacttagttggtgttagctgtgagggttgttatcaaacctgttttacggttgaggacactgagatttaagactttgagtaactcacctgaagaacaagatttaaactccttgcgagaaaggacaaactgcactgtattcatctctttcatcccccacagggctggcccacaaaagatgttcagtaaatggatgttgaatgaatgaggggaaccagaaagagtaaatgacttgtctgagtgctgttagagaaggtcagagatgaagggactctcagaagaggtcaagttcaagcctttcatcttatacctgggaatctgaggctcagtggggaagcggggcctgcctcagaagatgggcagtgcagagccccaggatgtggccagtgcctgtctggccagtacgtcttcctctggaccaggccgtattcatttccctggaggtctctagatcctgtggtctaagccaagccagaagctggtccagtgggatagaagtattgattctggcctggcccctggtacagcgtcaggcagaggagctcagtagaagagtgagaggtgagagtcctgcctttcttcctgcagtggcctttggagaagcctatctgaagcttgttctcaggcttctctagacctccttaggctgctacccggtaggatagcagccagatagatgcccatggcccactcatgcccatgttaataccttctgctctgacctaaggctgcatggcatagatgggggactggggttttatttttatttatttattttgaggcagagtctcactctgtcacccaggctggagtgcaatgttgtgatctcagctcactgcagctttgcctcccaggttcaagcaattcttgtgcctctgtcagcctcccaagtagctgtgactacagcgtgcatcaccacgtctggctaattttttgtatttttagtagagatggggtttcaccatgttagccaggctagtctcgaactcctgacctcaagtgatccaccaaagtgttgggattacaggcacgagccaccgtgcccggcccaggacttgggttttagtctgcccatttacacttacggctttgtggtatttagggcatttggctccttgggactaatttcatctgtagcccatctggacacttataaggtctcaaacaatcctcgtttcaggtgccctttagaggatggttcaaaaactttcacatcagcctcagggacagagctgtgctgtcattccaagggcttctggctccactgaggctgaacacaacttggcagccagtgaaatctttctggacagctgatagtgtcccccatctccatgggagccagctaaggtaggacagggtgctaaccagtaactttgctgtgctaggctgcccctgacacaaggcagccacaggaaaagccattatatctctgtagagcaggatgtggcatttatgctgtctcattggaatcagggcttcgttgtctgtttgtttgaggaggattgagcaaaatctggattggttttcctaggcaagaaatgccaagtgtcatgatgtcagggttaccaggtaactgagtagaggaatggaatatatgggtggtgcctggaaaggggagctaatacgtgttcctactacataccagctccaggcttggcacttttgtgcattgcttgccatggtttactgcaggtatgacttgcccagttttacagaagagaaaatggaggttgggaggtggtgactctccctgatcacccagagggaactagcagaaattgtttgggctctagctagttaaatatgagcttagttcagttgccaagtcaacatctgtgtgtgtgcactctgttgagatctgatggggctggagccatcttctctgccttctaatgggagggtggagttcattctggtggatagggaatcaataaaacaggggtataaaaatgatagccccatccattagtaagacagtaagcatttattgagtgtcttctgtgtgctctgttctagtcactggggacatacctcattcagggagctgccattctagtttcatgaagacggagaaacacacaaagttaactaaatgagatcgttgccagcactgagtgccatgaagaatgtgatagaggatagttgaggagctcctttagctaaagtaggcagggagagcttcctgaaggaatgaaatctcagccaggatgcaaatgatgagaatggggcagccatggaaaggtgtggggaaaaagctttccaagcagaaggaacaggagtacaaagacagtacaaagacagagccagtggtgagcctgagtgtgcagggaagccattggaaggagttaattaggagagagatgatctgacttctactttgagtttgctgtggctgctgtgtggaggacgggctgtggaggggcaagagagggagcagggagaccaaggagggggcatcatagcctttcagttgggtgaaagatggtggtaactgggaccaagtttgtggcagtagacagtgagaaattattagaatcaggcagtattttagagttagagtcaatagggcctacttatgattaggatagtggtgtgctggtaaaccagccaagggtgggagggaggcccttgttggtagagcttgccagtttctgtggtgtaatattcccaccacagctggtttcaagctacccatctggccagtgagtgatgcaacgttagctcttgtgagccagcacaactcactccagcacaccactgggtcaggccatggaagatagaagcaagaaggactgaagagcattccatggctttgctctgagcacctgggtagatggggatgccgtctactgaggtaggaaagactagaggtggaaagaaagatcctggggcagtggcaggaaaaaatggttttgctctggccatgttaatttttaaatgcacattagatatctattttataagttttgggcacttgcatcctttatgtcatttaagtgtcagtcctttcaataactatgagtttggtggtttcttctccattcacagaacaataaaccgaggatgcaagggaccaagaaacttaaccaaggttgtacaatcagtaaatgacagagctggatttgaacttgggtctgaccctgccccaagggccgaatcattgcccacactgccctccagaaagcatcccactcttagcttgatgctacatttttgggatttaaaaggggatctttaggaagttttgaacagcctttataccggagaagtaatcacagaatggttgctcagagaccagactctgccctttgatgtgttgtgtggttttgttttttaaggggtgtggcgggtagggaaaaagaggaaggtggggaggggaaactgtttgtttcattttgttttattggcccatgcagtttttttgtttttgtttttgttttttaaagaaaacaagaagaagaagaaagagagaaatgtaattgttttaggcaagtctgcgcgcccccgccactgctcctggcctcctccattccctgctgtctcaccacctgcccatttgacacacgtgacacttgcttggctcaggaggcatccagtgtcccgtgctctagaggagcccaggtgtagtggcctctgcaggcaggctcttggcttcatccttgcacctcagggagtgagcacctggttcccaccctgtctccaggcctgagccagtcactggggcctggggtgtgtttgatttgcactctctgctgctcccttcctgaccactgccagctacctaagacatcactgtgcttcaacggtaagagctgtggtctttggccaggcacagtggctcatgcctgtaatcccagcactttgggatgccaaggcaagacgatcacttaagcccaggaggtcaaggctatagtgagccatgacagtgccattatgctctagcctgagtgacagaggaagaccctgtctcaaaaaaaaaaaaaaaaaaaaaaaaagaattatggtctttctgattctatacatactaaagcaatcccacctctttccctggctttattggtattattttccctggtattattgttgttattttgctaacataatgaggctcggaggcatggtttttctgccttttggccttcttgctggtgatatgttcaatttaatggtgttcttcagtgtcactaggcgtggctggagctgagtggaagctgccatcaggtagtctgagaggagcacacaactgcgtaaatggctgtgtctgcctggctcccttggaccgagaagcctccattccctgcctgggcagtgctgggcttggttacctgaagaggcatagcaggattgacaggaagctctcaccccacggttggcatgaccagatagccctgagcatgatgccagggctggtggcactttgcagagccgaaaagggaggccagcctgcatccatctgcctccgtctgcacagttatgtgttccaagtgcaaccagaagaaggcttccccaggcttagccagggccaccaccaggccagactggaataggccgagacatacccagagagtggcagggttctcctggcatttccatgtatgtacctctttagtaaaagatgtttgagctggtaaccctgtgtatatgcatatgtatgtgtatatacgtgagtgtgtgtgtgtatatatgtgagtgtgtgtgtgtatatatgtgagtgtgtgtgtatatatatatacatatatatttatttatttatttagattatgtatattaaaatacataaagaaaaatagaaaatagaaaagttaactggaagttatcataactagaaatgtgatgttttcttctgtgcccctatggatcctgactcacaccttgagcttgccggccctgagccgggaccaggagctgtaagtaattgcatctctgcttcccaccagggcaatgggaagagcttcatgttcagaaaacttggctccaagccccagttctgctaactcacttgcagcatgctgtgggcacatctcctggccacactgccccacttctgtcaggtctgcatgaatgtcactttaagaccaccctatgtaaattagcatcccactgttaccgccccttcacttaccctgcttcatatatcttaaaagtgcgtagtgctactgacgtgtatatatagataaaagtttattcataggtttgttgttatacatgtttgttagttatctttactcgtgtatgctccatgagagcaaggattatcttttgttctctgctgtgtgtgtggtacatagtaggagctcagtatatatttgttgattgaatgaattaacttttgttttatataacccaatgctacttagtaaacttttgtaatggaggagaaatgaaaaagactttaatgcttgaaaggaggatttggaggctagaggtagaatcattttgaggaatatctgctttgtatagccgacaccattgctgtttttgtttttttgtttgtttgttttgagatggagtctcacttactctgtcacccaggctggagtgcagtggcataatctcagctcactgcgacttccacctcccaggttcaagtaattctcgtgcctcagcctcctgagtagctgtgattataggcacacaccacctcgcctgactaattttttttgtatttttagtagagacagggtttcaccatgttggccaggctggtctcaaactcctgacttcaagtgatccaccctccttggcctcccaaagtgctgggattacaggcgtgagccactgtgccctgcccccattgttgtttttacccatgtgaaaacaagtactggggaccaggagctataaataattggatctctgctgacaaccaggcactgttcatggatgggtgggtggatggatggatggatggatggatggatggatggatggatgaataaatagatagaatttaatcttcacaataacccattgagattaagtttcattgtctccatttcacagattaaaaaacaaaacaaaaatgcaaaaccttgaggcccagaaactcaagtgtatctaattccaaagtacctaaaaccatgactaaacagaatgcaggtacccagtgagtgtctgtggaatgaacgaaatcctagcttgttacactcttagaacttctcgagcttttccaccaagtagcttttgtggaagaagatggtgagtgtgtgcccaggagagtcgaagggcatcgcctgtagcagtccacctcaagccagagttgtgtttttttaacatctggctttttattttaaaaatccatgtgaatttctgtattatccttcatatggtgaaacaaactcctcctgtttgttttacaggaaaaatgatgcttttgatcatttggtcacttatgttccataactttaaaaaaaaaaaatgtcaatgaaagctgctgctctgcatgtactgcgggagtggcatgcttctggcatgaattctgtgcacctacgagctgcccagcctggtgtgcagtgaccacagtggaggctgctgtggggcctggtctcttccatgcccctcagtgggatcttgtgccattcgccccctgtgcaaacacagcttgtccagaggaagcgggacattcacctccaagccccagccatctgttgtttcaggcctggatgagggcttcatctgggtgaatgggccttcagcaaacagtgcctcgcctggtcccctgataaggggtttacctctccagcagattttatagctctgcccttcatccataatcagagcgtgggtggggagagacagagagtatgaaatatccctgaagctattggaatagcctttatggtttgttgtatataaacctgtgttctggtgtggtatgtgaaacggaccactgagactcagcccacaagactttgatgtcacatagctaagggccccttttctggttcatgtttcagtgactgggtttctgagcatcttctctaatataggggtccagactccaggatttccattgactcgcgataaggtttcttcattctttgtgtctttgctttcctcttcctggaaactgagttcaggcatgtccagagtcatgtgtggtttaaaactgaaaaggctcatagagaccatccagcccttgcatttctcagatggggaactgaggcccagagacagaaagggagggtgtgccccgttgtgctctgtcagtctgcaacctctcagcccgggtctgtggagttggtgccctgggtgtctgtccctgtcaggagacagctgaggctttgttcagcatttcttatctggttaatccccaccctgtgggtatgtcatatagccaggacccaaagacaggaagagatgaggagaatgaggatgtacaagtcccaaaacaggatgacaccattacctgggcagtgtggcttatgctttatgtgaaagactctgttggtccatgctcagactcagcccagcctactccatggccaggcccagaccttgactggcaactcacctcccagccctctgaaatccaccgtggggtaggctcagagcagactcacccttacccaagaaaagaactccattcaggtctctgcccatatgtcacctcttccaagaggccttccatgacaccctgtcttaaatagcagtcctcatcacttgccgtctccacgctctgcttaattcttcatttattaccacctttcctgtatttgtgtgttcattttttcttttccttttctagaatatatgttccctgagagccaggtccgagtctgttttgtccctagcacctagaagagtacctggcatgttctctgtgagcggggattagagagagagtggaacttggggaacaactgggagggactaaaagaactgggaaagtgggagggacgtggtcaaggaagagaatgagcacccttttctgaaccacttaaataaatctgaatgcagactgtgtttgaaaagagctgcttcaaggggctcatctgtgattccttgaaaaatcaccaggcttggtactaggcactggcacctgaagtcaggggtttttgattccctggcagtccaacctgtatttcccaagggccctctactcctctgaggctcagtattctctccacctggcaggatagggcccttggcaagatggagcctggtcccaggagaaggtgcacctctgtgacgatgtcgtccctgtggccacctgtcagtgcttttcccatctggttggcagatcagagagagaaagagaatgtgggggctggaggaggggggcccagaccatctgatccattcccatttattgcagatgggcaagtgggactgatgcctagagagggtaaaggacctacctaaggaaacacagcaaggcgttgacggatgtctgctttaaaaaaaaaaatgtttcctttactattgctcatcttttgatgcatcctccctcctgcagcctctcctacaaaaataaaaaaaattccacaaaagcttagcaagggcttcctaatgcttgctgtaacataattgaccctcttgagcctcgtagctctgagaagttcatggatcttcagaaatgcgcccagtaagacgaatagtgtttctgtctagagagagtggctctaatgagtcaggcatttcccaggttcatatcctttggaattcggttctgtgagctttaaacttgtgttctatacctcccctcagaagagttgtaaggtcaagcaagtgtagaaaatgctgcctgctacaaaaactcttggagagacacaatggactttagcatattaaagcctctgagaagttctataattaacaaaaatccaacagctctttttgtgtaattcagtttcccacacttgtttgacctcagaactctttttgcatgaaaaactattggcctctcacagagctggtcttcctccaaccacagacccaacagaccactcacacaagggagtactcagcacttacttttcattttatacagttatggctttttgttatttcagtataaaatacgttggaaaaaaaacatgacatataataggcctcctcaaaaggggttggggtgaagcgccctccaactaactttttacttcttataaccagaaagacaaaagacagcttcacgaagacatctcttcttctttatatccttgtgattctatttttattgctctaagagcctataggccatttccattttgtgagtacaataaaacatgccccttactcaaatggctttcaagacaggccggaaggacttcaccataaggaaaatgcatctatgacactcctgtagcttgggaggtggagtatcattgcactgaatggatttgaatcctgccatcaccaggcatcattacttaatctagctgtgtctgttttctcatctgtaaaatggagtgctcatagtacctggctaaagttgttttgaggattatatgagatctgtgtttaacatttagaatggggtccgatacaaagccgatacttacctgttactgctattatcatagaatgagagctctgtgtaggcagtgactttgttttgttcactatttacatgccccagtgtctagaacagggattagcacatagtaggtgcttagtaaagtttggttggatgaataagtgaatgaaaaaatgaatggaaggtcttctatgtatggagagcaatacacgtttctgagagtcagattctagcagagaaggcaccagattaaaagtgagctgcttgctgtaggccaaggcttttgcttcctctgccgtgtcctctctgtgtatgaatgagaagccagcacccataaggatgcaagtcatggtgtggaactcagaagcagagcgtgaggtgatttcctggaaggtggcagtgtcatctgaatgtttcaggcctcaagaatccaagcttgtggatttctattcctggttactacaggcaggtctgtgtctgcccagccagagagttgccaccatttacccttggagcctcccagcgaagatgctgcccatggagctgcttttgaagggggagtgcttctagctgtctgaggcaggctgagggccccttggccaccttgacactcttgttccccaaaggctccatgcccccttgtctgtgggttggcaccacataatgacatgttaacccttggcctgctgatgttgattttaccttctcttgagggaatataaccaaggcactggaccaaaataaacagcccagatgctgtgctgacccggctctgctgggaagcatggtattgatttgcccccagcctctctaccttcagtaacctcatctctgcctgaggctcctaagctgggaggttgattcacttctttccttggcagtgtattcacccaaacacccacacccactttgtttatattcctaaagaagccagcattagctatttttaaggactgtgagtggccctaggtgcccaaccctcctggtctggctgtaggcaggaggtgacaccccaaggagagtctacctgtctcaacctctctggtgggaaaacccagtagccaccagcctagggaatgccaaaggcctaagcaaacacttgtgcagccagccagcctcatggccttggccctctggccagaatgcccttaggctgagggtactcatggttggtggggtggggcagttcagactgatctccaaagaggggattgacagacatgctcggggcctgcagctgaatactgtctttagggaagtgcagctggaaagagggtttagctgtgattcagccaggcctgcagttcctcagccttgcccatgaggctctaatagccagtttaaggagagctcactgaaagtctgcatgaacccatgaactgtttcacagctgacccagcttcccagttctgcagcttccattttcccctgtccctgggtggtttgcttctcaaatccagggagtcttctccgagggtacaggagtttttgagggagtgtggttcagaatgggaccagccccttcccctctggttcccccccaactcctattccagtgaccacattgggcatgcagggggccctttccaactcaaagatcctccaagagaaaacattctagccttaaaaattgaggaaaacagtctacctctgtccccctggtcatctgcttgagccagagaatctgtttcactttgggggtgggcagtgtgtggccatcgggagctacactggctatttgcttgccccagtggctagttaatgttcagccaccagctgcctgtgaaaatgctgtttatgtctttcttaccccacagcccctcggggagtttaaataaggtgctgcggcacttgagttctgcaaaagacacctattcgctgaccagacaaagatgcttagccacaactcacaactctcagggtgcagttcgaagaggaggaagcagcatggcatataaagctcatgctcccttgaaggctggtgattgagacaagttatgtcttctagcatttgactccctcaaagagattgcaggacttccctctgattgcaggtggctcaatccactcagatcacctagaaacttgatagagatttagaatcttaaagaagacagaagcttagacagagcatgtagcccagcccatcaacagatgaagaagttgaatcctgcagggactacaaggaggtaggtagagctagcagaactgaaggccggcgggacactacgcagtccaggcaaggggctctgctgctgcagcctgtgcctgtctaccatttccctttggctcctggcacctgcctggtcagttctcctcgacatcccctgagagcacaaccagtctgacaattgttcctaaaggcagtgctcctaggggaatgcctgctgagagggaggctttcatttaacatgggacttgggtggaaatgcggagtgtgtcctatcctcccaggcctccctggataatctgtcaggactgtcctgctgtgcagccaacagcctctgtgtccttactctgctgggatcacccagccctgcctgggagctaagagagtggcccagccttgtaggtagccacttgccctttggattaagatgaatatgcatgattctggcaggagataagatatttatcttatttatttgacatgcatggatttcttggctctgtgtgaagtaggaagggaaatggagtggtggaagttggtagatgggcattttatgtacacgacttggacctttatcatttgaaattttcacaaagggggatcaaggctctcccgttttcactgagatggtgattctttgagtcatagcctattttgacttggagaagctgggtaccaggtctccactcaagttcaggcagtcattcttggtttcacttctcaggtaaagaggcatgttctcccattattgcttctgagatctttcctaaagatgatgaactggttgacctttgctgacaagtccacattagtctgctgtggggagaagaagtgagtggtgtgggcaattctggctgaagtttaaattgcagaattgaaccttagatatgagtttcatagtagatgtgttggagaaaagagagcctgggttaactgtatcttttctagtcccttcacaaaacacaggcacgcacacacatacagaaggagagagagacagagaaagagatcattcagtttgaatccatagaattgaccctgggaggtagattagaagagagaaagggaaagtggaggtggctttcttaggagctttagacatttccaggtatgacttccagataggtctggacctcagtgttccaggccaacccagtcaagttcatattggccaacatcagagagacgaagtaccagtcttaggtcaccctgcaaaaaaacctgactcccagtccagtgcccttttcactctactatgttacttctttcctagagtgacctttccaagctagtccatggctcaccagagcaaattggtctcgtggcattatagttacaccagcgctttgtttccaaacgcagtgatcctctgtaatcgccaaatacctatggctttgagggacttttgaacacaaaggcagactcaccaagagaaaacaaagtctcatcaccatttaaagttttcagattctgaatacattctgaaaatggcagttagaagtgctttagccaagggccgtgtcccaggaacgtgtaggattgtgcatttggatatctgtgtctagcttcatcacttattgctgggtgatcctggataagtttacttaatttatctgtgcctcagtagcctcatctgtaagagtagaattataatagaacttaggtcataaaatttttgtgaggattaagtggaatgctgtacatgaagtacttagcacattgcttagcacaaaatgagtactcaaaaatatttactatcagtattttattcttttgttttcaggtaagtctctcttataattgtacatgctatcaaccagtgcaaattaatatggtatcaagaatatgaagaatcaaaagactaaagagtaatgacattagctggtggggtttatgcagtcattcgttaaacagatatttgttaagcatcatctatgtacctgacatggagctgaatattggagctgagtaagatagatgtgatcttaccttcatgaacccctcctcttgtaggggagacagacatttaatgagtaactacggctgtgcagagcaatgccacaggatgcctgtatctgaaagagaaaggagaggaaggagagaggagaaaccatgcgttctggtggccaccccactgctgcaaccagaagaacacagccatctccctggaaatcattctgataaatttaactctaggggaaaaacacagccggtccatttccaaactggaattctccccccatgtgtttttgggaagcacagatgccttggcgttttccctctaacaataacagagattgttcacaattatgaatggttttggttgacttcagctccaacaaaaccatgaatcatttcataacttctgaaattgcaaagaaataacaaacactctggctccagaaaaaaaaaatggacacattatgaagcacaaagtcgtctaaatgaaaatgtgaattcttttttgtttgtttagcagctgcacgttgcaaggccagctggcaacggataaaagacccaagttagtgtctaggttcctggggtaccacttgtatagtctcatctgtgggatccgtaaccagctatgatataaacttcgttctccatctttctcaaaactttgggccagcagcattatttcatacattttacaatattctgagaaagcgagagtgaaaggaggtgcttgggctgaggctcgtgacagagggtctccatcatgggtcccatcacagatccccccccgcccgccccacacacatttgtgggacgactttttttcagcaggcctgctgcatcctcctgatatctagccacaagaggaggttttcaaaacgtgggaccaagaggatcaggcttcccccagtctgacagcctctgaggtaccaacaaggcctggcattggagcaaggttggctactcctcttctctcttaatccagaaaactgcatcctttcctaaaggctggagacacacagctatccttgattgcagtccagtcttgcctgtgcacgtggccagaggcacagcgggttctaacaccttggggctgagaccagattggagagtgggggacaagcacatgaccacagcaccacagtcacagagtcttcctccccaccttgttgactttcttttttcatgttaataatgtcaacatagtggtggccatcccactgctgcaagaacatttgttggaaagatacttcttttggaaaacaggctcaggggagcaattgttccccctcaagtctgcctgcactcctgatctctttccacgctgcagggtacacagcagacagcagtagactcaggcccattggcatagcatgtgcttcccacacacgcattttttaaagtaataattttgttacacaattaatgcttatttctcatagataatgtaggatatacagactttaaaatggaagaaaataaatatagcctatatttctattactcagagcgaatcataatttgcgtttgggtatatatgtttctagacttctttcaatgcatgtgtatgtgtttttaaacaaaagctagtatcaaactgaacacataattttattggccctctttactctcactgtacactctgaacattttcccatatctacatatatgattgcatatcactttatgccctgcagacatctctgtaaatctctggaagatttttccttttgtgtccttctccctaccatcagagatggagacaatagaaaatacacttcagtgtcacatcacagactcacatcttgagcactgatgtaagttttgcactagcccatcacaggcactctgcctgagacccttcctgctttagctgtgattatgagtgcccagttcatcagccaattcattgccaaggtagagcctagctctgtaaaatgcccacaagctttggcagcatgaaaaccatgcaaagttgcattgatgctactcacaagccccaaataggtggtctcaaaagagaaaaaagacttatgttttaataaaactccctttaataattaggtgctttaataaaaggccacttgggtcactgtctgcctcctcagcctagacttcctgcagttggaaaaaaccttccaaggacagagagggttctagggacatactggacaggccctgttcccagccgctgagcccacagggactgacaaggcaccaccccataagaatgtctgtacccttttggagcctacatctgtaggtgctgaggcatcacattcttcaggttctaatgaagaattattgcagtgatgagttgtagaaataatcatttaatgtttattattctgaggaaaatttaagaatttctgtattcagagcagattgacaaatatggcaaccacttcacataatccacacgctagatccttataaatgtcattgttatcactggagcctcagctatggttgtctttcccaagctggatgaataggactgccagttattcactaaagatagagacagcacatggcttctcttaggcctggttgctgggcagaggctatagcattgccttggggtagggggtgcaggtctcagcaactatccttgagcccttcaacagggagtcctgtctccacaaagatgtttataggtcaggcttttgagtcagaagaacaacttgcagttgttttctggggccacaggagttgattgggtaggtggtctggaaaatgaagaagcaggaggcttcacataacacaccctggatttagggtggggacacagccagccccagtgtaatcttacaatggagatgggatctcttcctcaggtgtgtctgaaagccacctcagcagcctccagggaagtgtcctctcattggtctcagctcagtgtgtggagggctcgggagtggttagaggcaggctcatgcagacaccattccctggaatgtgcttgtctgtatggtcatggaaggattttttctgcctcctcacatccaaattcagcttagtagactgttattgggcacccgtgctggtgccttgcctctggtgtctggctggggaggcagtgtgaacaccagggacttcacatcccagggtgatagcagttttcaaccactttcctagaactgcttggtttttgaaccatggtgctgtttaatgcttttattgagtggtgggtcccatatgtgtatacatttgagcatgtcagtttgacagcatttcttctcttgtcttgaacttttatctgagcctcatatcagaatcgaatttttcccatttctctcaacctttgccaagtcctccatgtaatgcctacacaggacctgaagaggaactccatggtctgatttgggtttaattggttggtcttagatttcccctccctctccaggctcagggtgcctcatagctgggcacttagggtgacaagcttatgagctatagagcaggctggggtgtttatcctcgtgcacagtcacgaggagaaggatgcttataaaactagaacaggatgagactctgtgggatatggtttgatttgcctcagctcaggaagcccaccccgatggagaaggagaaggcaggtagaagccaagggaatgacagtcaaggccaggatgcctccacagggaagagtgctccttccaggaggtggcatcagcaccgtccagctctctctagggctccgtactctctgtgtacatggtggcccaggctttacttcctgctttttggagtgggacctcgagaaccaagcagtcctgccactgcagcccaagcggagcatgcagttctttgccacaggccttacagcgctctgacgctgctcccatggaacttttcccaaccaattcagagcactttgagggccacagtgatgctgggagcctgtgttgtgagtcccactgctatccagggaaggccagtgtgaatgagtagcagtgctggggagtaaagcatcacttctcaagccctgtcctcaggctcatgtgcagcactagcgatgcagcactgactgcacacagcatgccactcagtcactgaggaggggaagtgagccccttttagttctcttccagtgcttcccatcgagttgaggagagtccattgggcactagaacagcttaatatccctctaaagcttgccaatcttttgaaacaaatagtctgttataggtttgtttgcattgtatttgtttccatggttatctcctatttaaagcaggtgataccatttaaggcaacaatgtaaaatttcctttttaaataataacaaataataataatatttgtttgcagtgtatagaattaaactaccaagcaaatgaagcataatggtataggctatggccaaaaatcatgagggtaatggagtgactcaagtttgagaaatgctgaaccagacctgctgctttccttatcctgcagtccagtgtcccttcgtgacaaggcatttgagaaggtattttgattgagtgtatgtttataccactcacaaggaggtcccagttacgagcctgtgggagctgggcatgagcagaagctgtgctgcttgctggcagaaactggcctgagctgcaatgggaagctacactgggaagatgaaaagccctggcctcagaagccctgtacctggaaaagggctaaatcccagggtggtcactgctagttagggggtgctgtgtcattcattcatcccactctcctgccagcccaggacagtctctggggcacagcagtgatagcagaaatgctaatagcaaacatgcattggactctcactgcattctggcacttcacctgagtcatttacttctcataatgctgaaaggtaacagtggtagtggtagtaataaggggaggagaagaaggaagatgaaaaaaatgttaatatttattgaatattcacccccaaatcatttatagattgaacataatccctatcaaaatcccaggtgccttctttgtagaaattgacaagctgattctaaaattcaaatggaatttcaagagattcagaatagccaaaacaatcctgaaagagaagaataaggtaggactcacacctcccaatttcaaaacttgctacaaagcaatgataatcagtacaacatggtactagcaaaagaataggcatctagatcaatggagtagaattgagagtccaggaataaacttatacatctatgaccaactgatctttgacaaggatgtcaagatcattcagtgaggaaagaatagtgttttcaacaaatggtattgggacaactggatagccacagggaaaagaataaatttggatccttatctcacaccatatacaaaaattaattcaaaatggatcaaagacttaaacaaaagaacaaaaactaaaacataggggtaaatcttcatgactttggcaaagcattcttaaataaaacatcataaacaacaaaagaaaaacaatagataaattagactttatcaaaatttaaaaattgtatgctttagagcagtggtccccaacccctgggccacagactggtgggaacccaccaggccatacagcaggaagtgagtagcaggtgagtgagcaaagcttcatctgtatttacagccgctccctatcgctcacattactgcctcagctctgcctcctgttagatcagaaggagcattagattcttataggaatgggaacgctgttgtgaactgtacatgcaagggatctaggttgcatgcttcttataagaatctaatgcctgatgatctgtcactgtctcccatcacccctagacgggaccatctagttgcaggaaaacaagctcagggctcccactgattctacattatggtgagttatataattatttcattatatatagcaatgtaataataatagaaataaagtacacaataaatgtaatgtacttgagtcatcctgaaaccactccatcccccacaaccccagtccatggaaaattgtctcccatgaaattggcccctggttccaaaaaggttggggactgctgctttagaggatattgtcagtaaagtacaaagacaacccacagagtgggaaaaaatatttgcaactcatatgtctgatcagggatttgtgcccaaaatatataaagaactcttacaactcaataataaaaaaacaacctaacttaaaaatgggcaaaggatctgaatacacacgcctccaaagacaatatacaaatgaccaatagcacatgaaaagatgcttgacgttattggccatcagggaaatggatggagaaaaaaagtagattactggttgccaaggaattggagggagcccaggagggtagggggtgacagctagaggctacagggttattttttttttagcagatatatgttccagaattgactatagtgatggttgtacatatctgtgactgtaccaaaacaaactaaattgtatactctaaataggcaaattatatgatgtgtgaattttatctcagtgaagctgttgaaaacatttattgagctccaggcacagttcttaagcattttacgtgcattaactcatttgcggtcacccagtgaggtaggccctgttatacaaatgtcaccattttgcagctgaggaaactgaggcagagttgcccagggcactattaatatctccttctagtgcataaggaaaatgaggcacagagtttagagtttgtgttctgtctgtggtcacacagctggtacagcggaggcagaatcacagtgtgatcccagaccccactcttggccactcgccatgctatactacaggcaaagcaaagggttcctgcccatggggagctgtaatctacttgagtgtaggcacgtaaatgggaaagaggttgagaaactgtcaggatgaccacctactaattcgctctgagacttcagttaaggcacagaattcctgggcctcagtttcttcctcttttaaaccaagtcttaggctggataaaagagggccccatcctggggttcatgaaagtagtaatgctggtctatggataacacttagcataaaaaaaaaaaaaacctaacattatatttgcattcaggcctggagaccatagagcatctttgctcttggctgaaattacgtcccaccagggtagtaaccctggttacctccagctgatgagaagcttcgattagcagtcacgtatctgactctgcttgacaagaataagaaactggatccctcattgcttgttctgggaccacttgctggggaaggccaccctcaggtctaggggcttccgctgcgattctctaaggtcatttgaccccctgggacttgccctcccttggactccctggctttcctctagtctctagggtcccagctattttttccaccacacccagggttccctgtggcaggcccaagctaaggtggatgtgcagagtgtgggctggccagtatagccaagctgggcaaatgcacgtgctgtcaggagcatggacagagctcccggtgctcagagtccaccaccgcttctgctcttcctacaggcagaaggcaaaggcctgtttcccactgaatagcaccttctccagtcatgcctggggagctctgaaaataaaccagattgggaatagtcaggatgtgggctactgatggcccctcgggtctatccagtgcattttctctggcactaattttcaaagaaagtttcactaaaacattttccactgggcaaaatcatgcctttagaatcagcctacactagagtcttaggatagctgagccaggagaaagcactagacaacatttatttattttatagataaaaaaaaaaactctgttaaagatgcttcatctacccttgttgttccagggagatgtggcctctgctaggctgttgcggctgagctgatgatcagggcaatttatccattcttagaaatctggtgagccctgcttcggctctgtgcaactgctaaattcagtttgtatggatttggcttggaatcacggccctgacgttccatttgattcagcttggctggggtaacgctcaggtcttttgtagaagagttcacaacactggccagttaaagggtggtgtgccctcaggcagtcagaaaatcttgtccactgactcattcattaacccacaaacagaacaggcattgccctaagtatttgggggtatgaaagaagctgatgtggatgtgttcctgtcccagaaggagctgatggttgtatctatgaaggtaagcatttttgtagatacgagcaccagccaccctaagcaaaggcagagaatgcttaggccagacagagggctagggcacttgaatagaaagagagcaattcttgggtacaagaagcccaagggaagttttctggaagaggtggcatttgagctggcccctatagaatcaataagattgggaaactgatatggtgtactttctctgtcaaaacatggcccatggagaacaaaaaacatagcaattgagacacagtaccaagtctggagggtagacttataaaaattgtgaaaagtgttgggaaaggaaaatgcaggccttttaggagagactaatgggaggtttataattcagattgggtgtgtaggggggtaaggggcaccaggattcaaactcggatcttaatgtttccagagcccacacccataattactgccctgcttcctcccagctgagatctctgcagggcccctgggtgaatcagagacagaagtcaggcctcccaactccctgggtcagccctctttcctcacagcctacctgctgcctgagctgctgcctcagggcacatgcctgtctgcctggctgatgtttcccatcagtggctgactccacactgtgctcttggaggtgaggtcagggacagcccaagcacccagactgcttagggcagacatgcaaggctcaggccctcctgaagcagtcgttaacctttcttcaaaggtcatgttgtggaaaacccctacttcagcctcccagctgtaatcacaaagggcatcagtgagaaagccttttcctgggaatgtctgttcttggtaacatgcccaggtcacaatctggaacatcagagtcccgttcacagaaacacggatcctgttgcaggcactctggccccaccatcgcccagtcctggagggtacttctggatactggacgatcaagttcagtgtctcctggctaaaggcagctcacgtaaacttcgcagctgcagcctgagaggcacgaggacccagtgtgtccacgaaccagaggtctttgtcctctgcctagggtttcccataaggaaaagctcacacggcaccgctgtccccacagcgccctgctgtggagcttgttctctgtgtgtccatgttccccgtcatgtgccctcccactccagtgatcattgctagtctgctgctgtcacttccctcctcctgtccctcttcctctctgacaaccctttcccagaatgcctctcctctcccctccctgggtgtcattctcttcaaaaaggttttttaaagagcgaatgtttaatttgtgtttgttgactaaatgaattaatcaagtagggctcttcattatgtaatgccttgtacatgcaaaagattatatgacatcaatagaaggtattaagaataaataaaatgcccactttaccaagttaaggcccctatctatgtggccctctgccagagtaacagcttccttaagtggcccttttttcctcttctccccgcagtctaatccactgtccacctgactgctggggccatctttgcccgcctcagctcccctccgttgctgtcaccagctacccaggtcagcatggcccgtcagcagagcacatgggctggcgccggccatccaggcagaacagaactgcgctagcctgtgccctgtaccctgctgtctccctgtcttggggtgcacagtttcctttacctggaataaccccacccacatgtcccatgtctctgcctgtcacacccacctttccttctaggccgcaaaatgtcatggttttcccaaagctgtacccaatttctccactcagctgtacttcctccttctctgagcccctttaaaacataggtggttttgcttttctcttgcagtgtatctgacattttgctaccttttattagggtgaggtttttttttttttttttttttcatttctaatctcacatactggattataagtgtcttgtggacagccacatgtctttgaatttgtagggcctagtagagcatcttgtgcatacataataggtcctcaacaaataattggattagaatggattgaacagtcctcccctaaagctcacctcacatctccttccctgaaatcctataaaaataagcacttgtctcccgagggagaagggcttcttggagcaggaatgtggttgatgcttaataaataatagctggatgaacaaatatttgcaaacatcctgcctaagatagaggattggactcagtgcttcctggggcagaaagttgtttaacctctatcacttcttgataaataatccctacattaggatatttggaattgccaactaggtatcatgtaaaggcaaaacaattatgatactgaatgtgcattctcacacacattggttgaggattacagctctcagaaggttgttcataaaggcatgatgtctctctgtaggtctctttggggacaggggattttgagggagattctgttggcccagtctcaactgttagtgcctttaagaaaacccaaactgattttctttagacaacactaagaaaagcatgcacaattctttgaaacaatttttaacagtaaaacatatttataccttttaattgtgctgtcttaacatttagagaaattaatatgcaaaaactttcaccactcttaactctcgtttctgttttccagtgctaccttccagtctttgtccatgtgtatgaaagaagctttcatttctgccagaaatgaaatcaaacttctgatgttttcctgttataaacatcaaatctaacaggcaaactttgtgaacacctactgtgtccaaagccatgtactgagaatggcgggagatacaaaaagagtttgttcactacacaagtatatactaaatgcttgccctgtgcctagagctgttctggtccatgataacagctgtgggtgagacaggtcctcagcttccaggatggaaagagaggcaccacacagaaaaataatatgtcaggggcagataggctatgaagaaaaataaacagggagggacttagagggggccattgttttatgagagtggtcagggacattctctccaagataacatttaagcagcctctgaaggaagtgtggaggtgagggaagagtgttctaggcagaagaaacagcaagtgcaaaggccctgaggtgggagtggtttttaagaaacagaagcctctatggcgggagggataggttggggaaatatgaagtcaagagagggagccagaggactgggctactttagaggctgcagaaggacttggacttttattccaggtgtgatgggagcccatgggaagtgttgatctcactgtggagaacagcccagagacaggaatagatgcagggagatcattaaggggctgctgaagtttctcaggagagaggctgtggtggcctatataaggtgctctactaggccgcacaaattcagagacatggggctgtccacaagaaactacggtggtagtgatttagggaggtagcagagcaatcaggtcctggatgtgttttgaaagtaaagccaacagatttcctttcatattgaatgtaggtgtgagagaaagagaggagtcaaggttgaatccaaggtttttggcctgagtaactgataaaatggaggtgatggtctctgagatacatggaatgggggggaacaagtttgggcagtgaagtcaggagttttgtttggattctcgaagctgcatatggctcctccgaagttcatggcaggtgctgctacgacaccgtttccttcagagccccagcatggcctcaccatctcaacacagtgctgcagaacccaatctagaatgaaaaccatcgcactttcctggcattgacagacaatccaggcatatccactggggaggggagaggagtgctggggaggaggctgttctgtggacaactggcatgatcagggaaagcaccaagggggagaggagctggaacagagcttttgtgtcaaggagccactggctgcaagtaacagaaaacccaattcagaagggcttaaaccataccggaaattatgaacacatatatcaagaagtctggaaattaagcaggcccacggttgcccaatgaagctatcagggacccaagtcttttctctctattcattgtgcctgcctcagcacaccagctggctcctccctgcagcagctccaggcattatggtttcaccacctaaatcaagggaaatgacagggtcgagcctctccctattttagaagccctgctgggagactggcccttacgctggacagatttagccctcattgcacagatttgggtcccatgtctcttcttaaaccaatcactggttagggcagtgggtttacatgatgtgcttctgccaatcaagaggagatagggacaccaggacacagctcagacttggccaacagggaagagagagaacaatggtggatggcttggccaccaacagtgtctgctccagccccaaaccatcaggaagaattggtactgagaagtaagaagggagggcgttctaggtggggagaaaagcatgagcagaggcacagaagcatgaagatacaaggtatgtccctcagacaagttggcggggttgatgagttgtatacagtgtggcatggaatgaaggccagaaagaaaccgtaattgctaaccttatttggggatcttcttggcttaccaggggtcttcagaccagtacttaaaaaccacagatctagaaggccaaccatctcaaggaaggaattcttgaagaactgtaagccttggccaattagactagataaagccactgttaatattcctctgagcacttccactttgggggaagatggaatgtcctcagcttagtccctgtgctgatgccaggtttagttgggtggctcttgggtagaaaaaagagcatgcaagacagagctttcctttggaaaacatagccagaagctgatcctgagtatcagtcatcctgctttcattgagattgcgtatcaaaccctttcaggtacaaatggcagaaatcctgcccaatgacttaaaaaataagcttagccacctctctcactgaaaagtctggctcctggggctgtaaggatgttatcaggacctagtggctcctctctaggctctgctttcctccatgttaacttcactctcaggtggattcacccctcagcctcagctccaaatccccatgcaaagtgtttctttactggatatcccaggaagagtcttaatgcttctcactgattctgattgacttatgttccatccctgaaccaaccattgtggttttggggaatggaatatgttgacttagtccccaccttaatgacatttggccaagagctggggagaagtggctcttcgaacacttgatgttggcaaagaggtgaaagaatgaatataaggtggccccaagccacaaatgtctaatctatgattttacccccgagtctaagatctcacatttttcacttcagcatcagtttgtgtgttttacagtctacaacaggctatcataggcatcccacttaatcctaataacacccctataaaggaggctgggtggcaattatcctatttatagatgaggagactgagggttagagaaattcagttatttgtccaggaccatctcgatcgaaattggcaagtctggcctttgaacctgggacttgtaaccctcttccagtgaagttgcccattacactgatgacttacaatgcatctgcctgcatattcgaggagagaagttcttaaaacttctacaagtgaaatcaagttcacttctgtaagtgaaatcaagttgaagagtcagctcaaggagtgcaatatgtaaatggtaaaataaacaacatcattaagctcaagggcatgttttaataacagttaaataacttttacaaaatagcaaatattttcccattctgctgaaatgggtcttaggaaaaaggattgtaatatagaaccccaggtggtcaagtgcacattggattttcctaacagcctcctttataaagaagagcttgcctgtggctttgtttccttactctccagcctcaccttcctccccttgcctatgctcaaaccattgcccactaatagttctgcagatcccaggatagaagttaatctgcttggaaggttggtccacttagcttttccccacaggtgtcattttggtacctggtgagagggtctgcctgtctccctctcactctgcactccagcaccagtcagcgaggctgccatcttccctgatcaagagctggctccagagtgaactgtaaagcacccctgttagatttcctggcatttgtaaggaccttttctggggcccagacagaaccagaggcctccagccagaggcaccaatcctctgaggccctggtgcatgggcaacaaatgagactttttgcctccagaaggagctataagcagaaattataggaagtataataaatcatcctcccgccctcaaagtagggccacaccaaggaaggtagagggaattctgtatcaaatgagctgatcaggccaaaatgtgtgtttacttctcattgagaacatatctgcaggtacatggtaaactacaagtactatactgtgttcctcttggttattagtctctggatggcacagccaattgcagtacaaggtgggatggcccctgtgaacccaagtcttctgactccaagtccccaaggctggccccctagatgccaggctgctggacaggaccctcagacaaggctagggaaagcagtaagtgctgtgcttcctgggccagcctcagcagggcactgggttgcaaggagagcagttcagatgaggtgggcactactagtgccttgctcagagcacaagcttccaagtaacacagaagctcagttctgccactcaccacctgagtgaccttgagcaagcgagttgatctctcttggcctgcatttcctcctctgaggaatcttctaatagtacctttcttggagagtcgtgaggatgaaatggggaggtgcacacaaaccacccagcacgacgtctggcacagggtatttgcttgatactttcgcatagtgaggctgacataggaagaacttctcatcacagctcatccacacccccacatcaggaatgctcaagtagacccttctcccctcccaaccttcctcctggccccggccccatccagctgttccttcttgtgggcagtggggtgggccctgtcttcagtgcagacatgccctgttgcccttgagtgcattggcctgtcccccccaccaaccccaacagctcacagggcctcttggtatgggaagtgcaagtcaccctgaggaggtgccgtccatgctggagccagattctgaggctgcaatggaactttgggctgatgcactcacattgcttgccttctgccaagagttctgctggggagctgccctcggctaacctctgagtgtctgactagatagcagcagcggcagcagcagccatctctggagccaagcatttgagcagagaacagctgctcctggtcctgggccccctcttgcctggcccaggttccagtcagctctgcctaaaagactccccagggcagcctggctctggtgccaggacccttcaccctcctcgttcctccatctcacccgcaacagtgtgtgactgatcgactcctcctgccactttgtcttatcacgaagattagcagggaggaagctgggatgtggagtcagaagacctgggttggagccccagcccggctacttgctggcctgtgaccttgagcaggtcccatcctttccacacttctggaagatgggagaagagaatctttattctttcttcttaattgggcaagtgtgattaattgtaatgcaatgcagagttgcctgatgagaagcttttaaagcaagccagaggtgtgtttgagtgaaagatgaaaatattctttacagccctgtggggcgggtgttggtcactcttcatctgtttggtgttggtaggtgaaagcaggccagctcactgggccactcttcagcctccatgctgagccctgttacctactgggtccctctcaagttcagtccctgtgggaggtatgcacagacatgtgtagccaggatttgacccgatgggccatgcactttgccatcacatggaagcagagtgggggacatgtggcagcttgtgggatgaaggggccagacctgggccctgccttctccccagcctggggtagcagggagatgccaactcttcctgggattgagcttctacttaaaaaacaaacaaaaaaaagtgttgaaattctaattaaaagttgtattaagttccagtgtacacggggcattttttataatgttaaatgttcccatttaagaacatatgccttttcttcaaatctggttttatgcccttccataaaatttttttttattaaacatacattgtttgtttggggaagataaaattttgtttaattaaaaaaataaacatatcttgtgaaatttattaagtttatatctgtgatcaagttttgtaagtgattcaggtcccaacaaatgatctattccagattcaaggaatgcagggccctatatatttctagtaattcaaattatattttttattttctctgttatcttaatttttgcctatatgtctatttttgaaatagacatctttgaaatttcacactaaaattttatttattccatttctaataatggatgcttcatatatttagcttctgtgtttaatgcattaaagtttctgatggtcattaatgtcttcataaaataagtgttccttttatcatcacaaacatctgtatcctctgcagcatttttttaaactaaaattctcccttatctaattaattttgacacttctccctccttttgtttgcacttgcctagtatctgcttgcctatgcatttattttcaacatttctgtatacctttattttaatcagttttcttataaacagcatgcacctggagcttggtttttgttttaatttcttaacccaatctggcatcttctgtttttaatgagtaatctaatctgttgactgatgtactggattttatttcttccatctacagtatgtttataatttctttctgtcgtattttgtttcccttgcttgtgctggtttaatgtagttgcttcaaatttcatcttttccccatattctctatgttcccatagagaacacagggaaagttctctacttttccctttcattaaaggttacattctttttcccttaattcataattaaacacatattgctttaatgttatttgaacacaagataacatgaaataactgttcctccctccaagatgttccattctctccctgctcttccctgcttcagtgggatgagacgttaaaattgtttccctgtccctacttaagatgagaccttggaacacttttcctcccatcctcttcaactccttgattctgttaggaacatttaatatttttagctttgagctgttggtggaatttcccttgtagtatgtcccttctattttcagagtccttctttagcagttccattcccagaacatctaccattctccatttagatttaggagaaaagggaggggcaggtgtgtggcaatcttccttactcctcacggtttcctgaccagttcattttccccaggtcaaggaaaaatgttctgccacatttgttgtttgttgctttaagtattttccatagatgagatgtatgggtgataaactatgaattcttgtgtgtttcctctaaaaaatgatgggcaaactatttgaggtctttggttatcttttctgagtagtgtatacatggtattctgctctcttttagtttgtagtgtttcagatgagaagttcaatgtcagtcttactcttttttccttataggcaatatgttctttctgtctggaagcttttaagattttgtgttcatcttgaagtttagcagttgtaccaaggtaacctatgtgtatgtcttttcttgtcgtccttcctggaactgtgtgagccttttcaatctgtagagtcagttcttttttcagttcagggcaattgtcttctgtttgttatttaattattggctgtcctctctcagtttgtttttctacttctagaactcccaatatttttaagttagatccccctggatctgtcctccatgtctgttatcttttcccttataaattatatatctatatttttactgtatatttggagataggttttccattttgtcttccagaccaccaattcacatctcaacagggactcacctgcaatagttgggaagacattgttttaatatgtgagaaatcttttaagtctgccctgagttgctgtagggctcatgtgatgttctgcttgagttttcatttgtctcttggagcagctgcacttcactgggcttgtgcactgttcgttctgacagatcttcttctgccaggactttgaagcatgttgtgagtgttctttgttctttgtacctctggttatggagcccagagtggcagcagtccacagctggtgggagtggagctgtccttacccttggagccagtggtattgaggcaggtgagccaccagtctactcctgagacatctgtctcccttacttcccattcccctttggctacagggcagggggttgcagcccactggttcagccacttcttggtctgacctgggtcaatcaggcaaagccagtttctacctgcgctccattacgtgccaaattccacccacatacacacacacactagggatccactggtcttccttggccaagttctttccggcatccatggcttttgatccttgctccaaagctctctgaagctggtctctaataagggagatccccacaccagtttttcagccttgtttcccgcatgtacccccatctgcccaaaggcctcagcagttctctaatttaggattgaacagataggttagagatgataatctctttcaggttgccatgttctcaggatctgttgtcttttctcagttactgatggatcaactgagactggaggtcagtctctttctctctgtctctctctctctctctctctctctctctctctgtgtgtgtgtgtgtgtgtgtgtgtgtgtgtgtgtgtgtgtgtttgtctttttttctggataggctatccctatggctgcactcaggggccactaacactccccattactctttgtctagttgaatctgattagacactggactagcttccagaatcatatactccagagtgcctcaaattacaggacggacactgccagtggcccaagatgagttgcagtggtgcaaggacagtgtttgagaatgttgaatcccgtggtgggaaagttgtttgttcagttctcttttagttcttctaattatggcaaatagtctcgcgtttggcattactatgcctttgacacatctctagcactcattaaattcccttttaataaaacagagatcaaatgtcatgcccagtcttcagtaggcaacagtattttctgtggtggggaaggctgaaaggggactgggtttgggggggggaaattagaagttcagttaggagcccatttattctgccctgcctagtacatatttaagtggagatgttgagtcggcaatccatggtcttagccctggggcactccagtgtttagatattggattccttcccctttgccaaccaatgcagaaggtgcctttcctacttgttggctgaatgtctttgcatcggctagctcaggaggtttgtttcccatcactctgggccacttcttggcagccaaggccacgtgattgtcattagtgttccgtgtgtctgaccaagcagcccttaagtgcaaacatggaccgtggccaaccttccagctgtgtagagccttctggctgtgcatcttgttgggtccttgggggggtgtggtatcccccagtgaggcttcataaaaaggtggaagcaagctgaaccgttttcacaagtttgaacatggttcacactaatgattcactggacctgtcaaatttctgactacagcccgtatttattaggatgaaaaaaaaatcttccattagtttagcacttttccttcttaccaacatgcaggaaacatttattctacctgaaacgtgaggctgatgccattaactgactctgtgaaggagtcctaatgccaacagggccagcaggctggtagactgagggctgtgggcgtagactgacacctgatggggcgtgtggatcacgagagcaccagcctagcccacggcaggcagccaaactcaggcctcacctaaggaggcagaccagcatgtccgattcttcaggagaaccagaaatcagtgtccttttgtgacaattcttctgatttataaatgtttgcttaaaggaaaaaaataaaaagaaaagaaaaactcaaaactactgcaggccaaacaaaatacatctccctggcccaaatccaggctgcagatggccagtttgagacctctgctacgtgactgcaggccagccaatcactctgattcttatacttcccaccattactgtgaaacagagccactaccaggcttgctgaggtggagattatgagtggggttctgttttagctcccagctctgctgcttactggctctgagatggtggccaagtagtcagttaacctccctaagcctcagtctccttatttgtaaaatgaggataactgggttattcattcctatcatgaggacttcatgagaaaatatataaaaatgtccagcacaaagttggtgttttgtcaagaggaactgttgttactgttcagtaacacgtgaaatgtttggaaaacctgaaagggagtgttgggcatttgacagttatgggtagtggcacaccacccagagcagaaaaccccttgcccatggttctgtcatagtgaggggcaacagggcctgatgatggtggatatattcctagagtcctggaacttgccattcaggaagagccctgttccccagcagcttccctgtggggtggtgtcagaagcaggcctagctgttctcccacaaatcggtctggacagacttgcagcctctgggcagcccctgcctgttacagagcgcttcccaagattgaaaggtgctgagaaggcaggggagagtttcctgcagctcctctgggagagacaggggattggggcaggcaatagctcttgggtgggagtaggcaggagaactttcagtctgaagttagacagggaagccctgtgcatttctgacctcaagagccccattgttattgcttctcattttgacacagatgtcccagtcaaggccactcctgtgcacagccctttgttctttatggaaagtgctgccaggcacacatacgcgtggctttagatggcgtatacattcttacatgaccagctgaagagccttagggacattttgtgatcagtgggcgtcagcaagtccatgttggagctggggacatgcaggagccagtgcaggaagaaagccttgtttcagagggtgtggatagcaccactttaggaagcccctcaggaatgagagcaacacacttgaaataggaccaaatgcatcttcagcctcacatgctgtgtgaatgccgcctccttgtcagggaacgtgatctgcaccagtcaaagaggcaaatgccaggccttgcactcaggaggtgttgggtaaatgtttactgaactgaattccattcttgggagccctatttgtgccacatctaatgctggaaattatgtgtattctaccccttctcaccatccttcctggtttccaactgccctgttccataccagcctgacccacatgcatgttggagcttgaagctcagtggatacagaagtgtcttgggacagttgtctcagcattgctggccgtggtgataataagcagatgtgactgtgatggtgatcccgacagtgtcagagctctccctagacagtcttcatccatgcatccattgttcattccttcagtagccatgcgtctggcactggccagggctgagcagacagtgctgggagtggtctgcagaaggggcagggcgggggttcatgtggtaaggattaagctagaaaactggaaaggcctttaaagaggggtaagagtttatgactcagggccagtgtgacaacagaaatcttctgattgttgggaccccttcttaatgtggacattgtttaatgcctttaccctttttcacagttggtcagaagtcttgactctcaccagcctggtctgcttcctctgaatgtgcctgaagtcatcagtattccttggatatttagtctgagggctgtccataaagtggagagctcttgagaacacccatgtttgatagccacataaccttgggaaagctcattaactttcttattaaccagtttcttcatcttcaaagtggagctagcactaacacttgcatagctttgactacagctgatgtcaggaggcaggggttattgggaggattcagtgtggcagtgtccatgaagcccttagcacagtgcctgcacctgaagggattcaacagaggctgccgctactctgttctcccaggcccagctctcgctactgtggcgtggctaagtgacaatgggcagtgtgggctgtgggccttttttctttttgtctctacctgaaatccagatgagagtctgagagagtggacagagtctcaggatggcagcttgaggggcctgttctccttagcctgcttgtcttcaacgtgcaccaattttaggcttgattcacactgaaaattcctcagctgccggctgctgggccagaagcaggcctttgtctcagagagacccagagaccatgatgaaggctgagcatacctgccctcctgctggcctctcagactgcagcagagcctctactgagcccgactctgagagggaacagctgggctctccacagggtctgccacccctacagccaagtatgtgctttggctttggcatccagaacacactgccccacccaaacatccctagagaggggatcgatgtggaagcccacaaagtgatctttgtggactctttttttgggggcatgaccacgctatcatggttattaatgaggaacttccatatgcttgagaaggcctggagtgggaagcctgggagccgcggcggggctatttaaatccaccacacagagagtggcatcctttctgggccacgtctaccaccagaaaaggaagactggctgggctgggttttgctgtgtctctctgtgaatgtatttctctggcaagacatgctgtcacctggaattctcccctactcttgttcaaaggcccaacaaaggggtggcgcagagggaaccagaaggatgtggctcacgtccatgtagtcagagatgtttggggacctgacccaatgcagacatagccatctttgtccagcaaaagttggcgtggcaactgaccactgccgtttcatttgaggagacatgagttaccctggagaggaatgtgcattcagacttgcttttggcagactttaccataagcagtcctctcagaggacatgagaaatcatgatttccctgaggagcccccatttggggtgatctgtaccttttgccttgaactctcctaggcagggagctgagaagggcgtcttttgtctgtttcagaacactcacctaaaatggtccaccatctggggcaacgcttaggaggctctgtggcaaatctcaaaggcacgtgtgccaagcagcctgcactggagaatgagggattctgtccatgcccctttgtctcttcaggttgctggtggtgtattggtgtccttctctgcccaatcacatggcaaggagaagaaaaacaagtcttcatttaaaaagaacaggaagggaaaaatcaagagcctatgaaaagcattttccaggctggctaggtctgtaatgtagaagagacacaagggagtgaaattcctcatgttttggggttaggtggagtcgggggaggagtggacagtcctttgggatcagctgatccccgaaatgcccaaaagagaaaatgacctccagtatggcttgcttggctcagccgctgcaaaatgggatgggggcagctgctgtcctatggtggtgtaaccctcagagccctcagaacctgttcagtaaccaggcaccccctttcagatcagcaagtctgtgtgaccgtccgatgccctgctgccatctttccaaacaaacgtccaagggctatgcagcttcaatgccgtcaagactcctgactgctaagaacagaaacctgccctagagtgactgaaacgtgttgtctcatgtcactgactagcctaggggtacactagcttcaggcatggctggatccacatgtgtgtgatactaactgacaggtgtggatcaggaactcactcagccctgggacttaggctagaagtggggagaatcctcaaagtgtgagaaaggatggttcccccaaggaaagttgagctcctatctctcaaggaagggaggagttgcacaggcagccagcagatgtccactacagccctcatttgccatttgcagagctcaggctccctcaggtatattctgcagtgagtcaccaccgcgccccacagcaagtcgcaagggagccaggaggaacccagataggagccctcccacaggctgtcagagccccacctggtctgtttggatgacagagccttttggacttgcctggtgtcagaaaggacaatgtcttaggtaacctgggtttgtaaaagccttgtctgtgagctgtcagccaaagacagcagcttttgtggtcttttctctttcctgtggttcatgagaacacatctaggcgctaatgagcaggaacataaataatgaacaaacataccgtcaacaggaaggcaggaagtttttttttttccccaaagactgaacaagatgagcaaagctctgcagccgtacttgcgcattctccacaaaatataattaaaaagctatgcagactgctcccaatgtacagtattgtttatatactaaacataatgtactaataggaatacctcacttcattatgtcagcagaatacgaaagggagatctagcagctgcccttatcaggcagatgggagaccagaaatgttacttagatctaggcagtaaaattgacattgaaccaatttgcctcactcgtgccgcttttactgtgtttaacaaaagctcatgtctgcacataaggcattgtgaggaggactcagcagccataaagctctctgtcatgtctctgcaacataaccagtgaatttaaccgttgggtttcaaagaacagttttggattttcctggaaataagcctacagaggacagcataaggcagctgtgtgtcctgacccttagaaacctgtgagaaccaagacatcagggttgaaggaggggaacccatgccagtgaatgagggagcgagtctagttacaatcacaaggaaagggccacagactccgggcccaagggggaagactattcagtccgcaaggtggagatgggattggcagccagggctatgagtgggggatggtggagagagatatgtccatctggggccactgtttacaggctacccaccttcacagaaaggagttatatgtggagccctcattttagagccagaggtcccaagcaatcacctgtttcattcagccattcatccagcattgattgatcattcgccatgtaccaagctctgccctgggcactacagtctgtgaactcagtcctcatggagctcacgtcgatatgtggggaaacagatggtatacaaataaaaatatacataccaggtggtgatacatgtgatgaaggaaaataaggaagaataaaggcacagaataatgtagggaaggggccgtagtcagactggtctgaggaggtgacatccgagcagagccctgaatgcaatgaggtatgcaggtctctatttcagagctcctcaatcttttgtccaacaagaacccctttgattatttgccccccatgagtcactatgttttgtgagctggtgtatcccagaaaggatgcatttggcaaagatgtagacgtagacatagacatagatatgaccgtgacccttggtcaacctgagaaacggggcaaccacaggaagttgatgcaacccagccccaaagccaacacctgacctgtccaagaggctgggcaatatacatagaaaatgagtccagagtcccagtggcttgtccaagcttatgccagctggtcagcagcagagctaagacttagaccccgggtctcctgagtgatgaaattggggtggaagctgccacagtcagtggcagtatttcccaaacacacaggcatgaaaaaggcagtggctggaatctgagggtgggtcaggaggcctgaggtcttcccaagaggaggccgacagagctgccttgaaggacttcctccaccaccaagggggagccccaggccagggccgatgatgcaggcctgagaaggattcttctgccctcatcacctggggttgcagtgttgatggccaatctgcataagaatctgagtcttatatctccaaagttcaagtcacgatatctgtaatctagggccaggggccccagaccagcaatgctacccagaaggcgagaaggaacagagctctagcaggcagttctctgagcattacgctgccgctgccgtggactgacagctggcctgtgcagcccccacctccacccaccccagcactgtgagctgagggaaagggcagggttcatgttgtttttcagataatgacagcagaggctctgcactggaatcacaagtcctggccttgcccctggctctgtctggtgacaattggcagctgacatctttgcttctggccagagctaccccttattaaaaatggcatctttataatagatttctgcaagtcattgtcaacaggacatccttcttgttttgtaccaatcattcctctgggggactgattttgcctgttactattattttagaactctttagaatacccttttattctatattattctgatattagaatatcaagttttaatatagtattaaaaatatagtattaaatatagtattttaatatagtattattactaattaatatatttttatcgtatagtatatagtattaatatagtatatagtatagtatactaattatatagtattaattaataattaataattactaaagtggtcataattattttttaaataaatgttcgcataccatacagcttcaccccacaattaaacagctggatttttagctgagtcttctcttctttccaaatagccaagggatccatttgtgcccaagttattcatcctcactttgtaaggcctaggtgtcacccagcctctatcttgtcccatctaggttttgtggttttctgcctcccttgggagaagcaccctcgtggtcagacaagccccccagcccgagcagctgaatctgaagctggaaagagctctcattcgtgagcagcccaaatgtccaccgtgaggggtttggttgaatagctcatggcccattcagatgatgagactaagcagctaatagaaccccagggtcacatggagccacatcaatgacttcttcctgaagtcatctctggccatgctggatggagcctggtgcccctcttatgcatgtccacagctcctgggctagacagcagctccagaaggcaggcctggccatgcaggtcgggctcactgccctgtatccagtgcctggaatgaagaaagcacttcataaacagctgttaaaatgaatatacagttcagtgtagaaaacaacatgtacagtgggattccattttagggaaaataatactcgtgcggactcccaggtaaaaggactgaaatataccccaacatgtggacggtggttccctccagctggtgggttgatggctgaaatttttttcttcttttttgcttagctgtgtgggctataatctataagtgttccaagaacaggcctttcagtcagggctggagaagtcagggaaagaggagggaaagctgccatttaaaagtgatccacaattagagcagaaccactggtgggaggcaagatggtttggggacgaatgtgtttttttttaacaggtgagcatttgttttaatgtgtagctgagaaaaaattttgagtagtacattagccatagtactggtccctgctgctcctctggcctcatcccccactttccctatcactcactaggttcaagccctgctggttcctcatcattagaacactaaaggtgccccggggcctttgctcttgctgctccctctgcctgttgcgttcttcctcaccaatatgcaaggcccacttcttatcactgaggcctcagcttcatgccacctcatggctcttaactctacccttccccactaactactagttttgtgtttattactctgtaatatttgtttacttctttatgctttcccctattgagctgtgagtcctttgaaggcagggcctctgtctgtcctgttcgccagtctcctgggtgctgtgtgaactgcacctggtacatagcagtcagttctgttagatgagaagaggaggatgccgtcagtggggggattgaaggaggccataatctcagggatggctgagctctgccagtcaaggaagcagcctttatgcctggtaaagagcaaagcttctgacttcccatcaggggcctctacactcttggaattctgggaaatcagaaattaagacccagaataattgctttgcaaaacatacacatcttacttctgcccaaccagtggtccctctgagccagtcattcaaaacatggatactgtctggccccccagcaccacattcagttgagtcaaggcactgctgcaccagatggaaggagggcccgtggcttgggaaacaagactagtggtctagccctgctttggcactgaattgcctgagacttttaaataatattagcagctgacatttattgggccctactgagtgccagaccctccccacacattaatactgccagtgaccctgtgaaggacaagatcattgtccccattttacaggggagagacctagactcagggaggttgagaacttgcccacagtccaactgtcagtgaataggagactcagggtgtgccccactcttaacacgtgctcagtatatatatattcatggagggaatgaataaacaaaggaaagagtggtgttctctaggggatttgggctgctgcagttcctagaaagccctcccagtccccagccgccaccgtgtccacatcgtgtgccctctggaccactgcagaccactctgcttagtcctcagtcttgatggtatcccctgagtcaggaagccaggtccctcctgcagatccagcaccactggccacaagaccacattccagggaaaggaaatacaagagcagagttagtgggagctccaacaggtagaagaagagggaggagggtccaggcggggctctctctccccgttcccctggggtgcctgccctctgctgagcccacctccaagtaggtatgctgccagtgcctgccagtgcctctcaaccaggcggtgttggtgacatttcccccattgagtcagcttgctgttcatgccttctccttgagtcaatggaagcctccctcaggagggaacggcagacccgtgccagtgccagctccagggaagcctgctgactggggtctctggcttccggtcccaccggccagcacgtgagctgccttcatgcatttcacacacatttcccgagcactctgtgggacaaggggggctctgggaggtgcgaagggaccacacagcgttgtctccaggcaccggtgctgttctcttgtctggattgtcctaccttgtctgtccagccagcacctgctccgtggtcactgctgtttcctgagaggccggtcccaccctccaccatgcacctgtactgtaggtgctccttcaggtcgtattttccccttattcccattatgatttatagaaccatttgtgacattacttctttcatattgttcttccctattagaatgcaagctccacaagggcagggattgtgtctgtcgcttttatcccagcccatgatatggtggctggcacctagtaggtatgcaaataatatatgaaaaatgaattagggaatcaatgaatagagatgcttacagaatatacccctgccccccacccctacaggaacacctctaaattattgggagctggatcttttaagacagaaggtaaaaacatctttccattttgcatttgattagatgtttttctcacctggtgtcacccatcacctcccctctcccaggggagcatcaagggaggtaagacgcctgtagcacaatggaaaggcctctgggggttttgtccctgctctgccacaaactaaatgtgcctgtaggcacatctcttcctctccatatcacagttttccatctggaaaatgactatttctgtgtgggctctaagcagaaccatttatttggccagtcttcgtggcaaaggaggcagggaaaggaactcttcatgagaagggagtggctttcaggtggcagccagcacatccttcaactggcccttggcagatgccacttttttgttgttaattttcatttcttggcactagccttatcttaccatctagattgagaagctctggaagggagggaccaggcctcataggctttaagtcggaagagaccttccagcaggctgaacccaaatgtgtcactccaggagattcgtattgatcaatgactctaccccttttactcaagtattctctctaggtcaaaatggtccctagtaggttaaacacgaagtgtctgtctcccattggaaatgacttgttgttcttccagataacaagtatacatttttaaacatgaaacaaaacatacaaagaagaaagtttaaaaaaatcactgaatgccaccacccaaaagtgattattaatacatcttgttacacatcctcacataataactccctctccctccttctccctccataccacaccctacctcctgcccccacccacaaacagttttatgaaaacagctgcacaggacacacactgtaaccagcattttcactttaccgtcctgtccagatcctggtctcgtaggttctgtggagcccccaattcctggcatgtggcttcttccctcactgacatctgacagttgtttgattaaaaatgtgtcatatgaggccaggcaggtctgtccctacctccactggggaggcagatggcttcaggggccacgtcccattactgccgagatctccctgacggctggaaaccattggtgctgtgcatgggagtgaagcactgggccctgaccctaacccaggcagccacagcacagctctccgtcagtgttcagaaacatatttcatgacacgttaagacagcctcaaatcaggaaatccaccttctcatcccacaaccactcccaacgtgttcatttggtaaatggtaaatgagcagattctctgctttggtccggagaaaccccctctgccgctcttcttttctccactgtggcttgttaacccttgctgctgttgttgctgctcctcctcctcctcctcctcctgacaagcagtggtcctcccagccttccctccccgtggacccagttcacatcctcttcctcaagaggacagacgcgggacgcctgactgactgcacgttctcccccgtccctcgtaccaagtatggcaacaataataatagctagcactgattgactgccgactgtgctgggcactctacatggattcattcttttgatcctaaccatgaaccagctctgttaccacgcccatctcccaggaacagatgcggaaacaagcacccggtctcagctagagtctggctctagaagcccccgcttcctgtggatcattaaagggattgtgatggaggaggagcggcagtccagtcccagggcaggagccagggcgctgataaagggagcagacgaggggcatttaatctagctggagatgtagtgaaaaaccatgtatcccaacagcctagggcctctgagtttgtgaccctccagaagttgggggggaaactgtatgtgttggtacattgtcacactgtcagaggagtctatgattcagagaaggagaatggctgctgggccagatgagcctccaaggtcccttccagctcccaagcctgtggttctgtgaccatataaggccagcatgcctggggagtctcactgcagctaagtgcagtcctacactgcaagggggaagcagagagcaaagggagcccaagtccaggcctcctgcagggtccctaaggcagcagagagagaaatggaggtgcggggagaaccagggtttctccttggttgcctcttcccagaaagctcagacctgtgcaggcgggcttggttgccaccctctgtctctccccatacccacgtgagatctcctctcagcagcgttgccaggtttccagagtccagctggcggtttctgtccaaagtcaaacactccacagtcagtccttggttgttcagacctcctgttccttatggtgcttctggtttggtggcctggaacacccctgagcgtccctgagttttgggtggacatgaattcagaatctagcttgatctccctttgataccctggctttgcagtcataagaaatctagtaggtccccaccctgacacacacacacacacacacacacacataacacacacagggacacacacgtctgcctcctttagtgagtgctctggagagggacaggtctggtgcatctgtgtactcctgactcatgtagttatgtcccactttatccaagcactgtctggagctcaaccctatgccaggagatatgggaagaaagcagagataggtgagatgtggtgctttaattttaaaaattaaaaattagtaaacaagtcttctgggagatgatctctgattattattgttatcagggtacaaaatatgtaccttttagtcatgtctctgttggttctaagtggcagaagcccaaatcaaattagcttattcaaaattgagagggaattatttggctcatatcactcaaaagtatggggtgggcttcaggcatggttggacccaggggctcaaatgatgtttctgggacttgattctgcactcaatcgctcagctatgtagatgaacagcccacctggggctgctgcaatgtgagatgccactgactgttgctaaggtatctcgtggagcctcgctcctgatttccaaatcctggccttgtcacctccacaactcagacctgggctgtcacatgagactgaactctccagagctgtatctccaactccaacccagaggcctcctttccttgccagaacattgggcagatacaacagggtgagttccaatgcttgttttgtgggtgaaatctctggattctcctggatatagggactcagggcagaaggagaagccctgcctttcagcatttgccatttaccagctgtatgtcgagtaagtggcctaacctatctgagcctcagtttcctcatctgtaaagaggagataatttatctcctagaattgttttgaaggttaaatgaaatgacacatgtaaagcacttagcacagagggtaaaccctcaaacatgagctgcaattattctgcttatcttatactgcaaatgaaagaaattatgtttgcaggattttaactttagaatgaaaatgctattattttttttggttgagacagagtctcgctctgtcgcccaggctggagtgcagtggcgtgatcttggttcactgccacgtcctcctcctgggttgcagtgattctcctgcctcagcctcccaagtagctgggactacaggtgcatgccaccacaccaggctaatttttgtatttttcagtagagacggggtttcaccatgttagccaggctggtctcaaactcctgacctcgtgatctgcctgcctcagcctccgaaagtgctgggattacaggcatgagccactgcgtccggtggaaaatattaatagctaccatttgttttatacttactatatggtaggcactttacatttattcctcccaactcttttgcttatgaggaaaccaaggctcaggagattaaattgtttaccagggacacacagctcatcctgtccaatgcccaacctctaaccactgctctactcggcctttctaaaatggtgtggggaaatagaaaataaagagggtctttattgatacatttaaggatatttgcctcaaatcaatgctagcaagaaaaaaagaagaggaatgtggcatttaaaaaagccagagggatgacttaacatttaaaaattcagtgttcttctgagttttgggagtatgaataatatttcctgttgtcggtgaaaccccgtctctactaaaaatacaaaaaattagccaggcatggtggcgggcgcctgtagtcccagctacttgggaggctgaggcaggagaatggcatgaaccaaggaggcagagcttgcagtgagccgagattgcgccgctgcactccagcctgggcgacagacagagcgagactccatctgaaaaaaaaaaggatatttcttgttgttctgtatggaccaaattttctagtcttaagtatttattacattgtagtagaaggggatataaaattctacccagaaacaggaagcctatttttaacctaatataagccagtttgaacaacttatagggctaatcatgatttgagcaatttcccccaaattgcaacatttctgcaaactgcaaatgaagcttctttatcttgggacaccccaggcaacagattgagacctgccaggcagtattttcagcccatgaattgaagtgtgatagaaagtactgtgagcttggagacctgtatcctgttcttggcccaggctcttacctgctgagagatattggggcaattacttattctctctcagcctcagttttctcttctgtcaaatgggtataataaaatcccaccctttccacctgatcaagtgcatataaagattaatgatatcaataggtgtgaaataggttgaaggaagtcccagagccagccataggtctagagaacattcccaggagagtggtagggtctgctggtcccaaatgaagcatgagaaactcaatgcactggcttctggggaagcatatcatagcatggggaccagcaaatcctgcctgcaccactcaggtcacccaaagggtcccaccctcttaggggaatctaggtaccagttgcctttcttttctgttttttagtatttacgctagagtttacaatgtgtatcttgacttattacactttactttcaaataatattatattaatactacttttttcacatacaagaatctttctacagtatagagtatactttcattttatccctcccatcctttgtgctatggttgaagttttatttctatgtatgttataaacataatacatttttcagcttcttccctctctttgtttcaatttagatagtttttattgccatgttttcaagttcactcatcttctgtatgtctaatctgctgttaatcccatccagtgaaatttttattttagatattatattttcatcagttgatattcccttttgttctttttaatgtcttccatttctttcctcattatgttcataattcccttcaatttcttagaaatatttaaaatagatgttttaaaattcttattaattccatgatctctgtcactgctgggtctgtttctgttgactgcattttatcatagttatgggtcatgcttttctgcttctttgcatattcaggaattatttgtgtgatgctgatactatgaatattatattgttgaatgtctagattttgttgttctcatgtaaagactgttggactttattctccaggtagttaagttacttgtagatcagcttgatttttttttaactttgtttttaagcttcatgagggcaggtctaaagcagcctttactctggagctagctcagccccgttgctatggcatgagccttctggcgtctctgctgagtgccccaggcgttcaacaaggactcttcactctggctgtttggaacttgaatatctcccagccttgaatgagctctgggaagcgttcaactgataagctccctgatgcttgttctttctttagtaattgttccttgaccagctgtggaatcttaccctatccagccacagactccaaggagacccctgtgcactctctgaagcatctgaagtgctctctcttcgcagttttctcccctctggtacgctgcccttccagctacctcagctttcctgaactcactttttctcttcagctcagtgaaatggctgtgttctgcctgggttccctcctgcactgtggtctagtaaacacctaaaggcggacgcccaggccatcaccggactctcctccttggtctcccttctctcagggatcacagtcctgcactgtctattctccagtgtttgaagatgcttgtttcacatattttgtctggttttctagttgtttacagtgggagctagcaaagatccctttgagatctctctggggtggtgcaccagtggcctgtactggttatgtactccctcaagatacttttacaaaactggacttaggaataatgaaagtcgacagaaagttaatagggtcattctgatctgctttttagagaaattcagggtgaagacccgcaaaccagcaccaagtggaatttgcagcaggaatcattattgtacgtcaactgatgactggataaataaaatgtggtacatccatacagtggaatactattcagtaataaaaaggaatgagctactgatacatgctacaacatgaatgaatcttgaaaacattgtgctaagtgaaagaaaccagtcacaaaagaccatacattgtatggttccatttatatgaactgtccagaatagccgaatttatagaaacaaaatgtagatcagtggttgcttagggtaggggcagggcatggacagtaactgctaatggatacaaagttccttttggggagattgaaatgttctaaaattagattgtggtgatgattgaccaaccttgtgaatatactaaaaaccattgaattgtatactttaagtaggtagagtctatatatgaactatatctcaataaaactgttgtttttaaaaaaagaagaagaatctttagccattttctcctgcatgaaagtaatgaaggaattggaaggagccttggtatggtagaaaggaggtctcagttattatattggtgcgtgaacgtgtcacaagtagtgttctatctgggactgaaaatatgaccacagaagagtttacatagttcattgagggaggacaaatgtaggatgttaatcttaaaattcatttgctctttctggattactttagttataagaggattcttgtggttttggcgtgagcccctccttctagctttctctcctgcccggatccttgtcagcagtgagcacatgttgagtggctagcaggcagtgccacgtggcctctgaaagttgtgatgtcccctttatgtcttctttgtccctgttcagatccaccagaacgagggtggtatgtggttaaatcctagccaaggatgaaaaagtaggcaaacccttttattgacttttctgttgtcaaagataaagatggttatttgtttgtcttaagtgaatcattttaccttcattaaaagcggtgagttttctgtgaaagaaaaatgcatcatccatttgcagactttttacagggattttcaacaatatgcctctgggtgtacacctaagttgggaccccgaactttgcttaaaatactcatgactaacatacattgagtgcttaatgtatgcccttcctgttctaagtactttcaagtattatcacacctcattgacggatttttctttcattatgtagggaatgtgaaaagactgcatttcttttttccaagattctgttttccagtaatttaggtagctttttcctttagattttatgacattaatgtagcaactcagtaactcagcatctcggctggacctggcccacagtcagccagtgcgtctcatgcctgtgctctctgtgttgatgaggacaatgctctcatcaggtgtggtgtgtgtggtttttctctaggatcatccatgaagatggcttctccggagaagacgtgaaacagtacaagcctgttgtctacagcaacactatccagtccctggcagccatcgtccgggccatggacactttgggcatcgaatatggtgataaggagagaaaggtaggcccctgagcccataagcacagcaacaagaggttctgtctgtgttaccccactgcctcctctttatagtgctgggctgccttaaatgaacgagaagagactccgctatgtttgaaagatatatggtggcacagtcaccaacctaagccattgcatccacccctctggcaaactcccagcaaactcaccaactttgcaagttgcaggggctacaaaactcccggatttattttgcagatgaggaagagttggtgacagttctaaattggagctgccacaacactgtctaagtacctgtccttgggcaattaacttgtacagaaaaaaatatgtattaaacaaaacaagccttgtctggccaccatctcccctccttagaagaactttccttgccttgttgtggagtgaggatagccatttgaattgactgcctttcctcttttacaccaagggctatgttttctgcctcccctgggtaagtatgaggacctacagggctctccttcctgtagaaagtcagtgtcctagaacagggactgtttgggggtaacatttccagtcttctattaagtggtgaatggaataagtactatataaaagcctctaatttgcaaacatttatattaactgttaagactgaactatatacagctacactggcaaggctaaataaaaggagggagggagagagggagaggagaaaatagcctcagaattctttccagaagcagctctttgtccctgtttgggactgaatctcagtgatcctccctctgggacctggagattggagaagggggcggagggcaggtacagcctccaagcacctgggctctgcatctgagcctctggatggagagcattcatctctgattgctgtgtgatttgattgtctattatacacatgtcctgtctttgctaaaaatcatcttcctcacagaggaaaactgtcctggttgtctctgtgtctgataaatcatccatgatagacagctttaaatgtaaaatttgatatgtaatgcacaaaatcctaattccatggggcagagtcatccagcccaggcattggctcctccaggtactggggaattgggtgactgagggtatgtccgaggccagcctgcggtggagaagctgggcactagcagggggacctgggcccatctgccgctcctcctggaggccaagttgggaagtggattctgcaaaggaagcacttcttcctggaaggccggctttgggtttggtcacggagccagggcctgtggaaagagggaatgggggagtggatgggtccattcactgcaggcttatgatgtgcaaggctttgagctaggtgctgtggatacaggaatgagcacagcagggaatggtgtctggttgcagaaaacacctattcagatcgttagaactaacccagatgagtacagtgcttcattcttcttaataacaatagtaggaataaaaacagctaccatctgttgagcacctactggctgccaggcacatactaagcactttacacataatgactcgttttatttaactcattttattacagcccagagcaaggagtgcctcatcttcaggcatggcacaagccacaggcctctggtctgtctgtctccctttgactaagtggggagcgtgatatctgaatctcagccagatagcagacacagtacaaaaggcacaccccctacacacacacacacacacacacacacacacacacacacacacacacacacacacacacacacacacggtgtgtgagatcttccaggagcaaatgtattcatctcccagccagctcttcctaaaaatctcctatactgattataacccagcaaagtcagtgtggctttggaatacttttctccttccattttggaaaacattcattgttcccatgggatttttttttccattttattatcctgaatggagagatgattgcttgggaatcgctaggactatgatacgttaaggactgtactgcaggcccctgggaaacagggtcccttctctggctatttctcctccatggaatttcccagtcaagtcagccttcaagtaggaaggaggggaaggctccaatggaaggagagactgagagctaagcgggactccctggagagtccactggacacagtcgagtccaagcacagttccgttatggcaggtggcaccatggccagcacctggcccatccctagggcaacacagccttgtctggtgtgagcttcctggtgggcaaaggcctccctggcactcaggcacccccttcctgtattcttacacctgtgaggagcaggaaaggagtgaacccgagacccaggccacagcaagccagacaactggaaaaggcgttcccgggagtgggctggtgtggattcgcagcctgtggagctgggcagaagagagtggaagccaccacttggcatgaggagacatgccaggccagaaagggctgcagtacctgctggtgtgggggcagctcagagccaacatccttccctttccatgttctcatggagcttcctatctagcagtacaggcagcaaacaagcccacaagtaggtgactgcataatgtcagataatgctaagggctgcaaggaaaacaaaataaggtgatgtgagagcctgatctgggggtaggaggagcagataattcagagtgggaggacgaggggacagaaagttccagacaagcacccaggccctgagggaggaatgagcctggcgcagaggaatataaagctctgttcagctggagctacctgcagccaggcagctcctgatgtccagatgccctgagcccagtgctgggtccccatatttttctgtctctagggtccccagccactctccacctaggggatctgccatttggatgctggggaaaccaccttatgctgcaggagtccagatccgtgttttggtctctgaagaagagacctccttccctctcatgtttttttcacctctgccacccaccaccactcatcaggggatgtctggaggaagacaaccccactcccagcacctgccggggccagccagccttgcactctccacacagaaaagcgcctaagagcttccttgctgtacctcagtgtcagcccctagaacaggtaggtgtccctgagttcccccggcagctgactcaccacctgtcctgtctgtttcccccagaggaaagaggactggctggtttttccttcagcctctctggtgtggagtcacttggggccccgtgactgtgcgtgagcctgaacctgaaagagcctccgtgcagagcaaacagcagggacctccttacatccgtctgtggtttccacaccccaggccccagcctcagactacagacctctcccaggggccccatgtactctcactcctctgggccttcgctggggtgtgctctctgcctctagtgccgtcctcttttcttcccctcttccacgtggaactgccccactcagtaagggcccactatgcttcatcttgtccatgaagcctccttcccttttccttccctgaggaagaaactcagctcagggctttctccatgaagctcttatctcacacactggcatgaagatgaattgtttatgcttctttccatagagcagtgggccctaaagtgtagtcagagtcctttgagcagctcatgaaagccgcgagccttccctccagaacaggggacacagcacacatctaggagattctgcatgcaatttcaagggggcctggcccaccaatggagtccagcctaagaaccccttcatcatttaaggtcttctgatcaaggcgtatgtcgtttatctttgggtcacctcctcactccagcagccaacacagtgctcagcacttagtaggacttcaagacccatcccattaatggaatgacatttctaactttcccagttttcagagaaaaaaaggcaaagtgcctgtaactttgtcactacatcaacagctgttgattgagtacctaccatgtgtcgggctggtactaagccacgtgtgaagattcaaaggcatgtgagttggagcctttaaggagctggtcatcttcttgggaagatggagctcacaggcagagtgagcacagcccttgcacatggtgggcaggaagagctgcttagtgggagtgaagatggaactgtccctgaagcacaggtacagtttgacaggtgcagtataggtgagcaaaggcccttgaagccaggaaaaaaacatggttggtaatgagggaaaggagagttaattggcagaggaggccagtgggcagaacagaggactggggtctgagcaagatgtgggaaaactagaaggtccagttgggtccagatttggtgggccctggaaggtaggccatggagtttgggttttatcctgttagcagtaggcagccgtggagagattttgagctgggatgggatgaaagtgaaattttaggaaattatgatgatggcatgtgcagagtggacagggcagggagggggatggcagggggagactaaagatgggaggcaggtgaagaagctgcagcaacagaccacgaataaggtgcaaggggctaggtgaggggtcagaaaggcagtagagtgatgcgtagcaacaaaggaaatacaggggcctggtgattaattggctgttggaaaaggatgggcacaaggtagaacctcagccagaaagccaggaggccgggtggggccggaccacagagggtgagtccccttccaaacctaaggggtttccaggtgggggaggtccgcacatatcagatggatggattcagagaactgaagctctgggaattactgactccaggataataacggctttctatttttatgtttcagagcctttattggaaaagggtgggcctaatttgtcctgttatttaaaaaatattccttaatgcttaaattatttaatcctaacagctacctgtgctgtgggtgctattgttgtcctcattttataggttaaaaaaaaatgaggcatggagaggctaagtgacttgcccagggtcatgcaatacaaattatatatgtatacagtgtagacatggaagcctaacaagactagaacctgtgtggcctgggtccagagcagagtcccatttagataggcacagtatgatgaggtaaaacaaatcattcaaagaatcccatccttcatcctaagtctctctaagaatatgaaaagggaccagagacagctccccctgctgttctcaaacatcctctcctgcctcccacatctgtcccaccccactcccttgagctgccttacccccctgggttctccatggaccctcttctccaccccagcgagcaaggctggtcctctctttcccactaaaggggttcctgctctgcctctccttcactcctccctttttcttcatctccctttcccctccccttctatctctccctttcccgccttccctttttcccttttcctctgtcctcctccctccttctcagtccccttttcctcctccccttccctctctccctcccttcctcctcactccagctcattattatgtaaattgtcttcaccttctgagccaagctctccccctcctccttcctctagccttagcccagggcctacatctgcatcacaaaagcagagggccttgttctggctgagctggcctaaactctgacactggaagaaagggttgaggagaaactgaacaattacaggattagaagattcactggaccagtgggggggatggggaaagctttgaacaagcctgtattaatatagttcatcatacacacacatgtgtctatataaacatatgtaaaatatacgtgtgtatgtatgtacatccttgcatatgtaaaatatattgtaaacaaatggactagtagcagtcatgcattgaacttgtatgaggctttattcagttgaaaatactccagttttcattttttcactatttgtgcctatgcctgtttctctcaactataaactccttaagggcagagtgtagatcctgttcctctagcacaatgcctaatacaggaagtattgaatactaagtttaaaccccaattctaccaccagctatatggccctgggtaaattatgtaacctctctaagcctcagcattttggactgtaaaatagtaatgatcctgatacctccctcattcatatctgccgtaagagtaaatgagataatgcctgtagcgtgcataggatagtgcctgtcacatagcaacttctcaacatgtgttggcaattattctcattatttgtctaaaatcattatttttgataaagtgttgatgaattctactcacagcaatctagtgaggaatgggcaaggttttatctgcacttttcaggttagaaacagaagcacaaggttcttaactggccacccaaggtcatattaccaagcctgggtctgctgaacctgtgccataaagccaaacaccaacactgaagtttacaacaagacaaaagactgcgtttatctgcaggaggctgagcaaggagagtcaggcagctcatgcttaacatctcacttcctcaatggccctacaagcaagggcttttaaaggcaagggtacattttaggaaagcagaagctacaggcaaaaccgtaaacctatacatggaggttatacattggtttggcccaaaaaagcaggatatcttgtggggcaggctttgaggtcatacgtagatccagagattctgtgatatgcagttgattaaggagcaagcctttgtctaaaaccttggggacagccaaaatgaatgttaaggtctggcctgtaggtatgagtctctccaggcccctcaggaagaaattgagaagaaagaccggcgatcagtgttctgtccttagttaccactcttctgaggtctacttgactgcaatgggcattttccatctggtgggggtccaggtttctgaaaaacaactcagggacatatgttaagatgttatctttagtttccatagggaaccaaacatcttgtggctctgacttacttgtgtggctattattttaagctattacaacctccttgcttctcaagttgctcatttacttctcaaggctacctaggtgcctggaatttcccttgaagagactcaagatttttctgtttccatgctttttcagggtgtggggggcagcacgaccctaacagggggctccctgctctatctcagtcacctacctaagcaggaggaaagatgggtgccagctgggcttgccgcccatgctcttgttccaccaggggccttcactggagctgtatcccctagagataatggtagctctttgggaggcagaatcagatttcacatttagttttcagaatgtcattggatctcctctggtaaaagaaatcttgacatttaagtcacacaatggagctcaggacactatgttttttaataatcatggaaatattgtggtgccacctctacagtgcagtgcggttcaccttgtggtttgcatgaattctgaaacagataaaaacaaggatgctatctggcctgtgtctccctgagtcccctggggcttagagatactttagtggtagttgttagatctgacgagggctggaggatgtaatagatgaaggcttcatactcccatagcccaaacacgaggccaggaagaggatgtagatgtgtcccatgctgggtgctgaggctctccacctacaacagccccagagcctgccctgaccctttgccagccaggtgaatagagcttgaaactgctccattcaagcccatctcattctgctgctccattttgcagatggaacataggtttcatctggtccaaactggaaagagacttacccaggggaatatgtggcagatccaggactagagcattcagcttcctgcatcacagctcagtcctctttccatctcagcaggctgcttccagttacccagccaatttggggactcattttctttcattcagttggtcaatcaatcattccacaaatacttatcactcaattacttattacttacaaatgcttacttcctggggaagtgcacaagatggcagaggtgggtacaaagatgcaaagatcaagaggctcccggtcttgggcagagatgccagccccagaatgagaaggtaaacgccttggtttccagggcttctcccagctctgaaattctagctctccagggctcagtgcagcatcagcacagctccctgatccaaggctggatcgggccgcaagctcctggtttgagggaaggcatccaccatctaagccctgccacaaggagcctgagacccggctactggtactttggcccaggatggcagcatcagtggctttccttgaccatcatctaaaaggaagaaccaacccaaaggaactgcagttttcagtatgggaaagaaagaaggactaaagtgtcagatttttgaaatgtctcttagctgctcctcctcattagagtcttgggtttccttagctaaaagtggtgccctcccccaagcccctcccagctgccccccagcagcacactctacttcatggttgtcttacccttggggccagacagcaggtctggaagaacaggtcagtcttgttcatcatgcccagtgctagcaggggtcagtgaatcctgtgcctgagtgattccattcatccaatgggtgtgtgcttctgggtcaagtgctggcttggtactagggatatgcatggcctgaacagatgtgtccagggaagaaaggatgaaagatgcagaatatgcttctttccatgccttcctgatccctccacagcgtttgccatgcgtgcttccattcatgtgttcccacagcggtggctcagcctggagcaggcactcagcctccagggctccagcacattggcccctgcagaggccccagccagcacctagccttcatctggcctggcctgccttctcttccgtggcgtgcagagttgagtggatgctcaaggctgggctgccatcagtctctacatgttcattgcctgtagaaaagggcatggaattttaaaaaggaaatttaaatgaaagacttcaacaaacagtaaacgaaaactgcaagcggtgatgccttgcgcttgtgtgctctctttctgtctttcacactccaaccccgccccccaccgccaccataagccctaatgactctgctctgatggtgggaaaatgttataaccacgtaaataaatattcctcggcatcaggactgaagtggcccccaccaatcttggatgtccaagagccaccccattgcagcccctcttctacccccaccaaacccccacctggcagctacacagggggaactgaccgcctcccctctggagaggggccattgtgtgagcatcctttgggcttgtggtacctgtttcaaggtggcaaaccagctgccaagcagacttcagccttagaagccataggccacagcagagaggggcctgcctggccagtgccctgtattttgggactcctggaatattgaaaattgaagaattcccaaaacaaggtcacaaaatcgtgttgtattttaaatgcatctacttaacaaatcagtactttgggcctaccacaaatgcaatggaatataattgtgctccctaaaaagacaattataggatttacaaaaatattaattgacagtgcagtgctggccctgtggtcctgtagtgggacacaagtcagagccctgtgctgagcactgtagctttcactgtgagagatctctctcccgactatgtctgggacctcatttggtccaagccccagaattgagccctttgtggatgtataatccctttctggccaccagatataccgtggagtagcctaggaaaccaggaaggtagattttagtttgctgaaggaagaggcgccagggactgagaaagggttaggtttgaggcagcagcaccacgtggggaaggctgtgtggggtggggacagccaaggtggtatctgcccctgccctgctgggagtgtagtgggggtcacagtcccacacatgtgagatggagatggcttccctaggaaaaccagagccactttccatcctcccgctacacacatctgcacacacgctcatcagcttctgctttactcagctccgttccctcttctttctttgccgggcaaccaacagtggtcttatgtcactgctgaagcccccactctgagtaagttaggacatgttggttgcaagtgatggaagatacaaccacactggcaaactggcttattcaaacaaaataaaacacaaaacagccacaggcccagagagtcagaaattcagacacacatgtggggagtgggggcttgatcagcagctcaggggacgtccctggcttcccccatctctccactctgccgcactgtgtggttttcaccctcgactccacagcatcactcctgcaccaaggaggaaaatggctccagcagctaagtcatcacttgtaaccttgtgtgcatcctaggacatcaccaagcacaaggtgcatctgagcaaccaccaagtcctgcaagtctctctctctctctcagtctctttctgtctctgtcgcctctgtgtgtgtgtgtgtgtgtgtgtgtgtgtgtgtgtatgtgtgtatctgtctgtctgtctgtctctctctctcattgcccctccttgacccaatcaccatgaccaagggggctgaggggttcctgggataagagtgaatcccccagaggaaaaccagaagctcctgaaaaaggaaatagaataggaggaaatgggtgctggggaggccaccagccgcccacagatctctccttgccattggggctaccagctgtgctgccccgtgcaggagatgactcatgtcgtagggtggagggccggccaggctgagtccactgcagcaggaccatgagatggctgagctcggcagcaagccagcactgctgctcccatggcagcctctcccctgaggtcccaggtggcaggacacatgggtgcacagcccccagcccaccactgaccaatggtctcgcctttccactgtggccgcagcagggggccagggaagagtgggaggtgaagaggggagataggctggtaacagaagaggcctccactagaagtcaggtcccttggagcctgccccagccagcaacagccttagagctagtcaacacctcgcttcaaagctggggaggcactgccccagagggcgggcagcaggagtcagagatgtgactttgaatcctggccctgccctctgccaggcagtggacttagcactagtcacctgactgactgaccctcaggttcctcatctgaaaactggagatcataataatacctactcacagggttgttgtggctaaaagaaatgatgcatgttaacagctaagcaaggtgcctggcaccaagtaagtgctcaggaaacagctactgccatctccctcctcttgcccatacctcactgcctgttagtgaagggccaggacaggagcctgggtgtgacaattgtttcagaaccagagcaaagggttggtgtcaaggcctcttagctattacaggtcaaagaggtggtgtcatcccctcccagaatcagctgtcccttctgatttcaggctggaagacagtatgcctcagcacctgccctcttgctggctttgcaggagtggagctgaggagagctgcttctgactcagggcccagcatggcctgagagagaaacccaaagagatagagacaaggagagagcaggagagatcacagagagggaggagagtggcagacactgtgtgactgagaaacactgagatggcgcgctgcatagaccgtgcaccagtgtccagtgtcgatggtgcactcagcatagcatctgcgcagagtaaatgctgctgaaatggctactgctccattccttttcattagggccgcctatgactctgtgaatgtcattccacagcccctccagccagacgtgtcttctttctccccctggatgccctcagcacctggctgtctcattcactcactggtttatttacttgagaaatatggacgtggccttctctgtgccagcagcatgctgagtgctttgtgcaccatggtgaactaatgcaagcaggtgtactgctgctcagagctcagctggcgagcaggtggacagcctcagtgattccagagagcagagtgtcctgacagtcggcctgtcctagcctgtgctgaggacggggtatctgacaaagagctgaagggattggcaccggtggggtctcaccagccaccaggataggagggtaaaaagactgctcccaagtgtccccatatggggcacgccaggaagtaagaccagagcacatacttgggctcctggctgtagaagttcccaagctatataaggagaggagaatcaggcctggcctctaaaaggaggctgcttcctcttggggaaaagtcagggaggtgggaaaatgcagccttcacagccctgtgtcttaagtcactcagctctgatagcaagagtggccagcgtgggggccggtcttccctttgcgttactttctggcctctggagagtcaggagctcaggtagcctggagtcccctggaactcagcagcaggggtggaggcgggtagggtctttgtcatgaaccggaagcataccaggccttcacttagaacactgacccctcacagaaagaccagcccctaggccctgcctcggctggcagggtgacctcaggcccatcccttaccctacagggtctccattttttcatccattagatctgaggaacgacaccgaagatcgcccctcccccaccctacctcctttttagttctataaattcccctggcagaacttaattgctaagtttaggtgattgccaagcacaaggttcttcctttgtatccaaaaaagggggggggagcggaaaaaagagaaaaaaacacagtttcaaagttagggcacctgtgttcaattgaagactgactttctcttaaggagggagttgatgttcccacagccgctgggctgttagcagcaaaagcagcctagcaggaggggcagccttggtgagcccccagtgcaggccacttgggccacttgccccacagtatccagcgcactggggggcagatcagcctgtcactgagaatgacacactcaagtttggagccgggacctcttttttgccatccatcaatgagagtggttcagggttgtcagtctaagacgggagtatagcccagggctggggactgtagaaatgggcatggtccccacccggtggggatggggacaccggtgtggactggcacacatgggccacggagccatcggggtgaagacactaaatcaggcagaaaaacactgtcaagtgttaacactgcagcatctgtgtcaagggtaaccatgtctcagggacgcaggagatgagcggccccatgcaaagctgtcagttttagtctgatcagtccagaaggctcccggtgtggggagaggaaggatggatttcagtagcagcttgctagatgaggatgagatggcagagcatacggcgcaggcttgaggagggggtacggaggccagggaggcctttgggcagctggctgacagcactgttacaaacattttgcacacattttattgattggcccactcctcaaacccagagcacataaacaagtgtcccatggtaccattggggtacctggaacccagagcagtggggaatgtccctgccccagtcccccaaacaattgcaccagcctctccagcttcccactgcctctcttgcctcccaccccgtaatctgtgctccacacaacagccaaagtgagcttttaaaaatgcatatctaatcccctgcttaaaagcgctcagtggcatctttgctctcaggataaagccagccttatctcctgtagctcctgccacaggctctgctgctgactctttaaatgccacgacctcctggcctcagggctttttagtgagttatctcctccataggggacttctccaccactgcttccctcccccaggcctgggttccaccatcacttcccctcccttggaagcctttcctgactctccgaataggctgggcctcttgtcctgactctcagacccctggtatgtgtgctcacctgagtatttgatcaatgtttgtgccccctgacccaacaaggctgtaagggacagggacagggcctatatgacttcagttggagtcagtctccagcacccagcacagtgcctggcccagaattggtgggtgctctattgaagtctgcagctagtccgtggtagagctgttcttgatcccagatgtttgaacacctggcccattgctttctgtatggccccttgtaaaatcagagcaggtagttaaaatcagatcctggagacccagaatgagtttggaacctgagttctagaacccacttgttcataggccctcttgcaggcctcaattttttcacctgctgaattgaaaccacacctgcccacgcactgtgcaggaagcaaggagtaggggtcacacacgtgaggcatgtgagagggggtgcctcctgaaagctggctctgtgcatccactcctggaacccggcccctctccaggcaaggcacagaggcaagcacctccaaaagaaaccctatacccgttagcattccctccctacccctctgcctgcagcccctggcaaccactaatctgctctctgtctctatggatttgtctattctggacattttatataaatggaatcatacactatgtactcttttgcatcttgcttctttcacttggcataatgttttcaaggtttttccgtgttgtagctgaatcacatttcattgtatggatataccaaatttcattcatctattcatcatttgatggacattgaggttgtttccaccttttggctactatgaataatgctgctgtgaacattcatgtacaagttttgtacagactcatgttttcatttctcttgggtacataactaggggcaaaactgatggttcataaggtagttccatgtttgactttctgaggaaccatcaaactgttttccaaagtggctacaccgtcttacattcccattttccgcatatggaggttccagtgtctccccgttctcactaatacatgttattgttcatcgtttttattatagccatcctcgtggctataactcattgtggttttcatttgcatttccccagtgattaatgatattgagcatcttttcatgtgcttttggccattggtgtattttcttcagagaaatgtctattcagaattagcccatctctaaatggggttatttgtcttacggttaagttgtaagagtcctttattctggatacgagtcctttattagatatgcgatttgcaaatattttctccccttctgtgcattatctttcgaattttgtgatggtgccctttgaagtctcacctcattctgcccttgcctctgcccccttgccagagttcctcactcccccagacctactcatctgtctctgttcctttatgctgctgcaacaaaataccttagaatgggtaatttagaaacaacagaaatgaattgcccacatttctggaggatgagaagtccaacatcaagataccagcagatttgctgtctggtaagggtttcttctctgctccatagatggtgccctatcactgcatcctcaggtggcagaagggacaaaaggctccctcaagcctgtttataagggcactgatctcattcgagatggcaacactcttatgatctaattgcttcccaaaggccccacctcttaatatcattgccttggggattaggttttgagcacgcgaattgtggacggacacagatattctgaccatagcaccattgcctgccctgccttcgggacttacactcttttggagctgaaggaactggctctttcttgctccacattgctccacattccccatcagcgttccccagcaggctctttcctagcagacaatctgaactgcacccaggctgcagtcatccctgagtttgggggcttctaaggctgtgtgctgagttgtgcctgaagcaggaggagcctacaattcactgagcatctccctgtgcccacgtgctggatgcctcgcaggcatggatatatcccactgcatccccagaacaatctcaaaagatactggtatttttctaccctgtggataaaatggagtcagaatttaaatttggatttttttttaagacaaggtctagctttatcacccaggttggagtataatggcatgatcttggctcactgcaacctctgcctcccaggctcaaaccatcctcccacctcagtctcctaagtagctgggactacaggcacatatcaccatacccagctaatttttgtattttttgtagagatagggttacattatgttgcccaggctggtctcaaactcgtgagctcaagtgatccacccacctcagcctcccaaagtgctgggattacaagcatgagccactatgcctggccaaatttagaatttaaaatggagctgttcgctgtcttcctacacagcatgttcatggcttatgagctgcacgttcagctctgctgtcctgtttgataattgcctactctgaaaagtatttaaaaatactggagaaagtattaatacctccctaggtataagccctagtatggtagcaacagaagtttcttgacactctggaaaatgcccaactccacctgctgtaaccagcagccccgaaatctcagggcctcaacatagtgaacgttagttccttgctcccaccacagtctaatgtggaagtgctgggggttgccctgtcccacgtaggcccgagccaactcccctgtggtcagtggttcagcctcagctgagggtcttctgctggactcctggtatcaggccagtggactggggaaggtcacaaggggagtttttggggccgggccagaacttggtccctggtcacacctaactgcagggaagtctatgaaatgcctagctgtgaccttggaagaagagatgaaatacttttgtcaatagggagccagtctctggcatagtgctcaggtgtgaattttagccaaactgctgccaactggaagcagcacctctgctggggtgacaggtccattttcttggctctgttggctgttttctgctcctcacttgggcccagctgagcagttcaacagctttgcttctctgtgacatgacagagcccacctgaaaattcatttcttggtggctatggtggtggcttctcaccctgtctcctgtcccagctctaaaaatggattgcccttctgatatgaacatgcatgacatctctggaacatgagtcccatgttctgtgtgcagacagtgtgccagcagcttctcctgtgtgatgtcagtgtttccctggcatggcacacatactttggtggaatatgagattaaatggtacgtggataaaccttttattcctacttttgtagttgcatatcggttttaatatgtacttgaaaaaagatcacataacatatcaaacccataatttcatatctatgactgaagatgaggctaatttcagagctgtcctgatatcaggttggggaaagcgatgaatgaatgactgggtttgggaacgttgcctggggtgaaaaggctcagatgcccagccgcctcaccggacttgctagtgtgtgacctctctgcacctttcctcctctgtagcatgttcccacatgaacatagggtataggaaggttggtgtgtcaagtgattaacagcagtacctggcacatatttcatgcttagtaggtgatagctcctaatgttcttaggaaacaccaagtcatatcacttaactgtgccaacagtgttgagacagggttattactatactttatagatgagctgagaaaggttaagtcgcttgcccaactggcagcagagccatgtgctgacccccagtgtgcctgactcctacctaggccaggctctgcgaggggagtttacttgcaatcctggctctggcactaacttagcaggacactgcaggcaggccccgtcgctctctgggcttcaagcttcccataggcgggatgggggaccagcataactctttgtgcaggataagtctcacagaatgtgggggctgctctctttgctccaaccacagcagaaggctttgctttaaaaaaaaaaaaaaaaaaaagtggactgggtgtgagctaggtgtctgcatgcaatgcccctcccagatcctctgcttgtctctggattctttctgctgcctctcttgtcacacttctttatgaccaagcttccaacctaccccaagtgtaaacatcatttgtttgtccgtcatctggtgatggacatttcacttgtttccattctgggactcttatgaataatgctgccagaacattgatgtacaagtttttgtggggacatatgttttcatttcttgtggtaactacccaggaatagaattgctgggtcacgttgggagggtatgttaactgcataagaaacttccaaactacttccccaagtggtagtactgttgaaaattccaccagcaacatataaggattcctgttgtcctgcacactcactgacatttggattgccagcccttttcattagctgctcaagtttgtgcacagtggtatttcactgtggttttaatctgcctttccatggtgactaataatatttggcaccttttaacatacttttgggccatgcgtatatcttctcttgtaaagtaactgttcaggtcttttattcttcccttttattgggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtgagaggttttcgtctgcagataaagaagtgatcatggtatcagaggttgaacttgtggactctggggtcagacagtcctgggtccaagtcccagctccgtggctcgcagatgggcaggtccttctcgtctgttctctgagccttgcttttctggtgtgtaatatgaggataataagtcacctacctccttgtgctgctgggaagattaaatgagatgatgatctcaggggcctagcacctatcaagggcacacaaaggctgggctgtacctgttaccactcctgttgctaaggcacgctagcaccccagggccagcccatgtgaaaccactctgcacaaagcaggcttcttctcccttccacctttaaatcgaaagcaccacctttctcccagttatccaagcagagaccctggactcctccttcccctccatgtctcgcttcctgttccagaatggctcttgaatcagcccttcctctcgctgcccaggccactgccccagtgaggcagccttccctcttcccagtgttcgtacggtgctcctcaccaaggtggtctccctgcctcttcctcccaatattccaccctgtttgccgctgacactgttgtcaaaggcttcctttctgaatcagaaacctggggctcctgggtagttgtttgggggagaccaccttgcacaggcaaggctcggctgtcactggcgtcttccttggttataaataacaggctctattcttagccaaacagcagttaattctcttcccgtaccttccagagcctctattagggaccttggccgtccttactggagacaggccattccttggcctttggcaggacccattcctttgatacgtgatcagaaaattcaattataaagccaattactgatttcctgagctttacaagggagactggaaagtttgattaagtttgaatttgtgtttggctgattgccagccaaaaccgaatgggcttgtgggagagttctgttgttgctgattctgttcctgttttgtggcagctctcttggggtgggggcaggcacactggtgttgtgttgtgggttttttttagacccccttacttgctgaatggctattcctctgttgtgatgcatgagatgtaaatcccccaaagactggttgccagagcgacgggctggaattgagctcagctaaacaaagtccttcagctttgaagggagaagcgcttgtttcccatgtggagttgagttatagtggccctcaacaaggctgcattcaaggatgcctgcatgaacaggcatgcagagggggtcgctgagcctgctggaggatcttaagcggcgtgtctgggctctaactgcctctaggacctacccagggggacacacagatgctgagcctgaggatcaaggctattcagggtgcctctgcccagctggtcaccctcaccctagaacctgcaggactggccttcaaacagtgacagcctgctgggctccagctagagcccagcacaggtggggattgaaaagcaaccctttgtctctagccaaagtacttgcttttttagatacttctgggaaaccaaacagagcccgtgatgggaccaggttggagttccaggtcagaatctgagttgtttctggagacccaagttccttccctagcaataaaatgagggaatcccagttctctggaagctgtagccatcccacaactcttcctacaaggtatacattattcaggagagatggtggggccccacttcaaagcgtctccctcatgcctaaaatctcccagttagagccctttgggtgttaaaggtttttaggtctctaagaatcctggttaaagtactaatactcctggaaggagaagcgtctaccagtagggattagccatcagctaactgagaaaaccgccctttgggagtaggacacgggattccctgtacccagggtggggtcagataaactccacctgcctcccagcttgcttgaggcaagatccaaatgtgacctcttgcaccagaaacattaatatctctaacattcgtatctggtgtgatgtaccagagctcacagaacactcacgccctgccctgtaccctcatccatacagcaagctcatgagccggcaccaccttgacccccggttgcagacaaggaagccaaggctcagggaggccaaccaccttgcccagcatcacacagctgggagtacagattttggactcagacctgggatttctaaatccaaacccaaacctgttttctgtgcgcacagccacccacccggtggatgacatggacactgcgcacctgttttgtctaactggtgtgtgtgtgtgtgtgtgtgtgtgtgtgtgtgtgtgtgtgtgtgtgtgtgtatgcatgtgtttaaaaggtgggaattttttgttaagtttgaatttcagttcttttcttttcttttttaaatgaaagtgttatagcatcctggtggagttgtaattaggaaattctgggttagtcagctaggcagaattgaaaaataacccggcagtgctggttggagtactttttcccctccttagaaattcaggttttgtcaaactagggaggagggagttgtgaagatggaaaaatgtgtgcagctgggctgggtcagggagtgtgtattctcttctttatgtagaactagacgattaaaaaaatagttatcgagtgggagtgctggctcacgcccataatcccagcactctgggaggcaaaggtgggcggatcacttgagcccaggagtttgagaccagcctgggaaacacagcaagaccctgtctctacaaaataaaaataaaaaattagccagccatggtggtgcgtgcctgtggtcccagctactggggaggccgaggtgggaggatcacttgagcccaggaggtcgaggctacggtaagccatgttcacgccactgcactccagcctgggcaacagggcgagaccctgtctcaaaaaataaaataaaatagttatctttgtgtaggatgatcttccgtatgtgcagacatgaggcagcctgtgaaagatggtaaggaaacaggtgaagaggaaccctggctgggtcccaggctttggcaggaagaggatgcgagccccagatgtgggttaagggctctcaaaccaggcgcatgcagagagactccattgtcacctcccttccagcttgcccttattgatcagcgacagtgatgatgacaagggcagtaacaacttcccccacacgtggggcatatatgccaggctctgagacactccgtcatttctgtgttaccctgacagtcttcattttaatagtgatatgcttattttaataagaatccaaaacatagcccatctagctcatgactgcccagatattagaatggggccaaagtatgggtttaactttttttaaaaaatgagttaattaggctgggcacgatggctcacacctgtaatcccagcactttaggaggccgaagcgggcagatcacgagatcaggagatcaagaccatcctggctaacacggtgaaaccccatgtctactaaaaaatacaaaaaaaattaactgggcatggtggcgggcacctgtagtcccagctacttaggaggctgaggcaggagaatggtgtgaacccggtaggcggagcttgcagtgagctgagatcatgccactgcactccagcctgggcgagagagtgagactctgtctcaaaaaaaaaaaaaaaagggttaattaaataaaacatatgaatataaggacggggtgtcatgtggattgggcagaaattgtgaaaacaagacagaaagatctggagtttgggaaggcttgcctcatccatatgagcaggtaaaatgattaacctcattttacagatcaggaaaccgaggctcagaaaggttgagtaacttgcctacagtcacacagctgacagatggcagagccagcaacaagacccaggcttgcctaactccaaaggcaaggcttggggctgccatccaggtgaacattcctaccttcactctccagatgaagccctcagcgctgggttagctagccttcctggggctgtccaaccctggagagagaaggcctttctcactgctttctgaagcatgaacagaggcggatcccactctagggaggtagggccctggggcctgcttcctccgatctgctgcgtctaactctctcaaataaaagccttttcagaaagggcctggcatgaggctgcatgtgactggcagggctgtgactgccaaggcttcactgtgcttcctcacccttgccccagccccacccagcccgaggcagcccccaccttcctttcttccctgatctctcttagctcttcctttctttcttttttgtctctgaatcattttttccaataagctgttgattgtctgttgaataattctctgaatgatttctaaaagcctcctgatcactgaaacctcagagttggaaacacatttatatttatgtggaactgagcttttagaacattattaaatttgcatggggaactagcagagtagccacttccacacaatccagatgatgaggaagcatcatcttcaggaggatggaaatagttccacaagccactctgcctggcttattactctgctgggagaaatcagcacagtctacctgggggtccagaggcagcattgacccagacaatctgagcaaatgctgtggcttagaaaccactcagatgcctgtgttttataattggccagcttcctaacctgggattctggagctgccacctcagaaatggaaggcagattggggttcgtgtgtgtgtgtgtgtgtgtgtgtgtgtgagtgtgtctgtgtccacgtgtagctggatgtgtagttcctgtgggtggtttagtgtgtgcatgactacatgccctctctctctaaggagagaggctgtagcttttgtcccatgtcaaaagggccacttgcactaatgacctactatgtaccagctgtgtaagctgctagctgaggcctctgagcaggataattctcatagaatttagagttgagaaaagagaaacaaacaggaaaggctgtagatagtggtcaggcggtacagagaatttaaataaatgagtggcttctctcagtcaaagtggtaccagctggcccctggctgcagctcaccacggccaactgtgtgacatagtaacagttaacctccactgactggtcaccgtgctccaggcactgtcttaagtggcttgtattcattcctttaatcctcataacaccctgagaagttgggactatttaaacagattagaatgctaaggttttgtgaggtcacacagagagcgagtgacagagtccagactgaatctggggttactcacctccaaatgcttccctgggtaaaatactggcctctccagactttatttttctcatctttaaaatgggttgattcttatttggcctatccctgaccaaaaaaaataatattttttaaaatataaacttttacacaaatcgatctgaaaatcagcatcctgctcccacttggctctggtgcccttgatggagctgaagtctgtctgggtggttcctgagttttctcagattccttcagggctgccagttgaaccaccaatgtgtggagttttacttaagcctcattttataaatcagaccatttgacttgtctcccactaacttgtcaaagttccagcgagcaagttttagttccagaagccagatgcttgccactgccagctccctgaggtgggcgttctcaccagccccattccctgctgagcagccacgggcccatctcccagcccagggcaaggccacatttcctcagacctctgagagctctgaagtcagcctgtgtggctggggtggatacaggccagctgaagtggacagaggataccggtgaacaataaaaataacagatagctatggcagtcaggtaaacagagtttgggcttacgctaacaatacgattgatggggtgggtttgacctttttttgtttcaagccataccaagaataccagtggaccgtgtcacatacctcagtcaaaacaaaagtgacttggatttgcttttgagggtcaaagaaaggccttacagaagggatgtgggggagccggaagcacagacttcgggggtcagaaagatctagactcaaaccccagctcttgcttccagctctgagccctgggccccctttttcctctgacttgctgtcagtgatttcttcagggcatgaagaggctgcaagaagggctttctctgtttgccctctaagcgcttaccacagaagcttggcatttttccattatttttatgtatgtgcatgtgtgtggagggagattgggtttttttaatttttcagttgcattttttttgttttgttttggtgagttcttctttaccaaaaccctgacgtgtgcttgttttattgtgcttctcttcccagtggaacacagctaaaccattctgcccggcggagtggctcagtcagagtgccagatgtgggtgattcataagcgtagtggccatcatgttgaattgttactattgtcactgagtgtgctgagcacctgactgcactaacttgtttagaactcagccgtctgtgaggtgcacactgtcaccacccccaatttacagacgaagatactgagaccctaataggcctgctcccaaatgactgctcacagcgttactcccttgatgtggaggtgtgggcagaaagtcctggggctctgaacgcccccgcccaggggtcctgcctgtgggtcatccagcagcagcacctctgtccagtcccacactgatgtgaacagtcttctctgatctacagctcacaatctacttcagccccactgtcaccctctccccacttgtgtgccgtgttcagtcctcagggaccccagaaccagcccaagcagactaaggttccctgggttctagaatcttgatagctcaaaccactggcctctccctgaagggtttcgacacacccccccaccacccacctcctctctagcctctgcttcccagccagccctacctccttcccaggatccaccagctaagccaccagtgaccctggaacagtgaactagccccgcctctctgtgcctcagtttcccaacttgtatgatgagggagcatagacagaagcagttctatgggcccctccagctcagacattctccaaacccccatcatctctcatttgacaactgcagtggcctccttggagtgctccctggagccactcttccaggcctcccagccccatctggctatacacagcagccagcatgagcttttgaaacaatattatttcattcccacctttaaaaccctccgtgacttcctaccacacatagaataaaagccaaactccttcccatggccaacagtaccctacatgactgggggtcacgcccgggctccctcttctcagaaggtgctttgaacacagccagcccgccagcccctggctgctaggagctgctgccgtgttgccaataccatcactgtgtgtattgatttctcacccaactggtgtccttaacttcatatttatggcttgccctgacatttcccttctcttacatgttccaaattattaaaaacagctgctttataattaattgagcaaatcacagaaaaacactttttttctgtctataaataattccaccttaacttttctgggaggataaaatgctgtgacaaggaaccagcacacacctggtatctactatctcctccccagcctggacttgaattcatctgaaccatctctggttctctccccggcctgaaacgggacctccacgcgcagccgaagtggggtcggtggagaagggtcgcaggattcctgagcagcttttgactgctcgttctgcctgcctgtggactgcttcccatgatttcaccactgccttttgtatgctgagctctgtgccctgtcccatgctggggtggggtgtgccaggggaagacatcactcctgccccagaggaatcacagtcttgttttccagatggacacttggagacccaagcaaccaagtggtgtgatgctgagctcagggtggggtcagaggagagccccatgtggaggctggcgggcagccttcccatagcaagacccccaccagcgaggcttgccacacaaaacgggtgaccagctgccccaagagtcagctctctgtgttccctgcaaggggctctgctgaggccagcattttctgtgtggacagaccctgacatgggagaggctgggaagcaccagagcatgagctggcatcttgggtgggcagtgacttcaccctctggagcagtagagcccctcgtgactgtcagacagtttatggacttacacccttgacaaagcatcacaaagcatgatggctgacagcgacctcagagatgatcacatctaaagggtgacacggatttgtcttgtgtgcttgctatcattgacccccagctcttgtccccggcagtcactgtatttcattcatggcactgaatctgccctcagagttctctcaggatagccattgccccaggcagccactaccggttggttgcagtcagccctcaagttgaagccagtttcccacctctgatctacccaatgcgacaccctcattttatagacgctggcaagggaaagggcactgaagagccacagcagaacacctatcttgcaccccgagctttctaaccccctacttcattgctttttagatctttccctaccaagccctaccaagttcattcacttggcaaatgtttactgagcacctactgtttgcccagtttgttggtacatcctggatacaagagggcgcctggtataggagcccagcatccagtggagagacttgtaaacacagaacacagaggctggtgggagccacactcactgccaccctcaccggggagagcagagaccctgctgccccagacttcagggagccccctgcgtctgcttttcttgatcctcagggctttgcccatggtactgagggcctgtgttctctttaatccttcctgccatcccaggcaggcagattgcaggtccctcttcaagctggtgctcttgaaatattgttcatcatttattcagcaggtccaggaagatgccattaatgaaacttgtttctttattgttcaaaatacgggatatattagatgtgctggacttaacataacactttaacattgttgggagctggctttcatgtccattgttcctaacaagagaagactggtgcctcacagcccctgaaaggacaagagcccataattacacaattaggctcaaacatcagtttacaactttttttttaatgtgggcaaacttcacttttctgtctagttcatgttttttcttgttttcattcacaacattccaaaccaggtaacttcttaggaggaatattagtgggtttgaaatttacataataaacaaatgcctccaccccagaagacagccctgtatcatccatgactcagtttcagagtttcaccgaccaaccacttcggctggctgagagctggtggcctggcccatgcctacacgtgcagtctgcacaggtggggttgtgttgatactcagctgaataggtgggtgacaaggaaggacactgtccacctccactggagtgcatcagcactcgtttctccagttgctctggaagcatccaggacaggtagggttagccggccccttattctgctccccctgtgacattgcagctaccctcatggctggtatgccccacagcctggctctcttggatctcctgttgaggtaagcagagaccttgagaacaggctctgggccatttctcctctgcttcctgaccccactttcagctcaccccgccagaccttgcaaggatgaggagatggtacctagtgcccatctcaacgtatagcctggagtccatttattccatgagcagcatcttgtaactgaacacaatagttaatgaagcagatgtaggccctgccctcacagagcttacaattcccctaggaagagaaacagtcatcaaggaaacaaacctgtctaattacaccttgcaataagtgctgttaaagaaaagaaaatcatgttaggatgagaaaaacttttgctttagattgggagatgggggtgatcagggaaagccttatcttgggggttaaagtgagactggaaaaataagaaggagacaatctggcaaagactcgagtccaggaggagccagtgcagaggcccctagtggaaatgaggctggtgtgtgtgcaaagcctagaaagggatgggcggagggcagtgggtgaggctcaggggaggaacgaccttgaccccacatggccttgtagatagagtttggaatgatggagagagaaccccaactcccagccccagggagagctccacctcaggggctgtatttgtttcccagggccgtcataacaaagcataatcacagttctgaaggctgggagtctgagatcagggtgctggcagggttggtttcttctgaggcctctgctccttggcttgtagatggctgttttctccccatcttcacatggccttccctccgtgtgagtctgtgtcttaatctctataaggacgccagtcctattggattagaacccatctaatcattttaacagaattgcctttttaaagaccctgtctctaaatacagtcacattctgaggtcctgggggttagaacttcaacctgtgagttttgggggaacacagttcagctcctaacagggagcttccctgccgtcctctgagatgaagctcgtggatcagcatattttgaatgctgcagcaggctgaggagcccagttccactgcttgctccctgctccctctttgttgaaaggaatgattcacaggtgttgatgggtgtcaaagataaaagggcaccaagcagcctttcttaccgaaggtcagtcagaagccttcctagcgtgagttagtggtgttaatgcagggtcccagaacaacctggaatcttcagcggcccacactctgggaaatccccttcatcgttgtggcggaatctgcagagtttaggcagggaagtgagttgactggccagggcgcaggagagctggccaagctgcccccgctccttcagggtttcctcccaacccctagcagaaccctttgctggagagaggcccagaaagggtagtgctgaattcagtgaggtggacttatgaccagctgtccccaagacccctgagatcagtgtttcttcagcctccagggctaacctgctgagggctgaggtgcctgcagacacacagaccagcctccagtcactgcctccaccttatgttaaagataaaaataactacaaggcgggaaatgtcctagagaaactaccttgaaattcagaaaacatgaagccaggcttcatctaattaagatgacattttaaaaggggggacggggggaggcttgggtggcattttaaattgcaagctgattgtgcagcctaattttggttctgagcaaagattccagttggaccagaaaacaggacttcaaaggcactgcctactgctggccaggcaaagggagtgaaaagggcagcgtggggcctcgggcacaatgtggccgggaactctgggcaaaggctgggggccgcggggggctgcagcccttgggagcctgctgtgcctctgaggagatcagtggagccgctcctgggaggagagctaattgaggtagcgacttctccttggagagtgagctttggtccaccccagcccatcttgggggcagtcactggacagaactctggcctggtggtcccaggcatgcccccacccaagtctcccccaggagctacagaaacaggcctggttcttatgcagagcgcccagtgccctccccaggagggggctgctcccttccggggacttctcctgccagcctctaagattcaccaggcgaagaaggccagctccctccttcccagaatcccgggaggggcagccccagtccctttcagattggagggcagcggctgggcctccgcgttggtagggagatatggcagccagctagcctgggaggtggagcatctgcccccagaggctcctgcatgtctctcctttttgtgcaccatagcttatctcacaaagccagcttcactcagcagattttgtagttattgttattattactcattctactgacatagatctgggcacatgcacacaccccacgatttaagtgctccacagtcagaaagcccattccccagactctgggttctctcacaggagccctgggaggagagcatggcatgaagaacaccatttacggttgaggaaactgagtcacaaggtgtcacatgactaacccagatcctctgaggccacaccctgacacttcccacaagtgttgtgaccttggtggagtcactgcttcccacttgacatttcctggtggagacaccatggtgtctgtcttccattccctctggccactgtctcactctctctcagcagaggtctttccccagctcctccataggaaggatggtgagatgagcatgagctaacagatgggaagagtcgaaggagctggtgggcaagggaccttggttcttccatggctgccagtggggagcacggagggttccactgtggcgccattgaaagactcagcggtggatgagagggagattaggaggccagtctggagtcgctgccctcatccatgcagggaggcaggggtgtccttggaaggtaagaagaagggacagattcacaccttcctgagggtaaatgaccttgggaatcagccagctgcaggaaaggaggaagagtggagccaactttggggtccccagcctgtgtcatgggaagcacagaaatgccattggaaagaggctgtgtgtccccaaagagtggtgtgcgctttcctggggcacacaaatgacctggcagtttttacagaccaacagctttggttttagtagttttattattttagtgtatattagaaaaattagcacacaaacctctggttctgtggatattgtggcctagggtaagctggcttttttaaatgagtccaatttaataacattttcaaaaatattgagtcagcagtgacggtgacttgctgatagggcagaaagctggagaatgaggcaggaaggaatgcgatgctggagccttggatgggaaaccaggaggggagtctaactggggacacattgagttgagtctgaaaggccagtgacccagaggttaggtaggggtaatccagttgttccctgcacagaggaaaatcaggcaggatctggctcagggagaaggtggctcgggaaagcaagaaggggtttgaggactgagtccttgggaacattggcacctaaatgttgggtggaggaacaggaccacagttggagacagaggagggatcacagtggactgaggtgaaccggcacccacggggctgggcgcccagagaagaggagaagtgggcgtgatggagagggcactgcgagccctcatggagtggagagggaggcagcaagacagaaggaggaggaaggggaggacagtggcttcacggggaggccagctcagaggacgggttaggatggaggggccagagacccccacccccaccttttcatcaggtcaagtctaacttggggtgaagggtacagactttccttttggggtttccctgaagttcatgtagctggatggggctttagaggcttgggaggaagcagccctggacttggtttctatggctccccgcaggccctctcccagtcacaggagacagcccccttcccacctgcttcactcaagctcaagtgctctcctagctgctgtggggacagacaggcagggtgggctccctcttgctccttcccagctcccttctacgaggacagtggccactaggagaccagaagttaccatgacaacaaagctccttcacagaacagagcccctgggctccctgcaactgtgtccgggatatttgaggtgatcttctctcaaaaaggatgaggccccaagttggcttttagagatggggagagatgataggaggaggtagggacagattcatgttgccagctctcccacccagccaaggaacgtgtgggtgccccttcccttcccataggatgccacacactccttggggagcccaccagtgggctcattccaccttgaaaccaagaccaaggaaccaagggtggggacaaggacagagaagggagcaggaggtctgcgggcttggaagcctggactcagtggcatgaccagatcactgccgcctgcctgcaagcactgtacattcccagccaatcagggttgttctcaggcctcacaggaccagaagccaaggcccttctgctaggagaagagggaggtgaagtgacctgtttccagtcccaccacccaggggccagacccggacccactgctcctgtgcgtgccgctctgctccctcatagctgaggaatgtgcagcagtgcctgctgtgctgggtgctggggcagtcctccccagagtggagaaaggacatcagttttagctggcatgatggattaacatgttgatttttatctcaatatttatgaattcattttcatggatattagaaaaagataaaagctagcatattaaatacatcctttcccagacattgttggtactaaatttccttttgcttgaaataaatttaagtagaaaaagtctgaaggaaaatattaggtcagatgcagtggcttatacctataatccaagtgctttgggaggccaaggcaggaggatcacttgaggccaagaagaccagcgtgggcaacatagtgagaccccatttctaaaaaacaaaaaaaagaaagaaaaaaaaaagaaaaaatcagcaggacattgtggtgtgctcccgtagtcctaggtactcgcaggaggctgaggcaggaggattgcttgagcctggggggttcgaggttgcagtgagctatgattttgccactgcactgcagcttgagtaacagagcaagaccccatctaagaaaaatattaagtaaattaaagtacaagttttatacaaacagcagaaatttaatgatcatttattgagcacctattatgtgctatagtgttctgtggatacagtggtgaacaaaaattatgcgagtaactgaggcttgggagatgctgctgtggagcatgacttttacccttcttagggggagtattggcacagcacagatctctaagactccagaaaactcacctgtgctctttcaccagcttacagtcttattgagagggcactctattgctcactgaagcattagaagagggaccgtactcagtaatccacaatgcaggataaacagaggtcagatgtcaaatagggaacaaaagccaggagaagaaggacaatggcagaatgtgttagtaagggtgccctagctgctataacaaatacacccaaaatgtttcgtggttcagatgcaataggttatttcttgctcatctactagtctggggcaggtgttcttggtgggtgggtggctctcctccacacagtgactcatggaccaacaccttccatcttatggcaccaccaccccctaggattttgtcatcatgtgcatacaggagacacactcacatcttaagagccttgacccagaagtggtatgcttcattttcacatttcattgatttcaacttagttacatggcaggttgtggcctacagaaaagttcccgactagcagaccatgagagggctgaaatccagtgcaccttcccttttctaagccttacaacctgcagaaaggaactccttttttctaattgtaccggctggcttctatctaccctggccagggtgtggggcttgggggtggagatgggggagagaggcatggaagggggtaagaggagtgacagggatgaaggaaagcaagaaatgccttggaggggagtggaacctgagcccaggtggcatttggtggccctgtagtttcagagagtgagtgccaacctgagctggttccccctgcccccactgggttaggagctgcagtgccaacctctcacccagtgagccctgtgcagctcttccccagcagagggcagagttgatacccttccccacccgggcctgaccccatacccagagtcacccagtgtctgtcagggaagatgaggatggcaggggctaagtagaggccatgcaccctgatcccagacctcagagaaaaactgttggggtgatggcgccttggctggagcaggccacccacctggccctgcgctgaactgagaacccgaggagcgcgtcccctccctcctccctccctgctgacatagcttggcagatgagtccccggaggcttggctcagcccctgaccccctgtaccccaggggccaggctctgggagtcagaggagctggcatccagccctggctccactgggctgtccacctcctgccccgcccagcacggcccgctgggacctccttgcctggcccagctgctgcatggccatgggtgccactctgcctcacctgtgttttagttgacaggagtatttgtcacccttgtttttacacctgtcaccatcccacctgccgcatgtaaacactaccagcatcaacacggtaatgccggttcccctgggtgggcaccagccaagccctctgggagctgagaagagcaggtgatagcagctggagaggtcccaggggccagccttccctgaccctgccctcggggagacagggctgccgggctctgggccagctctgcccctggcttgctgatggccccacctcctactcacgggcctccatttcctctcggaagaccaggccactaaatcacagggaagcagggctgcacggggctggcgatgtgggctccggagtcaggcggctggcgttcaatcccagctctaccacctactggctgagggaccgtcagcaagtctcataacccatctgatcttcggtttgtctgagtataaaatgggggaaacgataatacttgtgaacatcaaatggagtaagcctcctggtaagtgctcgacagatactggctgctgtcatgatctcttggggcctctctttgacaccaggcccctgagtgcatgtgtgggtgtttgtctgtctatctgagtcccaaggctcacagcaaacactgaggcggccacagcctgggcttgctgtatccttctggactggttggctcagccagctctgacccctgaacccagaggtccctcctcgaccccaactctgacaaccttcctgccaccactgactttttgcaaagactcataattctggatttcctacctgaggtggtggctgtggccgaaaggcccattctcacccatgagaaggtctcctgagaatgagccgcacctctgcaggtggaggccttgccatccagccctgggatgtgctgcatgggacggtctgcccagggccttccaagtggggcacgtgccaccgctctgtgagatgagatggctcagtgggacaaggctcacacatttaatagcatgggctcaccgagtcagaaagtggttccttctctctcagcttgtctgagagcctcaaaaagaaagtctcaggctggtgcttggaccttcataacacctctgaacctatctcctaggtcaacaaagagagcaaggcctcaagcccagagccttctacaggcaggggatccagagaatttagcatcctattctgctctcattgtagttattcttatgggtgttttctatttaaaatactttatacaagttcttcacttatcatagggatatgatgtttataaggtaaaaagatgtgtctaggaaaaatagtaagtattactcattcggtgatgcaggactttggcagaacttatgaagatattagggtatgatgcttgggaaagaatgctcttgtccagcagctcttaaacattttggtttatactcctaaaaattatcaaggaccccagtaagcattttgtttatgtaggttatatctatcaatttttattgtattagaaattaaaattaaggaaaatttaaaatatatatttatttgaaaataactataagtccattacacattaatataaataaaatttttatggaaaagtactgtatttttcaaaaatattttagtaaggagaatgtcattgttttacatttttgcaaatgtctttcatgtccagcctgatagaaaatggctcggttctcacacgtctctgccttctctctgttgtgatgtgttgtttggttgaagaaaaatttggccccacacgaacagggaaggagtattttactagccttttcagataattattctttgaaactcccaggacttggcaaatggtagtttattaaaggagagttgcaatgtggaatctgaaagtatatcaatgacccttctttttttactttttttgagacggtatctgtctcgcccaggctggagtgcagtggcacgatgacaactcactccagcctcaacctctgggctcaagcaatcctcccacctcagcctccccagtagctgggactacaagtacacaccactcccagggggccaccatgcctggctaattttttttaatttttatagagacggggtctcactgtgttgcctgtgctggtcaatgaccctttcctgttctgttacattaaaattcactggcctaccttgcactttgaatggatctcttactatgaatgatttttaacaccattttggtcatttggaaaatattggttcatgagttacacagatctgaatgttgacacatttcagcatattatatcaaaaactcacatttgttaatatcaacactgatctttgagaaaagctttaggtattgggaagttaccaagtttacagtggtaaacacaagtcttccacaattctgcattttcacttgaaagccagaattttataattttggtaacaaatatgtcagtggttttctttgaaatcgtggctcactggttcatttttgggagaacttctgccagagaccccagtctgaaatcctactgcttgccgctcaggcttttcaaggaaaagcagtgtcccatgaaggaagggatgagtccggcttgcaactcagcctttccccagtacagccgccacccttacatttgcagcacgtgttttgtgcttacttcccatgtcatcatctcacagaattctcagacgggtactcgagtggagttttttataagtcgtaatttttacttcttcaccaacgacattcttcagtccagccagcatttgctttcttggcatgcatggtggtagggagtgcaatggcagctctgcagcccggcgccgagtccagcgccggcgcctggcttctggctaaggagaccacgattgtatctgctgctgctacttttgcaccatccgtgcaaatgttaacactgttaggaaggcaagtgacatcttagttttgttatgaaaatagttttgatttcatggacccccttgaaaggatctcagagacccctcggggtccactgaccaccctttgagaaccgctgatctagccaatcccttccttatgcactagggacactaagaccccacaaggagaagagacttgcccagggtcccaaagccagtcagaggcagagtgacctgaagcccaaagctctgagatcctggaagcaacgtgatctgcaccttttctaacaaaacagtatgtgcccactctgatgaatggcacaggagccagtgtccccggggaaaggatgaggaggcaagagggatgaaccagcctggggataggcaccagttggccaaccctgtcaacttcaggacttgcctattcccaccctgcaccttatgtgtagcgctgcatcttccatcttttctcttccatagctgtgttgctaatgtctcccagccgaggcggctgtaattaaactattcaccatcgtcacttcgtgttctgaagagatgaggtcggccattatcatttttccttccctttgactgagctctgtgtgggtaatttcattctgccttgttcatttcttagaaattttgtctatccaattttagttcttttttcctcttagaacactgggctcaggggaaaggaggtggaggatgagggcatcatggatttggaaatttctgtcccattcaccttaaagcttttttgggacaggatagtgcctgcttggtggtgcagctatccagagagcccccatccaggagagatacccaggaggtgtagaacaggggtctggacccactgaggggagaagggcaccaagacaaagaggcaccacgtaaggctgtcccagaggggcagtggttggagctttggacagacagcgtccccacccctttcctggtggtcagaagccttgctgacataaaaacccccctgcctctgggggcccaggacaggcttctgttgctaatgaaagtgagcaggggccaggcacagtggatcacacctgtaatcccagcactttgagaggccaaggcgggcagatcacgaggtcaggagttcgagaccagcctggccaagagaccagcctggccaacatggagaaaccccatctctactaaaaatacaaaaattagccgggcatggtggcgggcacctgtaatcccagctactcgggaggctgaggcaggagaattgcttgaacccgggaggcggaggttgcagtaggccaaagatcttgccactgcactccagcctgggcaacaaagtgagactctgactcaaaaaaaaaaagagtgagcagggcctccatcctgcgtttcctctccccggcgtgccctgccaggcctccactagctcccctagggcccccatgcccactctacacagatgctggcagggctgacagctcccctgctcctgcaggaagaggccaggagcccacgccacacagaaaacgtgaatgtcccaggccccaacacatggaaggcctggcatttcctctgccaggctctatggggaagcattttctctccatcagggctgccccaggatggacactggcctgcccaccaggggtagggcaccccctcataggcatgaccagcaacctggccgagaggctgtctgtgcttgagcccctgagccatctgtgtgcccacaggtggctgtcctaagtttaaccttctagggctgcatgaccccactgctgtcctcaggccctgctgatggctgccagagcatctggtgcctccaggacccactcttgcccgtcaaggccctcagtgttgcctgggtctcgcctcacctctctttaattccctcctcacctcccgagaagccccatgtctcccaccatccacaaacctgttcctcctgaggcccagaccctgcctccctggggtggcctccccactccccagctggtgctgatggatctgacgcccctagtggactgcaggcacgggcagggcagggtccagttcctgctggcagttctgtccccagcactcagccctgggcttcacacagagacgtcctccaatctgtggggaaggaagattcttaggtctcgccctggctcctgcttaactgtggccagggccaggagtgggaaactgcaccagccactgacaggtggtttctgggtgaaaactttcaggtgtgcgggaaccagtgacagggcctcagaggacttgggccacagtcgccttcccaccccctggcccctggttctggaaggaacatagtaagcagtttctgtctaggaaaaacctgcttctcagtcattggaagatccctgagttctgaggctgaaaaggaaagaaagttaggatcaaaaaacccaagccttctttactccacaggagacatcctgggtccaggcagggaaggttctcagaaaggcttaggacaaatcctggggcatccagaaggtttgaactgctttctgaacccaggtggggacttcaggaacgccttgcttaacacagtcacagacccctgacacagaagggaccatgggacagaggcagggaaaacctcaggggctgctctccctccaccccgatgtgttcaaggcaccaactactgagctggggagattccctttgtcaaatgttaaagtccttaaggcccagaccccactcagtgtctgccacctagcaggtgtaaatggatacatagtagatgggtgaatggatgagtggatcaaggagagaatgaatgggtgggaggcgagttggatcaaacaggagtggatgagtaactaagggatagatagatgccagggaagagtggaggggatggtggtgggttggaagggatgtgagtggatggatgaactggggtggctgatgggtagatgatgtatagatgggtaggtgcacaaggtttgataggtaggtatcctgggtaggtggtgcaggatgtgtggctggctggctggagaagggatgatgggtggatttgaaagaagagagtgggaggatcatcatcctaaatggagaaggaaagcaagattagagatggcactgaatccttggttctgctgcaggatctttttgaggaaccaggaaggttcccttccctaaagcaatggtgagcccatgaggtcccctacctcctcaagagaccctgtgagctgaggacgttctgtaggcgcaggccttgctcagaatcctaagcccaagcgaggaaagagccccagccgccaaatgcctgcagcaccccagttgttgccactaccaaagactggtcacaaatgtctaacgtgcgcccggggtggcaatttggtaccacttccactgagagtcacaggcagagagccatctgccagcccaaggccaggaaagcagacccccgccccggaagggagtgctccccactgttctgacgcccagctgcagagagggaggggcggggggctctctcctgtgccggagagaacggagagaacgtgacggtgtttcctcagatgtgcaggcctgggtgggagcgctagttactaagtacccagaattcttcgccagctggaattgtagtggccaggctgggcccccccagcggctggggtctctctgccccttcgcgttgaagagcaagtcggcagcccaaggaaggcgcgatggccgccgggcccggccctgcaatgcctggtctctggctcggcgggtccagctcacgctccctctcccattggcctgtgcactcctgccccctggtgggtacagggacaactacagtacatggggcagggtggggccagatggaggtttttccctgcaactggaggactgggtttgtgtgtgtgtgtgcgtgcgcgtgcatgtctgcagactcacacttcacttggcctaaaagattagagatggaggaaagctctgaatgatccaaagcagctcctcaaatggaaggggttattattataattactatgattattgttatcaagattatcatgcttgcctagaaagtcttgtacaaagcaggcttattttgtgtcagcttgttgtttgtgtctgaggcatttcatctttgcttataataactaacattggcaggcttctttcatgttgcaaagctgtgtcacatcctcaccccgttttatctgcacaaacagccctgtgcagtggggagtagtgagagaacagaggctcagaggttaagtgttctgtccaaggtcacatggctaaaaagatgcagaagccaggatttgaacttgggtcacacaatgaaaatccctgttcatttccccatcatatccttggcacctcatcccttgagagggaagaggccttttattaagctttagctccaagcctctttgccactgatatttgctgaaaagcttacattgccatgaagagaagggaagggttttgaagactcaagtgttaaaagtgcagtttaccatcccagtttcacacaaagaatatacctgggcttttccaagtccctgcagtacctggggtgtgagtggagaatgtggtcttctatccttttcgctcaggttctcttggtcaccaccaccacccctggggtgtggcacaggacagacaggcatctgctacatctctgagaagcgcggaagaaggtgctatgacaggagaagctggtgcagggggactgtctgtgtcctggtgggtaggagctgggtacacagggggcagggccctgactgggctctgggagcctacgcccctccttggagcatgggttctatctccagggaccagctggctgactggagagagctttctggaagcagcacccctccctgctgcgcaccatgggctgttatactgattgtcaccagggtgctgcttccccagcacactcgtgaccagccgccagcagcacatgtcctcgtggcaggacacagggcctgtgtgccaggataagggaccccctgtgtaatgccagttccggagcatcactaccctaccacctcccaggcatcctgctccccagcaacagcccaaagcaacccacttctggggggtacctgtaccatgctccccacccctctcaatgctggaatgtcccctgggccctgtctccacaggcctcttcctctccttgcccacccctttctccagctgctgacaggtgccatgcaaaggtttacatagggggttctctggagccttgagcttccccaaaagtgcctcatctccactgtggcagctttgagccatttatttgtcaacattaagagtgagatatcatttaaccagaaagattgtactggttactatgataaaaatatgttcatgctgtctttaaatcattgatgtggaaaagagtcctgtaggtggccttgagaaatgacaacctctcctggcctcctgatcctaaacccataagaatggcatctcgcttactgttagcattcagaaatatacagtcccagccatgccccatagaagagtcccatcctcctcccgtgtgcccaatcatcatgagggtgggcgggttgctcttatctctatgtggcagccctgggcagcctatgacgtggagccgtgtatactcgtccactgggtggacagcagcgcagcccacccctcagggccatccctgtgctaagtgccctccgtttgctcacacaacagccttgcagagaaaatgatggtgctgtcatccccattttgcaggtgagaacactgagcctcagaaagatgataccccttgctcaagctggaagctaaagctggagctcaggtctgggtagctcctgaatttacagtctgaagcccgcagaaagctgcatggagcagcactaaaagtccaaggagggagtgagcaaaggaagctggcagaggaggctcctcgaagggtgtggggtggcaagagaatcagatgttggattccatggtgggttccagcaggtgcggaatgatgaggtgggggcattctgggcccttaatgattacaaaacccatcccacctgcacctatacatccgaggaaatgcagtcaggttttccctcacacacacagcagagagccccctcccttcctctctgtagctgggccttagaaccactgtaactgggacagtggtgggaagagggacccactccttcatgcctcaggcagacatgcatgtccatgaactccttacaggactgcctgctactgaatcccccagactgcctttagtgtgcagcatgtatgtggccagtgctcacaacacagctagtgccataccagtcccatgggagagagaggggccacccacacaggaaacaccacacggcatgtgggcactgtgcacggggtgtggtcagatagtaagagaggagcgggctcagaagccaggaaagccagtggcgctgcaggaatgggagggggtcttcctgcaggaggtaggccacacattagccttggccgactagggggcataataggactatttggggtacaagtgcaaaaataaaccaaccaaacaaacaaacaacatatcctccaatggatttttaaaagcaggggattgattgactcaagtaactagaaagcccagaggtctctgtggctgcaggcgcagctggatccaggcgttgacatattatgactcaggtgcctccctctcagctctgctttcctcagtgttggctgcacactcagagggggcctccctttgagagcctctctttcctaatagctgctacaagtgtcctggggctggctgggactagagactgattgttagtctcatttgacaaatagggattctttgtccaccccagactcttcacaggccagtgagatgggttggccaagcccagagcatgtgtccacccctagaatcaggggagatttagctcaacgcagaccactcagactgggctggagaagggtgcttcacttctgggaactggggctctgctgccgtaaaacaagagaaaaaagccacaaaggcagagagggcagctgcccaggagaacaggactgggcagagaggagcgggcaggccttcactgccacctggtagcggtcactgctgtctctcctgcagaactgcctgggcgggagcacgcagtgagttttctaaagaagtcagctctagccgtctgccccgcataaaatactcacaggccagacctggtatcttcatccattcaggctatcatagcagaataccatatgctgggtggcttatacacaacagaaatttatttctcacagttctggaagctgggaagttcaagatgaaggtgctggcagatcactatcaggtgggggctactttctcttagacggccccttcttgctgcgtcctcacgtggtggaaggggtgtgggtctttggggcctctcttataagggcactaacccccttcctgagagctccacctttaagacctaatcacctcccaaaggccccatctccgaacgccagcatcttgggggttaggatttcagcataggaatcttagggggacataaacaatcagactacagcacctggtgagtctgcccagagaacgtgcgtgtgttttgtcacatctcatatggcctgggcacccaggcacgctctgaccagcaagaaacagcagtgtgatggggccgtagcagaaagaatggtgctagaaaatacccaccacacacaacccataggcccaggaggagccttggatgggaaattcaggctcagcctgagccccgtcccccagacccctaaaagcaggcagacaaaggagcagggtctcccctggctctagtaattgcttgtgaagcccaccatccttttttttgtgctggcaaagcccttccttcccctcaggcctggcccttctatcttatgcatctcccttccctctgcttgggggctgggctgggtacccgttagttctcagcttgggcctcaggtggccaggccttgtctgagatgtgaagtccagagctgctggctgtggcacaagaggaggtcgactttgagtccaggctctccttactggcgatgtgatctttagcaagctctctcgcctaagcaggatacccacctgccgtaatcattaaatgagacacaaactgacaagagctggaggatagataggattgagtgagaaactggggccaagcctcatattaaaatgccaaggatccatacatcctgcagacgtggctgagcaccaactctctaccaagcacggtgtgaggcccaggtaccgtgagaaatcaggaaacgatccctgccctgaggaccaggctcatacagcaccagctgtaccatggtgttgctgtgcgctgtgggagcagggaggtgggcttccctaaggaggtgacatttgagatagggtgggactgagaccagagtgatctggacagatggagcacccagcttatttggggaacaggagtaaggctgtatggctggagccccgtgagagggggcaagttggaggatgtcaggacagagaggcagtcaggggctttgtaggccccaaggagtctggaatgcgggaatgatgggcagctgttgaaaggaagagctatacccattatgattaagtttaactgaataccagaaactctggaaattatgccttaaataagatagaaattgatttaagtattaagaaaacacacactgaagatagtgtgaggatgacttcagatagtgtggagtctgatccttgacctaggctgtttttggatcactattccactatccctagggtgttgaccttgtcttcatgatcccatttagttgctagagctccagccatcacatccaagttccaggcattaggaaagagggaatgagagaaaaagggtgccccttacctttaaaacaacctttcctgaggccttacttcacttcagcttacctttctttgtgcagaatttgtcacatggtcacaactagctgtaagcaaaaaaaaaaaaacatccagccttttagttggatatcagtgtgcccaaccaaaaatttctggattctttttgtaaagaagaaggggagaattgatgttaataggaaactaatggtctccttctgtgtggggagcaggctgaagaggagaaggaccgaggcagggagcccatgggagggaaccatggaggcctggacttagaagtcggggaggagatgaggaggagcagacagctgaaagcagatctgaaagaagaactgcagggcactgggcatgggaaggactcagtgaaatcaagcaggtctcctggtctttgaatttgagcagttgagccaatgtggaagacaggagagagcgggaagggcggggggccagggggtgttgctgccagcacaggacccctccccgtcccacaacaggaaggcctagacccctgggctatctgctggagaatcccaggaaatcatttatcccagatgtccccaaactgtagaatgcatcctactggagtgggacccattaaattccaggccacacatggaagctcaaacatgggagcacagtagctttgtggcctcggtttgtaaatcacaccgtcttgagtgtcctcctacaaagcctgttgtggctccagggcccccacattagcgtgtgatcctcaggtccagggaaggtcttgcctcgcaggcgtccccaaccctgctctcaggtcctgacttgttctgactcaggtgctccacagatctacagaaaccatgaaggtagggcccaaagaaggaagagttggaaaactcttgccaggtccaccacccgcattcctcagatgggaaagtaccccaagattgcccgaggtcagccaggcgtgaggagcaggatcgctgcaggtccctgactcataggccttgcactgtttttagccccaggtggaggcgccacccctgctcacccacctgctgctgccctgagtcatccctgcctgcctggggcacccaaagcccaggccccagggctggctttccaggtcactgctgccaggggggcccggacagccttcatgcccagtgagggcgaagtcagaccccacgggctgggttgttggcgatactgacccttggatgctgggtcaggtcagcatggggacttggccttccagcctctgcaccattgtagcttccttcccaggacaggcaatgggaggggcacagcttccagaactttctcactgcccttctgcagtggacagactctgacatgtaaatagcactttagctggacagctcaattctggaagagctttggcctcacacttcttttgtacagacctttcgttggcgacaaaacttccagatgctgacctcattttctttgtgtctctcccatccccaaggatgcctgcagactttcagtacctcccactcacttctagagccacgtgccatgggctgggcagtcagtctctctcctccggcctaatcagagggttgggagttgaaggggtttgcggcagaaaaattatctaataataatactgcatgcagctgggcgctgtggctcacgcctgtaatcccaacactttgggaggccaaggcgggtggatcacctgaggttgggagttcgagaccagcctgaccaacatggagaaaccccatctctactaaaagtacaaaattagccgggcgtggtggcacatgcctgtaatcccagctactcaggaggttaagccaggagaatctcttgaacccaggaggcggaggttgtggtgagctgagatcatgccactgcattccagcctgggcaacaagagcaaaactccatctcaaattaataataataataataatgcacacatgaataaaatatcccaattctggagagcccgtgaaatcggggagatggtaggcctggtgtatgcgactcccagaccccagtggggtctcagtctctgttgggctccaggactcgtgcggtctgaaaccagggggaaggcggctggaggaaggaccccagctccctgcctccacctcctccagtgctgagcatcttgtcttgggcctggtagtagtcagggtctctgtgagtgcaagtggcagaaactaacgggatagggctcacaggacaggtcacatgaagggtaaagggacccagccttggggacctaaataccatgacacttccctgcttctttctggtagctttattctgagagtcttcttcatgggttgggggacgcttgtctcagtgatactagcgactctggggccacattctcctaagcttcccactttgaaaaatcccagggaaagactacaggtggcccagcatggtcacatgctcaccagccacctcctccactcatcgaccctcttccttgccttggcatcccacacctggttcccagggcctggcatggactggaagctggcctgggctccacaggactcagggtccagcacactcctgtcctggccctgtgttcccagccatgcctcttcctgtcgctgggacatctcgcagtgccactctgctggtgcacaccctgaggcgtggtgccccaggcgggcagtagtcactaggcaggggtgttctcaggacctgctaggattcagccaggaatagaggggccactcggatggtggttaccttgcattttggttaggagagtggtctgagcaaagtcctgtcagccacagagacatgtgaagagcaagaagacagggtatgtctggtgcctgggctgagacaggggcttgctgtcctcaagacagcttctagaggtttaggttcctttagaagcttatctgagaaaaggatttgggtgagacaaggagtttatttgggaggtcatttcaggaagcaccgaggaagtggggaagccacacaggaagggagggaagccatgaaggggagctcatgggtggcctgccacgttggctgctggggctccatcccatggggatcctgtctgaatgtgtagcttgtctcagaattgcctccctgggagggcaaggaagccgggttatttgcccattcctgtctgtccggggcaccgactcaaactgcagccagctatacacctgaggcagtgagctccatgggcagaggcaggagggcggcccggggcagcacctgctctgctctcacctactctgcgttggacattaaaggctgtggctgcctcagacggagcacatatcttcctgggcaaggccacttcagctgtggtctagacccctctaccaggccctgtcagccgtccagggagctctcggcacaggtgggtctgatcatagaggctgggcctggagtccgaaggcacctcatcttgagtcccacccctgccactcaccatcgggttgttaagtgagtgccttcctctctgtggccctcaatttccccactatgaagtggagatggtaatactacagcaactgctgtattagctgtgccacagcaatgctgtctactgagcctctcctaaacccagccacttagttctgcagatcagagacccagggcaggctccactctgtaccaggctccccgagtcctcttcccaggatgaatgacagagcccgggcgtattcatggcgatggcagggcccacgaggaccagcagaaacacggcctctcaaggagctggcacagtgccactgctgcaccattctgtgggccacggcgagtcctgtgccatactcaacatcaagcagacaggacatatactcagcctttagcaggaggagctgaagaggcgcagggcaaagggtgtgggcagaggaggggtgaaaggcccaacgacacagctcttgccactcgctcctgaggtgggggaggttctgaggacggagtgtgttcaccaaatcctttgtacgctaagtactactcccgtgtgcaaggtggcggtgacggtgcagtcctgggatgtctgcaggagccttcttatcttcaaagaccaccacactcctggttgtgatgttacatgcatgtgattgtagtctttgaaaaggcgaccccactttggtatccaggatgaggggaaggggaagaaacctgttaattatgcagtactttttctgtaatttcaagaaggctcagcctacacgtgtgcaccttaagcaaattcatctacacccactcagacaaggaggaagggaggaggcagaggaggagagtgctccaagctcattacctgtcctttcccatttccatgtttcacctgacctaggagcttcccctgcccccagagaaaggtaggccccaggtcacaaacaaatcaagaaaaattaataaaatggacttttggctttgagcagtccaagggccaaagttcttgagatttagtgttggcatgagatatttttgccatctgcactaacttggcaaccagcccctcccctcccccagtcctgaggcacagccccgctgtggcccatccctcagctaaccggaattctctaccgaaacgtctgctcctctacatagcccagttctagggactgcattccaccctgtgtaagaagtatagaaaattacagctcagccaagaacattgatttttttctcccccgaacaaaataaccgagttttcaggatgaaagcagagctgctggttgagttggagggtggagagcagagccaggcccactctgccttcctgctggttgagttggagagtggagaacagagccgggcccactctcccttcctgccccagaaaactctggggccccatgggctgcagcttggagctcctgctttaggacatccatgtggtagaaggccccacgggccccaggaaccccaactgtgcatgctcaggtcgtggccctccctggagcaggctgtgggctgagctgcggtcctgctgcactggctgggctctcatcacagtccccgctaggggagagcccttggctggcagaggtcttctgtccccaccaaagcgtcaaagcccaccatccacctctcctcacaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatagtgagtgtcccagcgggcgcatggcctggagccgggcagtgatgcgggagtggaagggactggtgatggggattggcagagcaaggaggattctcggctgaggtcacgcctgccgggagatgttctcccataggtagagggtgtcaggaaggaatgagaaggggcctctcttcctgcaccccaggaggagaaagaggccagaggaggcagaggacgcaagagacaaccaaacagtggaaattcccagagggccgggaccttgtcactggcttgtcctggagagtgcctggcactgcaaaaagacagctttcaagtgtagcagctttgtttttttatagggagcccctgaccgcataaatacaaaccaaaacaacagccatataggcagaaaagaaatggtgccattttgttttattttagaaaaaataataagctttccattccccatctttaaaattaagaataaggaatatgtaagtctaattaatataataaatgtatactttaatactatttataactaaataagggggatgacaggagggcaggaggacggaaggaagaaaggaaggggagagagggagaaagaagaggacagaagagaagacggagaggtgggaagtggtaaaagctggagctggttagaaggtgctcccggctcttcccatcacagcaggtcacaggtccactggctgcagctttatcactctaggcatctccaaggacatcctcactgcttccgtgcccttggcctctagattggaggctccagagccctgggatggtcagcgttggtcagggacatgtcttctgtcatggagatactgggattgcccccttggctttcgggaaatgcaccccacctttgcaattgcaatctggtacccatacattcagtgggggctttctgcaaggagcccttgagctttatcccactagctgggaagattctgacatgatccagtccagccattttcaccaggtctcagctggggcctttttgcctccaggggacattcagcaacatcgggagacatttttgatggctgcagctagagtggtgctcccggcagctagcaggtagaggccagagatgctgttaaacaccccatagtgtgcaggacggcccccacaacaaagagttacgtggccccaaacatccatagtgccaagattaagaaaccctgatctacgcaatgccaatggacagaggctgaggccaatgttcactcctggacatttccacgggccacatggcagccaacagactagggacttgagcaaggccgggagcggcttcccatttctgcacacctagattgtccacagggcaaatgccgaagtcctgtgagtcccaggtgatgactacctaggcccccgggcctgatgagctcccagggacaccctggtggtcagggcagtgagcccagaagctcagtgtccaccattccgtatgcacaaatcacagaccagagctaggcaggagagagtgactttcagctgccctcctcccttcttccactccctgtccctgccctggagtccagggcctcctccccgagggccagcaagaccctcaagggcctttagggccagctggcccaaatctgtcttctagtggctcagcaaattctgctctccacttacatttttacccatttcactaattataacatgaatccattaccaaaaaaaaaattaaacaaatgcagagggatgtaaaatgagaagtaatcttcctactccccccaccagccctgcccctcccacttttacccacttccatttatttgtcccagtggcatccagaaaaacttgatcctctgactcaaaatagtatttactgccacccactctggaatcgagggagctcagctcaccttccttccttccatcgctctccaccttcacctccggctttttgctagttacaggattatttttagttcttccggtgcttacctttataactttaaataagaaacttgagtcagtatttgtcaactccccaccaagtaagctgaggaaattctcctccctgcagcctcatctctgccttctttcaaattttccacttcccaggttgatgatgttaccattctcttctgtcactgtggctgggccttccgtgtctcccctctgggagagggcaggaaagacaggggacacacaggtggccagggccggaagggcctggcacatttcctgtcttagcagttagacctcagcttctgacaaagtcttgggcccagtatagaaagcagatcagagtaggtttgttgtgctggaaaggagagggaggactcacagggctgccacagcacgtgcttccagggggtgccattgacaccctaatgccccaaccaccaaagcacttctctgcccagccctttacaggggagggaccagggcacaggctcctgagcaggctcttggtgcaccccggcctctgtgaacagggctggctctcccttctggataactacctagaggcaggtcccagaaaccctgggcacatccaaccaggggctgtgaaaggtgctctggggcctggttggcattggctttcctcaaatccagttccccactgagttgtccatgctggcgtccgacgtttcctctcctcaccttctctcttgaccccactcctatcgagctcttgctcctccgcctgctgagatggctcatagcccagtcctatcctgggggctgctccatcagcctcctcccactcagggttcagggttcagtcccctagtacctggtacctcctttcactcccagcccccgcctcctctcgggccgccctttccagactccctcgatgcctcctgcccacccacccaggcaactggtgatgggggaggtctgctgggggctgctgtatcccgtccccaagctccatcccagaagcacctcctctcaaggcctggtgcctggtgaccttctcctgtctcgttttaaacaccttgtacacttggacaactctcaaattcatatcgccagcccagccctccctcctgacttctgcctactcagtgcctgtttggacatcaaatgagtctcaagttaacatgagcccgtggaacccctggctcccatcctcccactagaagctgctctgtgtgctcctccctccctctaaatgtgtctcattccaccacgtggaggtatctctacttctgctcgtcctcctgtatcccacaccgaggccaccagcagatgcagctcccctggcaggtacatcagattctgaccactcacaccctccacagccacccccactgtgccagtgccatctggtgacgacagcagctctgcaggccccacccgctgacctgctctcatggcagcaacagggccgttgtcaacatgcttctggccagaaccctcgaggggctcccatctcactcagagcaaaagctcaagccctgacaatgacctcaagggcctgcttgccccagccggactctggccaccctcacctccaccaccttccccagcctcacccaccacctggcccctccacgtgtgcttcctgccgccatgcctgccagtgtttccactgggccactcgaggcccacttgctccctcattcccctcagtctcccctatccagacgccttccccaaccaccctgcatcaaatagcagcccccagcagctctcccccatcactaatagcctgattcgttctctcacactacctcctgacatatcatctctctgactcttctgtttaccacctcacacacgtgtgcacactcacttggaacacaggccctgggaaggtggggctgtgtcgactgccccatccccagctcctggaacagtggctaggtgggatggacagcaggtgcacagtcagccttcccgactgggttgttaagcagttctcccacaccttgcccaccctccacagccgtctccttgcatgaggctcggccagcacagagaggccagagggccaggttgcccatctaaaggaggtttgccctggctgggaaaggaagagcaggaccaaacgcttccaggctggtgtccagctgcagatgacagcagagggcgtcctcacagcttggaagcagaggtcatgggcgccagggcggggcaggcacagaggcttgggagaggctccttctggctgagaccagagcctgcccagataccactggctggcgaggaggctgtgaggccgggggcgtgtacaggtctgctctgcagcctcggctctctcaccccatccccacaccgttcctgtccacggagggcagtcaggctcaggagaggaggccaggagtcctgtttaaattttttttctggatttttaaaatgctgatgatgtccagtttaagagcatggggtctggagccagtcagaactgggctggaatcccagccaagtgcattttctttttttctttttttttttttttctccccgagacagagtcttgctctgtcacccaggctggagtacagtggcacgatctcaactcactgcaacctccgcctcctgggttgaagcgattctcctgcctcagcctcctgagtgctgggattataggcacctgccaccaggcccagctaatttttgcatttttagtagagatggggtttcaccatgttggccaggatggtctcaaaatcctgacctcatgatccgcccaccttggcctcccaaagtgctgggattacaggcgtgagccaccgcacccggctgccaagttcattttctcgcagtgtgacttcaagcttacctccctgagccttggaagccacccttctgttttcttttcttaggggcattctcacaaggattgtcactgggttctatcagtgaacaccctagctggcgaagtcatctgccctttccagccctgtggacatccatgagctggtcagcatgcccatctctcatgcagtggtaactgcaggtccagccagcaagctggcccccagcaggtcctggagcagatgcagcctgggaccccacatcgttctgtggttcagacacttggggctcctccctgtgggctgcttgtggtttgccccggcagcagggatgggtggcctggcaggctccatggatcactgagtcttccttcaggcctggcccagctccccacttcctgatttcccagatcctaccctggctttaggttcaaacttaacccacaatgaaccccaaagcccttgcaggcagcgtcctctgagtgcttggcctgaggcctgggcaggtgacttgcaaaagcctggtctgtccccatagcaggaggtagcaggggtaaagagccctgattccaaagaccgggtcccagggaggcccagccgctgtatggctgtgcagccctgagcctccaagagcatcaaattggaaggggcacacagaccccttggtaagtgagaaggaagtgtggagaaggcagggaactgctcaggggccgctgaagccccagacagtaataaaattatggcctctggagccaagggtccgggtcacagcctcaggcaaggtacttaccttcgatgagccccagttttagtacatttaactcagggaaattacacatgaaacatggttacacatgcaaagaatagaacctatctgttggccattattatcttttaaatgaaaaaatgacaaaacagtattataataaacatggtagtctcatataaaagcttgatcttgtctgagtgtcccgggagctgcatgcgtagcccttttggctgtgaatgagtgcgtgaggccaagacccctaagacccacttcctcagtcgcccccactccctatggcctggaatggaggtgatgtcttttccacagtgacctggaggggccctgaccgagactggactctgaagatgggtggcctggccagtcccgaacagtgtccaggcatttggtccatagtcccctgtttgttgccatcctcagctacctggacagcctggatcggattggggccgccgactaccagcccaccgagcaggacatcctccgaaccagggtcaaaaccactggcatcgtagaaacccacttcacattcaagaacctccacttcaggtgaggcccagagaggcccccaggccctggcgagggctaagatgggacatgcccagcctctcagcgcattgcgtttacagcgcccaaacatcatcctgccccagggaacctgcgggttggggcaggcagctagatactagaaggaacctgtctgtgtttctgccaaggttaggggctggagtgagcagggaggctttctggaagaagattcccagagtggggctgtgaggaacagggaggatttggacaaggaggggcagcctgtccctgaggtgacttccaaggaggaggaggaggtgggctaccagggggcccttccaaggtcaccttggggggaggagccaagagtggggctgggtaagcccaagctacctctgtgagaccctgaggacccacgtaatcccagagctggaaggagcagagagagctgacccaccctctcctagtacgcttgggaagctgaggcctgacaagagcagggcttttcccaggcacagagcacagctagaacccaggggctctggggcctcagagcaggggcctgacgggtgagctggttcccagggtcctgctgcagcgctgtgtccccacctgcagtaacatgcgtgcactgaggcctgctccgtcctgtggggaagagaggccagcagagaaggggagggcagggacccctgctgggagagctggattctaatattccctgcctcccatgtccccaactcctgcccgctcctgttcagactgaggggccgaggctctgggcccaggaacccctaggcctccgcagatctggggagcaaaaccttgggcagagcagccctgaggggcctctcttgccttcccaggctccttggtctctcctgctcccccactgggagcacaggatggggatctcagctcaacccagcccagcaaggcggggtctgagaataagcattctggaggggccacagaggccatctgccaacgcccctgcatttcagatggggaggtgggatccaggggaggatcccctgattgatggaatgagaaccagacccattccttgctctgagcccacactaatctctgcctgcagtcactccgttgtgtccggtgggaccagagatccttccctgtccccctctggcaggctgtgtgtcagcaggcatcccagatctaggaggctacaggactcctcgctctggggattggggtgggagactgaccttttacttccaggacgtaagtcccacctgcccacagtctcttccagaatttttgtgccccctcgggagtagagtctgagagggggaagaggccaggctctgatctgccagaaaggggccgtactgggcagaggtgagagcgccagctttgtccacagccagacccagctccaccacagctggactctcgccagcttgggcatgtcctaagcccatgggtggctcacttctgccatccacataacaggtgacatctcctgcctgcctccctcccaggctggtttggagtttgcccagagcaaacccaggaaggaatagactgagaggagggtcctcatgcgaggaggactctcagaggcacttcctgggggtggctcaggtgcgccctcttagtaaaatgctcctcagatgcaagggcaggtctttgagtcatgatctgtgagcacagccagtcccaggacagactccaggggtagtgcctggggatggcagtgatccagctgtctgtcatcacctggagtgacaaggtcttctagtgagggcttttagcaaggctctgagcaccatggcccccatcctctgcctctcagcgtgctcacagcttaatccccaggcagccctcacctgcctggaccctgcgcctaccagctccctgcctcctacaggctgtttgacgtcggaggccagcgatctgaacgcaagaagtggatccattgcttcgaggacgtcacggccatcattttctgtgtcgcgctcagcggctatgaccaggtgctccacgaagacgaaaccacggtgagtggcctgggccccccgggcagggggcagcgctgaggagacggccgcaggataggccagccctctgagcactgggcctcgggtgcccacaatggctctggggtccagccagctgttgtggttagaggtttccatcatggacaggccgtgccggcactccaccaattctgtattgccaaggcaaatgcctcatgatgccagtgtggcagagcctgtgtatgcaacctgatcacacagagccgtgcagaatgtgcctcttccataaacttggtggagtcacagaggccatcaggccatagcaaatttaagcaaaccctaaaaaaaccaggaggcagccaagcaagaatgtacaggcaacagaaatagcagtcttagcctgacagccatccctggggcactggcgtcagatgctgctgaagcagcatggggccggggatgctgagggagaggtggggagggcccaggatgctgcaggagagttgcgtggggttgggggtgctggggagcagtgtgtggggctgatgggccaggaagggcaatggggatgaggcatgctggtgagtgacagtcgtggctctgggctcctttgccaaatgccagaccaggctcctaccttctgtcttgcgtcacattcagcctagggcctcagtgaggggacattcccctgggagagtgcagccttcctctgggtctagtcctggctctgctactcactggcttgctgctgaatttaggcagcaccctttctggctcagttactattttccataaaagggagataataatagtacctgcctgtggggggctgttggcagtggggtgggtgatgcgtgtgcagcgctctggagctgtttctgggacagcagcgccaagctggtggttgtacagttgctggtgattgccctgagcctgcaggtccactgcgtggtccccttctgggctgcagcccgccaggcaccgagcatggcccacagggtcactggagacaagccccaacactcctgacagcggggcccataggctatggggtcacagcctggcgtctgtcatctccttctgtctggaacacatgcaaatcccccaccccacgcctctgaaggctggcaccgagggtttgaggttggaggtggggcttgttgtcatgctgggccttgagcgaggcctgtcctctctctgggtctgtttcctcgtcatttctggcccagctggtccactgggctttgtgaggatgggatcaactttggggtgtgggctacggggcacagtgctatagggaggaggagccgccgccctgaggggcttacacagagtgatggggctttgggctggtggtgtgggtagtctggacccgttccgtgtacaggcttacccacctgactcttcctatttcaggcccacctgtacccctgacttgggtttctgctgtaattgttctcaatggcatctgcaggcagtgatgtcagtcaccagcccagtcttgatgctgagtggggcaagggtggatgcgcttcctgggccgtgcttggacccagactcactgaccacccaaagcccaggtcagcttcctggccatgtgcccctcacagtgactacccagacatttcccactccccactgctagactctatgctattacggccactgctccaactcctggggtctgagctccacttggctcatcttttttcccccatgtccaccacggtttcaaagagagcaaaggagctagaagcaggaagccaggagggcccttccccctggaatccagcctctccctggacctgccctgccaggcctgtggatggcttcaacccaagtcccaggcccaccggccatggggctgggctctcgctcacctctggaagatggaagcaagggacgtctgggtgagcctagcagccacaggccctgagctctgcagcccatgggtccccagtgagcatgagcctggtgctgggcctggcactgggtgaccttccagcctgcgggccttgctgcctggagcacttgccctccggtcttctccaccttctctcacctccctttttccccatttcccccacccttccacacaagggctggagcagaggaccttggagaagccaaagcaaatggagccaaggtcacaggcaggctcttcctgtgtccttccttccccaaggctggccacctttgcagcccggggaagagtagcagctcgtgcagggaatggggatgactttgcaacctgacagcagccacaaaggcagctcattgccgtggtggcagcaagaacaatactggcgctgtagaactaagcagtcatcgccgtgcgctgggggcgcatgcagaggtggacagcttgggagtcagacagatctggtccagggtctagcatcacccctgccgcctgtgtgatcatgggcaaccgccccaccctgcccgggcctgcacctcctcctctgtaaatggtgacaatggtagaatggaccaccgggctaaaagctgtaaaagtgcctgtacacaggaatcatcactcagtgaatagctcctgtggctacaacattcagatgccatggctagaggtcaggttctaggatgtgggagctctgtctgcctcagggaggcaagagccaggccccaggaactcaggccttggtcctcagccatcctctctggtcagcgctgtgcatccctctctggcctggggtgagagcctgcaacaaaggtgtctggaagcagcttctggagccaggccaggagagccctggggctagtggctgccactggccatccagccgccctgtccgctgcatcccgggagcccgagagcctggtcctggcctcgtacctgctctcagcaccgcccagccgggcctgcggctgccacagcttctccactaccacggtcgcctccactgcctgcagggccttatcttgccaaaccaaggccaaaaccagttctgagagaccctccaagcccggaaggtatgaagcacctccctccaactgaatccatcagctaagagttgaaagcagcaggttctcagggcaccgctgggtgactttgctgtgatgcctgcccagcccgcccctgcgcccacactcctctccagccacttggcctgggctcatcccacccatcctgcatctcttgccctgcaatccacaggcccaggatggccatggcccctgtgagcccgcaccgggctctctgcaggagctagccaggatgccctggccctgagactggttgaaccaatttttcagtatttttctctctttctcttgttgggtttttatcttctctgttttcatctgttttgctgtgtttcatcttggggttcctctggcccctctactgagaaaccagccccaacaaccagttctcccagagcctcccccgctccagcccaccaacgagaccaccaaccacaccaaggccacagcaagctcacccccgagacgctattccctggtgtctgcttccaactcgggattaattcgaggatctcttagtcctcagttaatgtttcccaactgaatgcgtgcacccttccaaccttgctgtcaaaaccgaatgagaccctggtagagaaatctgcatgagcagggttccgcgcagatgcgttcggtggtggttgcggcccctgcgctgtacgtgcatggtgcatgtcctctccgtgagctggagcctctccagtgacctcactgcccccacctggggccagctctctttggaagggggcagcatcccccaaccctgcccggccctgctccgccccgccctgcctgcgtgtggaatgaaacaggaccacgtcccgtctgtccttgtgggtcctcccgtctccgtcctggtggtctccgtcccggtggtgcatccagccacattggtggaccttccctttgcttgtcccgctgtgtcattggccgcggtgggtcagggccctggatgctgccgcccctcactcacccctccactctgttgcagaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggtagagacccctccagggacagcaggcccccgagggagcgggccccgttcccaaagcccagtccacccttcctgtgctctgtggatgcccctgactctgccacagagaatccacacaaacggtcccccaccctgcccccagattgtgctctagagaggaggggcagctagccggggcttcctcatcagggaaagccggtagagccctggctctgccacttacgagctgtgtgaccatggcggcctctgggagcctgagctccactgtctgcgcacaggggctctctgtgacgagacgagcaaacgccgagaagatgaggggcggggcacagaggcttggagttaggcagcccaaggtttatgccccagctccgccactcacaagcagctcaggcaggtcatgcagcctctctgaacctcagtctctgggtctgtgagatggggtgatggctgtgattgccctcgcctccctcaccaggtgctatgaagagggaatgagctgatgggcacgcagagcttcgcgtggtgccgcacataggaagcgctccctgcctgtctgctcttgcctttagggttatgcctgtaactcacacggggctgctgcaagactcaaatcacagagctttgcaagcagcagagccctggccccctatatagggtgctggggatgagaggccagccctgccagtgctgtggtgggtttacctgaccatggggtgggcgggcagccaggagggcagcatgaccagggcccctgaggagctgcaggttggcagctctggtcagtgacaccagagcggttacagggccccagcatagctcgggtgcccatcagctcttctgagatggccagaccctgtccagagaagtgagtgggaggagaagtggggcaccctcagcccgacctgccctgaggccttggagggcacagagcaggggcagacagagtcccagtggggcatcccgggggcttggggccaggcaagcagcacagctctcctacctcctgcctccgcccatccccccatatcaggctgagtgcctggcaggccaggacccaggcatgtccagctggagttgagtagggctcagcctccctggaagctcccagccagcttcctctctagccatagttgagggcctgtggatcctgccctagtgacccgggcttgtggcctgtggggcagtggaaacaggtggggtcggtcagttaccaaggccagtgtgggcctggagtggggaaggaggaggggacaagggaggctgagtagtcagctgcagtcctaggacactccccaacctccagcccagattgagcaaagagctgaggtctggcaggccctccaggctttctgcacagcagcccactccagcttagagctgcggctctgaactccagctcccctccctgctgccccctccacagccctgcttgcacctggcatggattcctggaggctgagggccttcagtgcaaagctggggtcctgttcttctgccccttcccaaactagaagcttctctcctagactctcctctccctgagcctacctgagaaccagctcagtgtgttgccccctgaggaaggcagcatgtgagccaggcggttgttaatcccctgtgagtggacagcagaaacaagaagtttataggcttcttctcccatctggcccagcagtggccacaggaggtgatatcaaggcctgctctgtggactcccaaaggaaaaggcccacccacagggtgtgcatcgaccagggctacctgcatgagcccagtgccctcaaacttccttgctcatgacccatgataagatataacatttgccttaggagtccataaatggctgggcatggtggctcacacctgtaatcccagcactttgggaggccgaggagggtgggtcgcctgaggtcaggagttcgagaacagcctggccaacatggcgaaaacccatctctactaaaaatgcaaaaattagtggggcgtggcagcacgcacctataatcccagctacttgagaatcacttgaacctgggagtcggaggttgcggtgagctgagatcacaccactgcactccagcctgggcgacagaacaagactccatctccaaaaaaaaaaacaaacaaaaaagaaaaacaaaaagaggagtccataaatgcatgtataaaaggaaaatggaagtttcacaaaacgtgctccttttaatacaggtgattggccgggcacaatggctcacgcctataatcccagcactttgggaggctgagatgagaggatcacttgagcttaggaattcaggaccagcctggccaacatagtgagatcccatctgtattaaaaataataataataataataataagccaggtgtggtttccagctactcaggaggctgagaagagagtattagtcacttgagcccaggaggtagaggctgcagtgagccctgatcgtaccaccacactccagcttgagcaacagagcaagaccctatctcaaaaaaaaaaaaaaaaagataaatacaagtgatatactgggagacctgatattttgtatctttcatgacttttacactggatctgtcccactgactggatccaggaccccctattaactttgctgacccctcaggtcccctccatcaggttttccctgtgcagttgtctctgagaggcccaaggccggatggccacacaggccaggctggggtcgtccatgccaagcagtcccatgggcctctcgcctcaccacaccttgcctgtttgctctgcaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacgctcacagcctctgtgtcatctctgagtgcttgatcgggaagctggggggacagggcagggcccagatgggcacaccctgcacctgatgactcactggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtcccccactctaaagggagagtcctaggactccttagaggaggcttcactgcggagatccctgagcagaagggggcggggtagcttctcccggtgacggtgacgcaggtctggctggccttgggcaaccaacacacctctcccactccaagatgcctccaggtggctgaggccaacgcccacacccaggccagtcgtgtgcttgtacagcaggctgtgcctggggacctagatgtgccatgggagggaggagggtacccactgacaggcctctgcctccctcctcaagccctctgttctccctgcccccactctggacactgcttagtccccagccaggcagggcccctgggtttccacttgcagcccccggactgccccagagccgggaagcaccagtgccaacagctctggacttgttggacccacaggcacagagctctgagtggtgcccaggagacccaggaaccttccctagtgccaaatgcctgcagggaccggtgcctggggagcctctggcagccggactgcaggagccaccccatcagcccaagtccacctctgttttgttcacctcggtcatgttttggaccttgcaccaggtgctgggacgtggcagaggacaggccctgggaaccaacagtgtcctaccatggacagccagggccagctaagctaagccatcccgcccaacacagaagacatggcagttatttctcagcagcaccacgctgggtgaggccagttgttccgcttactctgctccgaactgtaaccccaggctcagaagcagccggcaaaagggggatgctggccacgccccacctctaaggccatcaccctggaggtggaagtcactgggctggagggctctccatgtcccccagcagccgccctcagaacacagtggccagagcaccaggctgggtccaggcctccaatccaggccttccctgtccctagaactggggctggaggagtgggtgctcagcccttcctgccctccatccccagcctgcctttctcttcctttggatgctccatcctccttggtttcttgcactgctctcaatcctcccaccctagcctgggggtggtccttggtcctcaggggtatccggggagaaattctctccctgtgcatgacacctgtcatccatgtcgtaaccagcggctccatcttgtggggtggtgactgagggtgacaaatgagatttggctccgtcgtggatgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctggcagagcaccacttcctggcagtgcagctccgaggcaccactactgtcctccccttccctccccacccctcccctccctttccctcctctcccctcccctccacacctgccctgttactcccacagctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccaccccatattaactgtaattttgtaagaagagtgacttgttggtttaataaatctctagttattgtaataatttattggctgccataatgtatttattagtcgcctaccgttaataaaaagtgcccgctttcctagcgtgagtgtgatgtgttgtcagggcccagggagctcctgccaggtgcacttgcacgatgtgtgtcctcgggccctgccccatcctggtcccaggactgctggcagcctggcagagtgggcacactcctgctggggacagaggatcagggcgactgggcgccctgcccccctgtcaggatcgccatctggtgggaagttgctccgttctgcgccgagccaccttcctgtcctggagagcttggtggccacctggacactgctgtgggtgacgtggcagtggccatggttgcgctggcactgcttcctgctgctcctgggcctccactgcagcctggggcaggtggaggtctagggggttggctgtcagccatctatgatctctgacttctttctcttttctcaaatggtggtatctcttctttgaatgtaccccggcgtctgcttcctctggggagcttgtaaggatgagctgtgctctcagctccttggcaatgggttccaggcagcgtgccgagggagggcagtcaggcctggggggctggcaggggtctcagtgccggcgcctcccctgccctgcaggatctcccctcctcactgccctccccgagtctccaggatcagccgccttttggggctccctccaaggccctctccccataaaaccaggtttggttatgcctgtcctctgctccccaagtcctcccctgcactgccactcctgggaccacagactgtgatcatctttctccagctggactctgagctctcggagagcaggagcctgatgtggtcattcttacatcctcggggcagcccagcagagagccctgcacacagatgccaggcagtactgactggaggagcgagtgtggtgtgagtcgtgctctgtggccctgagatgtaggggctgtggcgggggctcagccttaaccagtggaactgtggagcctaaatgagccggacttgatttctcctccacacctaagctcagtggccaagggggcacagtccccactcccagctcaggtcactctagtggctgctcctggcagtgcctgggaagatgtgcagtggaggagggagcttggctctggctgtgggtttccagctctctgttaggcagctgcaggccaaggtggctctgtggagtggggagcatgttcctgtggaatccttggggtctcagagcctcaccactctggcctcataatgtggctcaatgagcttgagtgtggacagcccgaggccctggacacaggttcactgggcctcccagaagcctccggctgcccttttctgaacagatcccagtgaggtggctcagggcaagcgagacctgctcctccccggagggatcacacagatgacagggaaatgctcctggggaatcagaatgaaatttactgattgaggataggagagtgatgagatcatatgagtttactgaatctgtttagcagaatgaaagggcagtgccgtgtactacagctcctggggggtggggaataacgccatgccagctgtccaggtgcccctgagaggcagctgagaacgctgccctccgccgaccaacttcagctaataggaaccaggggctggggctggccgcctctacaggtcatggtagaatgatgtaggcacgggggagatactgaagggaggactggccgtaagacgcacggagcccgccatgctgctgttagtatcgattcctcgaaagccccacagcctgctgatatggactggagagacccattgcataagttctggatctggcccagctgtgtcaccgcggtgtcccctcaggccagatgaggttaagtgacatgggcagggagagcgctggcacagtgtgggcctcagtgactggtgtggtcacttcatcttcattgccctccttctgctcagaggggggcggtgtggcagtgggaccagcaattcctcagcacccacggtgtgctcacccctgggggaggaggtcatctccccgtagatgcccagtggcatctacaccagctgtcttctttttcttgttacttgtgtcactcttcttatttcagaggtagagtttagcctggttcacctctgggctttagatccagagagctgggtttacagtgagcaagttcccagggctaggacagggttcttggggaaaataagggaaactgtcccttcctcccactccctgtgcagaaatggattcgttcacagagaaagatgccctctgtgctgctgagagacagactctgcccaagtgaatgagctcagcgccccaaagcagagtttttgcccagggcaagaggctgcccccgttcggcatctgtggggcgcccatcacgttcatccatttgctaaacaggctcctgtgtgcagggcagccctccacatctgccttgcttagaacatcatgcagtgtcagatgcagctgagtaggacccagccagaggaggtgtggccagtcccccaggtgctcctggaggtggccctgccaggagcctctcccctgagtggtggcacccaggatgctggcaggacctggcatgccttcccctgagaccataggaagggcccggagtctctcaccactcccagagaacatccccctacccaggatgggcccaggaggagaggtctaggcaggaagggccaaagcccagctctccggctccggtccagactcccccaacgcccacacacacaggcacacacacaggcacgcacacacactcaagcacatggatgcacacaggcatgcacacacaggtgcacacacataggcacacatgcacacgaacacacacaggcacacataacaggtgcatgcacacacacacaggcacatgcacacagccacacacacgtgtgctgggagaccctcacatagctgggaactctgcagtggggagagcccgggtcaccctgtcctcagcctccccagagagccatggctggtgtccagtccagtctctgcctctggccccgacatgacgggttctccggaagcagggaatgagatgtgctgtgaggtgtaactgactcaggttccatctggcagcctctcggaggagctgccgagtagcccagtccctctctgtcaagcctaattctctccttctctttccctgtctctgtgtctccctcccgctgtctgtcctctctcctcccttcctgcggccgcagaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggtgggtgccaggcagtcctgtgcagggggaagcctgcccctgacagggacccatggctcagagaacaggctgctcggccagcactgctggggctagctggcgagcgggacccattgcaggagactggtggggcgcaaaagaaaaacagtgctgtgccaccaggtttgggcttcccaggacacagccctcagcgtggtggaaatggcccctcctaagatatatgtgttaggaccaagtgactcaggagtggtggggagcagggggcaggacaggatcacaggcttcccccttcctcctggtcaccctctagaagaggtctcaggacagcctcctgtaatctcagcagtggcctcccctcacccctgcccagagccccacagcacctttgcatgaaaccgaaaagtggacacgtggcctgtgaacagggcctggactgcctcttggccccacctgctttccctgctccctgctttggtgcccggaacatgcttcatctctgtgcagccgcccagccagaccactccacccatcccacatcgtgcctgccctccctccccaaccccagccccattgcgcctcctctctccccttcttccttcgtccctggtctttgccccaaatccaaccactccagctatctgcaagcctcctgtatcactgcctccctttcttctgccttctctggggctttcttcttgctctcaggggaatgtgtcacagaccttcccccccacccggctcaatgacgctctttccaaatggatggatgagggatggtggcttccgtggaatgggccaactctgggctactgctaatgcctaaaagcagcactgatgggatgccagagcccagccctggtccctctaggggctgggaagcttctaggggtccctggggtaggagttgcctttgcagactacagagtgcacagggccagcaccctgccatggaggaggaggtgtcctgtcatccgccaggtcagggcacaggttggctcggccaggaacccatgttctgacagccctggagtaaggctttgggcatgggctcagtctcagggccacacgggtccccaagctcagccacagggtgcctacatccagcataggtcgatgctggtctccccacccttccccacagctgggagcagtgtgtgaagaagggctgtcagcttgttctgagcacaaaccgtgtcctcactgatggtccgtgctaatgtgaatttgcaaggttcttgcccttcccaaggtgcagagcaggaggtggggccaggaactgtgccctgcactcgaggctctccagcaaagtcccaatagggcagagagcccaggtagcctctggagccagaccacctgcagctcagcaagttgctcagtcatctgtgcctcattctaatctggtcaacacaatgggtaatcatgcccaccccaagggtgactggaaggacagctgcttggtgccaggtctactgaagtgctggctgtggctgccattggtattattcagaggatggaaactaggggagggggaactggccacggagaaggtgccctctgcaggatggagtgagggcaggagggcacaggacaagccctgaaaggccagccccaggtggcccttgggcagagccaggctgtagcccactctggcagccactcctgacctctcccagccacaacgatggagtccagtaggccccctcaggccagggctaccctcagagacaggcccaaccctacggctctttcttgcccagtgtcccactggggcctgacttgggagtggccagtctcactgctgtggagtgcaagcactagatgccccagcgaagggcagttggaacctgagaaacaagttctccagggccttcagaggaatccagtttgaattcaggtatcatggatgacagatggtcaccagtgcagtggccccatggagtgcaaacctgtgagggcacaaaacaagcagcaggggtgggacgggaggtggccggctgtctaagggacgtgtgggccagcatggctgggtggcagcagggctgtgtgaggacgctgggctcggcagacacagcgaaggcacgaggcgctcctcccacctggacggcttcctgtggccaccttccaccctgggctgtgcccagttcggctctctccagacaggaagctcctgggcagggtccacacgggctgctttgtccaatccttaacagctgtgctgtgggcttggcatctctgcaccagtggatcaaggatgaggctttgcactgtgggtccaggcactcctgctgggctgcccagagctggtctcagccatgacaacccacccaaggctgtcccaaccccctgccccttgccccttgtacacccaaggaattggtggggacagagggcccccagttggcatcatacatgctgatgtccccttaaacttcccaccttggggacatcaatgccccaatgtcctggccactcgcttaagaaccacgcctactaatgatatgctgccagccctgccaagtggcctcttcttaaaggaaaccaatgaggaaggagtgcaggtccctctgagtgcccaccaccctcttgggcaggcccctctccagactttgttttcatggtttactggaatcagcaggattggtttagaccatggggcggtgcctcaatttgctcatctaggaagcaaaagcgttcatctgtggccactgctgtcccaggcggggcttccgggtggatctggtgtgaaaacagtaagagatcttgcaaagtccaaagccaggcaaatgctcagcctgtgtatggttggtgcaaaagtaattgcagtaattgcagttttgctatcaaaagtaatggcaaggccaggcgtggtggctcacgtctgtaatcccagcactttgggaggccgaggcaggtggatcacctgaggtcaggagttcgagaccaacctggccaacatggtgaaaccccgtctctactaaaaatacaaaaattagctgggcgtggtggcacgcgcctgtattaccagctactcaggaggctgaggcaggagaatcgcttgaacctgggaggcagaggttgcagtgagctgagatcgtgccattgcactccagcctgggcaataagagcaaaactctgtctcaaaaaaatagttctttaatttaaaatgcaactatggcttggaactgcccagcagttcctactgctcccttcctgtctcatcccacttcctgggacacgccacaacccacttcttgtcttcatgtccccagccctgtccacccacagcgctcatcagggcctctccccgttcttctgtgtcttgttacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactcacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggcttcaatggggttcctgacccctcgtgctgctgccccatctcgcccaaccccagcagtagtcaaaatgttctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgtactcctgagtctcaccctgtgccttccaacgatggttatttggggtgggcttcattctggcaggagagggaaggagggactcggccacacacgctggtaggccggtggttaggagtcccccacaggaccttcccatcccctcagtgccgtcactggagccccagctcagagcacagttgacgcgaccactgcccagtgctgcctgggaatgagggcaggggagccgccactttctcctgcgatgccctctcctcccggctcccggtgcctcctcaccctcagtaggttttgtttgcttttgagaaatgaggtggaagtggggattaggaaggaagaaatgcaagaagggcaggcaagccccctctcctatcatgcaggatcctctttcttctgtagccggcggttcccccacagtgggaggatgggtggtcccaagaatgaggccaattgcctgagcccatctgcacccaagagttcccagccactcacatgcccaggacgagcttgggcccagcctgaccaggaaggctgccttcgatttgctccctgactgcacctggatgccaggaagccccctgcaggccgaacacgcaggaggtaacccagcagtgcagtggggcacacggagtctgatccctgttcctcccctagactgtaggtctcacccgtcccctacattggcccgcttttgctgtaataattagcaaatgggttgcaacggggacctggaggcaacggcagcccactgaacttgcatcatgtccacacgccacttcctgtacaagcggccaagagcatcatgtatcatgctgtcttcagtgagatgggggagctgccaagaggtcagttacctggaatcctctccacatctcaacaaatgggaattagaggctcagaagggcctctctcgggcaagttccagcagtcttttgaatcaagggggtggaggcaggggatattgtttcagagactatggaagaacaagaggcactgtgataaatacccaaccaatacaggcaccccttaaacctcttctgctttccccctggttccccaaaccccaacttatctgcagagaggggcacatgacctaccctctccattgaggggaaggtttgcaatccaggccacagtttgactttgtaacaaaccaagatccacatggaaggctgaaggaaaccatgacattttctatatatggcacatttgaatttttctgaaaaccaagccatattctaatagggttcttcccaactttcaaatgagttttgcaataaaaccaacagaagtttatttgcctcatttttcttagaagggaggtcatagcattttttggaaaggatgcagcaaaaaggccaattaaatcggaacaaggagagtgggggcagaacctatctgatatatatatttttaaagatcctttttcccccctagtttatctgtgcacacaattgtaaaaagctagttctaattagaaccaaatcaaataggagatttacttccaatggcacctaaatagcttctaaaagaaattctgagaaaattgcctctattcaggaggtaaacaaaaggtatccatcatcaccacctgtggaatccctccaggtctttgatctctgccctgaaactctactgagaaagtctcagagtcgctgtgaacctcttctggctctgggggctgccagattcctgaaccattctttgcccagttagaccacccaatgaagaggggctccaaaatgcacttttgttgcctagctggcagttgcttaaggcaataagacaggtaattaaa

SEQ ID NO: 13808 - DNA, 29954 bp, Human
gggcaaggtccctcccaagagggtcctttaaaactgactctggaaagtcagagcacacacccaccagacaagcctgaacttgtctgaagcccactgagacccaagccgcagagacttttctagctgtgatgatcaagacataatcgtgacctccaatgccccccacaagtatattgctcctgattctttcagcccctgaccttacttctcaaactgttccctgctgacccccagtcctatctgcccccttcctaggctggtccttactgacccctccagctccatcccctcaccctgtgccccacctttttcagatagaaaaaactttcttctccagtgcctcttgctgtttttcatctctgggccattgtcaatgttccctaaaacattccccatattccccacccagcactccacctctttagctcttcaggtctcagctcagaagtcacttcttccaggaagccttccttgattgtctttactagtttaggggctgaagtcaggcgttcccaacagcctgctggagttccccatcacagcttatctctcaactgtctttcctgagagagggagaagacattcctcagagacggttgtcacagggagaacttcaaaattgggattcgacctgagaggccacatggattcttggcttggcgcaggaaaggattcaagagtgagtggggaattcgtggaactgagggctcctcccctttttagaccatatagggtaaacctccccacattgccatggcatttataaactgccatggcactggtgggtgcttcctttaacatgctaatgcattataattagcgtaaaatgagcagtgaggatgaccagaggtcgctttctttgccatcttggttttggctggcttcttcactgcatactgttttatcagtggggtctttgtgacctctatcgtattaaaccagtcttgcccaatttctatctcatcctgtgaccgagaatgcggaccctcctgggagtgcagcccagcaggtctcagcctcattttacccagccccctgttcaagatggagtcgctctggttccaacgtctctaacgcggggcccctgactgctctatttcccaaggtgtatctagcatctcgcactatacgaggccaagttaaggcttacacatttgcagaaggaaagaggtaaggaagcaacctgggaccttccactgtctctgtttccatctctctctttccatctctgttcatcccagaatctctctgtccctatccctaaatatcgaaaatttctgtctctgaccatctatcattgtggctgatcatctgtttctgaccattccttcccgttcctgaccccagggagtgcagggtgtcctagccaagccggcgtccctcctagtagtaccgctgctctctaacctcaggacgtcaagggcctagagcgacagatgtttcccagcagggggttctgaggctgtgcgcccagatcgcgagagaggcaagtggggtgacgaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtggtgagttgctgcgctggcctcaaggaaccacgtttagacaaacttcggaggcaaaggatgggggtgtctctccccctgtcctcggcggtgggcacacagcgtgggggaggggcttcggtaaacagcttggggggtctttggcaagctattggagtgatctcttgcaaacggtgggggatcttttgtaagcaaagaaaacctttgataaacaatttggcaaccttcagcatacagcagtggggcgaaaaacaagccagagagtgggagaggggtgacctggcaaactactggaaagggactcttatgtaaatagcggggacatcctctagtatctgggacatttggcgggggggggggcggtctttgtaaacaacttttggacacatctgggcagttgctaagggctcttgccaagcgtctaggtaagcctttggcaaacagctacaggggtcgtttttgctaatgtaggactttgggaacggtgctctggcacacaatttgggtaaacttatgcgcgcataaggatgggagggagcttggtcaaagcggggcttggcaaatttctaggaaccttcggcacagatccggagagggacctttaaacaaacagctcgagggggccatttgggaagtgattggggcaggagggaagcagagagcgcatcttttttctcctggcttaatggacaaattggtcaagggctgggcctcggaaagtttcctcgaacttctccaaagggtcggagaaaagaaggagagagctggcccggcaggagggaggaggagtggggcaggcgctggagggcccggcgcgtggggcgggggcggactgcgctccgctcgggtcggagagcggccagagagccctccttcctggctgggctcccaaaccgcggttcagatgttgtcttgtgagcgtgcgcgcgcctggctggaggggcactgagcctggccgcagtgttgcgtaagtagggcctgaggagagaggcaggccagggacccatcaagatgtcctttccagtccaggggatatctgcccccttgttgcttcagccaccctgccctccagcctccccctcaacctgtccgggagaagacgcccatgccctctggtcaccctaggaactccttcaggaggtgacaactaccctctcccaactctcacccttccaaacagctaggtctcagccccctctggatagatgggttgggaaacctccatacatttttagagggctacttttttcaaggatctggagctggctggcataatgatgtggctgttgggtgggggtgagagtggagctttgggacaatgacaaagctacttggtttcctacaccttttccagccaatgggtcacaggatgaacccctaaattggggttcagcctgggggccacatgggttcttggcttgcacaggaaggaattcaagagcgagccaacagagtaaagtgaaaacaaatttattaagaaggtaaaggaataaaagggtgattattccatagacagagcagggaatgggctgctggactgagtatacatatggttatttcttgattatatgctaaacaaggggtggattatttaagagttttccagaaaaagggtggggagttcctggaaccgagggtttctctcccttttagaccacatagggtaacttctcaatgttgctatggcatttataaactgtcacagcgctggtgggagtgtctaatgtatttaacatgctaatacattataattagcatataatgagcagtgaggacgactagaggtcactttcattgcagtcttggtttgggtgggctttctccagcttctttactgcatcctgttttatcataggggtctttgtgacccgacctgtatatggtgaaatcagtcctaccaacctcctgtctcattctgtgactaagaatgcatgcctgccctcctgggaatgaagcacagcaggtctcagcctcatcttacccagccccccactcaagatggaggtgcctggtttgaacacctctgacaaatggaagtctgtgttgtccagaggcaatgcagtgggggcttaagaagataactctggacttagaccgcttggcttcaaatcaaagagtgcatgaaccaaccagctggcctagtgatgatgttaggcaagtgacttctcagtttcttcatctgcaaactgggaaatttcctatctcagggttaaaagagaggtaatcttaggtgcttacctagcacatggtaagtactcaataagcactagccattattctattatattattattattgttatgtcctccatttcccctttcctaactacttccaacaaggctaggaccgttgtcagaagatctcctggctcctttcaacattctaacacagtacttatcacatacttcattttgttttatttgggatctatcagcctccctgctaggatttgaaccttagagacagaattgtctatctttttcacctgtttttcctcagcagtagcactgggcttggtacatggtaggtattaaaaagtatttgttgaataaataaatgagtcggttgctccctgaacctctgcagggacctgctcagtttgggcctcagtttgggcagggccagttgtatgactcatgaaggacaggactactttctttttgcaaatggctgattcaggatttaaacccaggtctgtctactgccagagcccatgcacatagtccttgaatctctttagaagaaaacaggaggaaaaaagtccccaagtcaccagccgcaaggtagataaatgagttgatagaggtaaaggaaggatgctggagtataatgattccatatcacagcctctggagccagattgctttgtcccaaatccagatctaccatttgtgaactgtgtgatcgtaagcaagtttcttaacctctctgtgcttcagtttcctcctctgtataatagggttagtatatctacattacagagttttgagcattaaatgagttaacatattctgactttagtgcctggacatatagtcagcacccagcaccaacaagtggtagccatgctctctatagctgtatgtcctgtcgctcaactaatgggtgaccgtgctggtttgggaacccagtactccacccagtgctctgggacccctggcttatatcctgtctggactatggcactgggttggggggctgattgctacagcctgctttggtcagtactgtgccatcctaatgtggctaattgccttgggggtgtgcatttctttcagcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggtgccggggcagggcttggggaggcagggccatggggctgagggacacgagtctccttgacccatgcattctctccactcaggggatccatgaggtgtcttttgtgaaggcttgacatcttagggagtttcaatacacagttcttagaaaatgaagtcagacagacttgagtttcatacttgctagccatgagacattgggttacttttcagtgctgtgaatgttggctttccaatctacaaaatggggcttaaaaaatgcccttatatggtatgttggggaactaagctaggctgaactaatacaaacggcttctatgatttttgacacagagcaagagtgtagtaatgctagtcattgttattgtttttagatgaggtcattgggatgggcagaaggaacgtgatgattggtagctaattgggtttagcagcccaattgggttataactggttgctaattgggccaagagctgtgctctgtatgggtggtgctgggttccaatggtgggatctttgccctgtgccccataatgcactacttatggccctcccccaccagccagaagtgacagatggaactcctgagctggggcctaaaaatgttggctggcctgggactccctgggtcttcaaggcattctgggagggttgtccttggcagtgagccctgcccagcctacacacacatacacgcaggcacatgctcacatatacatacacatacctgtgcacccttcccgtgcttgtgcatatacttgtatgttcacatacacacacacactcaaactttttcatacatctgtgcacacacacatacttgcatatacatacacttatgcacatgcatacacactcacatgcagttctaccacctccaggatcattggctacacacctgatctggacccagagacagtggatgatgcctttgctcgtgccttccaagtctggagcgatgtgaccccactgcggttttctcgaatccatgatggagaggcagacatcatgatcaactttggccgctggggtaggcagaagatggggcagaagaggggccagcagggatcagtgttgagacgagggggtgagatggacattagaggggcgtggggatcctaagggcggcttagataggacagtagatggtgtgggccctgggggtggtttagatgggggcagcacaacacggagtggacactggagagccacgttgacatgggggcagatggtgtgttgtggtataacctggaggccgtctaaacccgaagcaagtggtctactgtgctgtccaatatggcagccattaggcagaatatacatggctgtttaaatttaaattagttaaaaattttaaattagtttcctggtcacactgggcacattttaagtgctcaaaagacacaggaggctagtgactattgattttggacagcacagacaaagaatattcctcttaatcacagaaagctctgttggatgatgctggtagacactgaggaactgtagatatatgagagtggtttggaaacagtggagcagtgtagacactagaggaagggtcgtagaacctggggccaggtggccatgtgagtttatggtgtgaacactgccagtagcacagacataaaggtatgtggtatagacactgagtggtaagtgatgaaggtaaagagcaggggaaacaatgtagacaagtgggtgggtggtacaggccttggtgacaaggtgggcatgaggattcatgttgcagatattggtgatagtgtgacatgaaggcaggattgtggttaagagggcagtattgacaggatggaggatggcatagacactggggatgatgaagatggggtgaggacactagtgtggtaatgtgggtatgtggtacatatagtgtcatggtggtagagtagacaatggaggtagagggtatggatactgggagtcatgtaaacctgggagagcagtgtagaccataggatggtaacaaccaggtcagcagatctctactgagctcctgttgacagtcctggataaccccactgggacaagggaaggggacagatgctgggtgggctgacaggctccacatgtagatggggtgtggaggggtttcagggtctaggtggcacagctagacgctaagacccagtgtgtgtttcagagcatggcgatggatacccctttgacggtaaggacggactcctggctcatgccttcgccccaggcactggtgttgggggagactcccattttgatgacgatgagctatggaccttgggagaaggccaaggtgagaaaggggccctctgcatgccccagaccttctctcctgtcctctctccactccatttgcttggaccagagaggtgggaggggaggaaagtcacacatctgggtgagtcagaatcttggtctccaaagaaggcctggagaagtccaacctcccccttccatgtcactctttagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaaggtgagcatccactctagtccccaagactttccaccccaagcctccagcttcccgggctccccagtgtgctcttccctccacactctccaggactggctgccactgccagttaatgagcatccctccaacgtccttcactcagttcccccccatcctgatctgagccattgctgtttctctcccaccagtaccatgatgaacgtagtactctaattaaatcaagttgattttttttaagtttcaccattagcaatcatttaggaagtcacagatttgatttgctaattatttatttctaatatatattggagtgaacttagaactattacaatgcccagtggttctctctagaaccagtctttacacttcaatcaagattgatacttcaagggcatgaggaaaggcttgctggtagctggaaacctagcagtgtgatagggaggcaggactcagaccagggctggactcaacctggtttgcgtactccaactgaggaatttcagctattgctcctgccttggtcctgatgctgcctctgctaatgcgtgtgtgtgtgtgtgtgtgtgtgcctgtgtgtgtgtgtgtgtgtgtgtgtgtgtgtgtgtgtgtgtgtctgggcacgggggctatactatctgcctctcttgggcactgtctttttctgcctcctgtctagcttgtgtctgcatctctgtgtcttgataaagactttaggcttgactcagtatttgtgtttgtgtgcttgtcagtgcctgagatgcaacatttcagagattttgaagccacatgggggaaatcttttaaaatggggtacagatattgacatacacactcaatcctttttaaaaatatccttgacacacttaatagtcataaatcacaaaaagacaatgtaacttcatactctatgaagtcatcatatttgataattctgcagattgaaagcccagaaaacctggcgaaaatggaaaaaagtctaaaaatttttaacactatcttctttcccatgtcacaaagactctatagtctacatagactaaagactgtctttttgtctgtaattttatgtctgtgaatctccctaaccccactgtaactgaaaactaagcaccaaccatcttgacagaatgaaagaaacaaagagctagttaattcccttcctgtttatgcttttactaccagagctaaactttatattaagtaagagtttaagccattcaccattaataagtcagacattttgaaataaaaatattttttgtatcttgcgtttcccggtagggattacatgtggcgttaacccttccctgtgtcacccctctgataggaacagaaagctttggtgatagttagatgtggaaacagctgtatttcataaatttgggaagggttattccctgcattggacattagccatttactttgtgcttagccagatgcaagtacgcacaacacgcacgtgtctgggtctcgaggcagagattgttgttactcagcccctgctgatggctgagtcagtgtctgattcttgccatccttgtcaggggaatttgggaggagacaggggcttcctgggtggtagaaatgagaggtcagaggcagggggctggcattggtcgaagttaacgctttgcctttctcaactctgaggccactaaggtatctggactcagtcttgccttttctctaggtgccattgtttctggcattgcaggacaaggtcttttggtagagaggggagtggtgaggatacagggcctcgagttctgtggtgggaggccagggactgggctccattccggccatggtggagttaacgggggctggtgaggtcacctctggcgccgttgtgcacagatggtccttgttatggacttgtggttttgctggttggcaattccagagacaccattttttagctttgggtggatgaggggaggatggggagaatccaagacagacaggccaggctctgaaccccactccctcccccaactctccatttatggcccctgtcttgaagatgtcaaagtaggagcccagagtgtttagtaaaagggacctgaaggcaccacctccctctccctccctcctcctcttcattctttctctccttcctacagagactgcaacaaggccatccaggaaggggcctggggttgacaggaggtaaagcaagctttctgtgtatgcgtgtgcacgcacacacacatatatgagagtgacagactaagcaagagagattgagattagtgtgttttgtagtttttagttacaaccttcattcacttctttcatttctgtgaccatgagcagtttgagaaccatctttgtcctagccttgatttctccacctatcaaatggagagagattctcgtggtcctgcctgccatgactgatatattcatgtcatacatcattattacatgaaatttgcatggtacaggtgtggaccaggcagaatggacagtgcccttggggctgaggcagggttctagaagcccttgctgtgtgccaggtgtcaatcattttgttgttgggtggtccacaaggtcccacgggagggattgggataaccagggaagcaggggttctctctgggagctcagagaagcagctccttaccaaccagtagagatgttttcttaatattttaacaatgcatcaacttcactggtgtgaaccggcaggtgggcagccagccagccctgtgcccatggaagcatgtctcattcacatccttccctctctcccccacccttagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccggtgggtgccactccctctccctccctcagggcccagcacctgctgtctgacaaaaaaaaaacccataagactccgagtgcccacctcctttccccaagacaggggtgctaagacatctgtgcgaatgacatccacaccaagatgtccgtgtagctagtcaggatacttgtcacctggtatggcctgggcactgaaatcagaacagacattgggcatcaacagttgaattggtgacacttaaatgtcaggcctgctcaggatcctctgaccgacctgcatcccttttctctcaggctctctggcagagacttctctctcctcctctctgaccctgcaatctctcttccctgcctttcctggtctgtatctccaccttttagtctgttttttattaagagctccgtgctttcctccctgtctccttcctgccctcctctctatccctccctcctttccttcttcccttcctccaacaggaatttactgagcgcctgctttgtgcagcatacacagaggttggtctctgcaaagccctgcccaagggggctcacagctgaggggcatgtgctggtgccatcagcttcatccaactccctttgcccctagcccatctgcccccttccatgggaggctcattagaactctggaatctggcttcctgggtttgaattgcagctctgatacttcctagcagtgttggcttagggaaatttcatcatctctctgatctatttcccatccatgaaacgcggtgctattcagtccctcctgcacaaggctgttgtcaggggtgggtgagatgagtctaaagatacagtgcctgggactgagtctaacttaggtgtggttcattaaggtcagcgtcatgtcattgcttcctggtggtagcctcagactctttgctgcgccttgacccgtatccctaaccccacagccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaaggtacgaggccctggtcattggacagagaccctggacattgcccttgcccctaaacttgctccaaaaaccttcctgagacctcacccacttcaagcatagacactgccccccagacacccacctacccagacccgcccacctgggctgagacaatgcccatctctggtggagccaaggtccctgcttagatcctgcccatccaggtggaggcacagcctccaaaatcagaccctggtagaccagatgctgctactcacctcccgggtaagaactggccttcctgaggggtcactgctcttgtcttccccttcagccaccctccaggcgggcttgtgactaccaaaattggctgaattctgagcacagattaccagagagacaattctcctaagagacattcccactgcacaaagaggtgccttcaaggagctggtaggcagtagaagaaaggaaaaaaggaagagcctcatgcttgatctgacaccatggtccacgcagccctgggggagcccccagagccctctctcccccatcagtcagcaccatctgttaccagggtgtaaatggtgggtcctcgtcagtcctgggtgctgaggatggagctgactgggacagctctctgccccctaggactcacaagctcaggggagagagtgaccaggagacagcttgtgaccttactatgtgctcagtgcagtgagcagggtgcttggggccctgtgcccaatctaggctacagagcccagggttgcagggttgcttaaagctccctgatggcccataatggccaggtcagtgggcaggtccagggcctgtcagaattaggcaagcctgtctttatgttgctttcattctttttaatcatcatgagatggaacttggcagatgtcagtggacagaggctggccaaaggaggttttcttatcccctgctaaattccttgctaggacacagtctgattttaccagcttaaaggtgggattctccaccttcctgagtggttcaagtatccagagctcagtggctcacccagggtgaatattatagtctcctggggctgccatgacaaagtgccacaaactgatggcttgaaacaaaccccatgtattctttcatgcttctggaggctggaagtctaaaatcacggcgtcagtaaggccatgttccctctgaaggatgcgtcactccagtctatgcctctgtcatgacatggatggccttcttccccctctgcttgcctctcctccttttttttttttttgagacggagtcttgctcttgcccagctggagtgcagtggcatgatctcggctcactgcaacctctgcctcctgggttcaagtgattctcctgcctatttccaaataagttcacattcacaggtccctagggttaagacttgggcaaatcttttctggggggacgcatttaaccacaacagggtgtgacacaggttttgctcgctggctgtggctcagcctgtgcaaccacgctaagtgtgaaaggtttttactgctttcacctgggcagaaatggtggcaacatggggccagcctatccccactcttcttacctcttcagagaggctgaggagctgggtttgtagagctcatcttttatagagagacataaaaagccaggaagcaggattttaaaatgaatggggttttaagtagaaaattcgcagatactacttgttctgttcctttatagcacacctgtcctgatactgacttggaaagagacaagaagactttggctgaccccacttggaaacaataggcactaatcccaaaattgtgtattgatcccagaattctcaggaaaagaaaaaaaaaatcaatacatgccgcttccagggttctcagccttactgtggggctgtcctcaaaagtctgcatcactgggtcaggtcttgacttctctctcatctctcttcctgtctttcaaccctctctcctccctgcaaccctcagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggtaaacctccgggcgggggttgggggtggagggtgaggagggggcaggtcatgtagcctgggatggaggcccagggggtgggaccagcaagatctcatccagccaggagtgctggagacgagggcaggaaatgggagtgttgacctggtcttgggaaggcagagcagctctccaaggggatacttggataactcttccctatccgaacaatgctaatatccatgtcactcttagcgctccatttctgggtttctcccattttctaggtgagtaaggtcacctggtgcaaggttacacaggtttgagcaacccagtggagtttagaatccaggagaatagccaagtacaggacagaattttccatcatgtggaatgaccttaacaatacgggggtggaagtttctagttttcataataagctttgatttttagtatgtagtagaaacagaacaaccagtgccttaagccaattatttatttatttatttatttatttatttatttatttatttattgttggttcttacagtgaggctagagtttaaaaagtcagttcatttttaaaaaatatttaatggtccaggtgatatctgagccaggccaaaatagtgaaaatggtgcttgagtgatgaagtttggggactgctagactcaggaaaaagcccaaggtctgccgtgaggggtgctgggttcaaatgtggcctctgcccttcactagctgcaagatattgtgtaagtctttatacctctttggactcagtttcctcatctctaaaataattgcttatcatgaaaagtgccatactgtcagttctggacacaccagcggccccctgaccgccctgactcttgtgggcataagaatctgagctttgggtttgaatccttgggcaagtcactcaacttttctgggcctcagtttcctcacctgtgaaatggtgcaatcatgataccccactcccagggctatagagaggactgatttgggtgatgtcagtaaaaaacatatataaagtacaaagggccccaggactccccaagtccaggcatcttcttgttaccttacggagcttacactaaggccagaaggcgatttcttctgactcttagatggttgggtgggcacccctgggggctcaccctagtggggagaacctctggagctgcagagagtctaaggtcaggtgttctccccaggggcctctcctgacattgaccttggcaccggccccacccccacgctgggccctgtcactcctgagatctgcaaacaggacattgtatttgatggcatcgctcagatccgtggtgagatcttcttcttcaaggaccggtgagtgcaggagcttgcttcttgtcctccttgtctcctgtcctctgctcttataccattattcttttccctcactcttcgctgaagactccaccaaatgcttcccagaatgacctgaattaggcagtttctgctgtgtatcaaacaacctccaggtttcagtggatttgcacccaagcattttgtttgctctctcatagtctgtgggtctactagttatcttgactttcagctacagtttgggttcaggtgtgctctgcctgttgttctcatgggattagcagctactcatggcagatgacagggtgcaagaggccaaactgaactacacaagctcatttaaagcctccactcacatcttgtctgagaatattccactgcctgaaataagtcacatggccaatcccaagacctaccctagagggtagtactgcaaagtcacatggaaatgcatatgaatgcataatcctaaaatcgaaatggagggaagaattgggaaccataattcagtctaccacaggccttctagaatggcgttgccctcaaatggccaaattactctgtgtatgggtggtgagtgactgcagagtagaaagaggtggtattcttcatgctatagataaagatcaccactcagttgactaaagactgaggtttaccctaatgccctagttccctggagaatggcaggcagtatctaggacctcattaaagggtctgtccttccattcttctatcatccatccatctacccatccatccatccatacctatatctttccatccatcatccatccatccagccagccatctattatccattatttatgatccagccatccattattcattattcatccatttattcattcatagagtatagtagttgagaaaatggactctgaagccagattctctgggttagaattctgtaactgctacttactggttatataatcatagacaagttaattaagtatcttctttgtaccttggtttcctcatttataaaatggggctaatattccaacctatctcctagggctgttgtaaggattagatgaacttagtgctgagaacaaaaacaatgcctgacacagagtaagtgtattcatattagctattgttattgacaaataattgtttggcatctactgtgccaaatactttgctaggctttagtagctggaggaggaagaatgatgttctcgggacagtggggtggggggctgctagatcagtgttctcaaagacaggcgcatgggcctcctataacagaaccatctagagtgtgggtattaaaaggtgggttttctgccccagcttcagaccctcctgactggaactctggggctaggccccaggaatctgcgttttagcaaattctcccagtgattctgatgcacattaaagtttgtgcatcacaagtccagtttgagaaataggcatggagaactgacatggcaagatgaaagaaaagtgatcgcagaggtgttaggtgcttttgtgagcacgtcccagtcaaggaaggcttcacagatgcagcagcatttgagcagagccttcaaaggagaagcaagaatctgatgggggtgacaagttaggaggttctttgagacagagggacctgcagagccaagccatagtgatgtgaaagtttctggattagccagtgagaatctggtgaggctagaagatgttccataaactttcaggaagagtttcctctactctaggcactgggccaaattctggggtgcagatgccttgcccttcacagggtctgctggccaatggggaaatggcaagaatgcaatgagagatgagacttagaatgtagtgagaaatcaggtcccgtcaggcctcgaatgcccaaatcaggatatataacagcagatgtcagcactgctctgcagttcccattgtaaggatctggcaatgtgcttcatctggagctcctcccactaagaaagccctgaccacacatgcagatctcagatgtgtggggcctaggaaaggatgcagagcccagacccaggctggagccatccctggcctaccacatcacagttttctttcaaaaggaacgtgatgagtgtttaatgggtttatttgattaaccagtaaatattaaacttcaaccatgagcaaaaattgctgctaggcactggtgagggtgggggtcatgaaggacagtattgcaggatgattaaactcagactttggagtcagatctggatatgaatcttggtaataactaatttatttagtcattgatgtagtgataactaagtaatttgaatcctaacctctctgagcttcatttgctaaataaaaattgtgacaccttcctacgctaggatgtttttctgcaaataacagagaccatccctctgcaaactcaatccagcctaaacagtagagagaaattgctttcatttggtacaaagtccaggggtagagctgcctgcaggggcagagagagggtcagtgacttgatgtctttgtccactgctagcctctgcacttacttcatcctaaggccggttctacctcatggtcacaagaaggttaccagtggcagttggggctctaatccctgccctctcccaggaagcgagagagaaagagacacgcacagatacacacacacagacccccagatgtgaaatacaagtctgtgtgttccgtctttacaccactgtaagtcatatggcaactgctgaatcagtaacagtgctagggaatgctaaactctgattggcttagaccagtagttctcaaaccttggcatgcgttagaatcatctggaaggcttgttaaaacacagattctgggccccaagcccagagattcttatctgtagatctctgtaaggacccaatcatttgcatttctaatgagttctcaggtgacgcagatgctgctggtcaggagactgcactttgagaaccagtggcttataccaatcagtatctacccctagaatgggggtaggggacacagggtcagaggaggtgaaggctggatcataaatgtggagttttgtgaagaaggatggtggggaaatagataattaatgctaggtagaccatccagagtgcatgctgtcttaaaagattgtggggattaaattacaaggcacataaataaagcacatggcatttagtaggaccctcaataaatgataactcttactcttgacaaagtacacaaattcatttcattttaattcaggaaatacttgagtgtcatcagctcctgccccaattggcctctaatcaaataggagagttaagacaaacagacactactgttccaggcactcagagttgatgattttgagaggcttagagagggaaaacacaatatggatggaggtagtcagggaaggcttcctggaggaggtagagggagagaacagggtaggaggatgtttctcagctccagcagattgcagacaggaactctgcccgttctccagtccttctccaaccttcctttgatcctgcctcccactcccatcatggaatcatctctgggatgtttctgggtgggtttgggggggtgtgtggttcgagctgcagggtgactgaagatgtggtttcctgtgcccccttgcctcctgccaggttcatttggcggactgtgacgccacgtgacaagcccatggggcccctgctggtggccacattctggcctgagctcccggaaaagattgatgcggtatacgaggccccacaggaggagaaggctgtgttctttgcaggtgtgtgggaagcacccttccttggccctcagctccacagggctctgcaccagggctcctgggtgtcccaggctcactccccctctcaaaccacagttcctatgcacccgtgggtgctccctttcctttatggattcattctttcaacattatttcctgaagtgcgcagctcctctgggagattggttccgacacccaacatcagatagcattaaccctcagtgtacacatttcattttcttaattcttttcaatccgtctcatttcttttctagaagaaaaaaaagtctcagtttagtgctggtgtgtccctaacgcctttgtagtgatacagtctttggcaggtaacagttttagttcgaatgttttaaagaatatttgttttcatttttacttttagacataaattggttttaacagaggcagttagttataatagtgtggagtttcaaatcaggacagaaacggattattcagtaactgatattttgacagtcaaaaaacattttttaataaatttatttttaaagatttcaaaatgaattcactgaaagcagaatgttaagtaaataatagtacagggagcccctagaagtggtagaaatcatcaaggtgaggtctgtatggctaaggtttactcatttaacatttattggagcatttccatgcgctgggctttgccataccctggggatacaagctctgccttcgcgatgctcacaaaccactcagggagacagacagctgggctcttatgaggggtaaagaaggatttaggaggtccctgtcctggtctgaggtgggatcctagagaagataaaggctcagccaagactgttgtctccaccacctggctcccacctcccccaatccaccgtaatcatgggtcccggagaggacaactgctggctcctagggcacctttttgcaaattagcaaaaggtgcctctttatgacagcaaggcccttagagtgcacgacttggtgagcagagtgtgagctggatttatcccccaactcatgtccttgaccaggcaccttctgtaattgacttctaaagccctctgtgtgagccctgattctgggcactgcaaccaggagtgagcaggaagttgcactctgttgggaatggctgcagtggggcccgtggacagacagatgatgggaggaacaggctggcctagggcatgtcagcaccagccaacacaccctttgcttccaccccagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggaggtaagggagggcggtgggtaggacagcagcacagttggctgcgagagacagagaagccgccctgaggcttcaagcctcctgggctgagttcagaggttggtgggctctggatgccctctctctggtatctaacctctttggtctctggcacctctgagatgttgccaaaggtgaaccattcttgtacacattgctgatataattctggtggaatatcctttctctttgcagaattcttttgattggcccatgtctggtctggaccctcacattttgaaatgactcactgaagaagggggtaataaaaataaagataataactgctcctattgacactatgtgtcagagactgtcccaagggttctatgggataggaattattattcctcccattttactgatgaggaaacctgggttcagaaaggttaggtaaccgtggctgggcacagtggctcacgcctgtaatcccagcactttgggaggccaagatgggtggatcacttgagctcaggagttccagatcagcctggccacatggtgaaaccccatctctactaaaaatgcaaaaaaattagctggacatggtggtgcatgcctgcaatcccagctactagggagactgaggcaggggaatcacttaaacctggaagacagaagttgcagtgagctgagatcatgccactgcactccagcctgggcaacagagtgagactccaactcaaaaaaaaaaaaaaaagaaaaaagaaaggttaagtaaccagcttggagtcacatagccaggtagggacaggttgggatttgaaccctggcattctgtctcctgggaaaacatgttagtcttcactcttcactactattctatacccgagatggtggaatgggggttccaagagatgggggaacatgaaggcagtggacaaaatatgaagaagacttagagatgggtgcaccagtcatccatagaagccagcatccaaatcagaccccatggaaggagcaggtgccctgtgtcatgctcacagcaggcccgtggctgtgggtgcaggttggcaggggaacaatttggaagcagatggttctgtgctccaggttatctacaggaaagggtccagttctgaggggctatagtcatgaccagggaacctaatatccaggagtggctggtgagaggtagcccaaacctcaggagtttgactgtaattcttcacactttctagaaaaggaaacggaggtccaaagaaattaaataacttgttcaagctatagagatatgtgtatttgcacaaagccaggattatagctacttctcttgtattctaactgagtaccccctccactatacctgccagtccatttgattagtgaggaaagagtggtcggggcacaaagacttgtggtgtgtctttccatcccctccctcctggtatccccacattccttccatggctgccactgcatctgggccctacccaagaattttagagggcacttcctgaggcctttgtctgccatccccaaaacaatcccgcttacttcctaaggcctctgtcttctcccccttccctcctccccactactctgccccccagctgccctgcattcagaaactctttatatcccaggcctgcccatgtcagggtggaattccagacatattgctaagacacttagcaacctaagctgattgatatctcaagcctcaagaaagaaaacagtcaggcaggaaaccacagagcaggctttccacccaccagctccagacactagccccagacagtgtgcacgcacacgcacacacacacacgcgtactgcgaatggcatctcagcattgtaggagccctgaatctccaagtcttagaattgtggctggtgagccacacagactcacagaaacgtgaatcttagaatcctaaagccctgaagttttcaaattatggtgttggaagaactttttaaatcacttttccatgcactgtatctatgtaaacatgcaaaaacagacctgttcctagcatataggaacatgattgtgtgcgcatgtgcgcatacacacacacacacacacacacacacacacacacacacaggcatggaggttgtggcagtgccttgctggatttccaggcagagttatttgcctcccagtccttttccacacaagcccacctcccaaagccagagccaggacagacagcgtgctctacagaggaaccaccctgagacttcctgaaaagggacagagctgaagggcctatcagaagctctgggctggcttccaaaggagacagatctctattccaagagaagtggtgaatgagcttgtgacactggccctgccgtggagtctgcagaggccccagaggcatctttgctggagaaggagagagagccccagagtgacagaggctgagcagctgtcttcagcatgccaagaagagctcaggccctgcttgtagaagctttcactaagccacaaatatatgttccacatctgctgtgtgccaggcacttagctagctgctggagagacgggggtcaaaaaatcatcacaccctgccctcatgtagtttatagtagaatgagggaaaattatgtaaacacatttgaatcagataatgatggctctcagtatggggcctctaccatagcccagcctgaggctatgcaggtcacctatatttctcagttgaggtagatactgttagctccttttcccaagtgtggaaactgaggctaaagtggctcaaggaaaagctgggacacaaatatctgtgttcttaacacctgctatacatggcaacttctacagctgcagagaagtaccacatcttctgacaccacagtgcttgtattctttctggatgaaaagaacttggaagcaaactaattctcttatctgagactcagtttcctcatctgtaaaatgggcttgacttctgccatccccaccttctgtgggtagaatgagaaagaaatgagggccagttcaagtgtgggacacacatctccaaactatcctaacgctagggaatgtagtttgagggctcagtggaggtgccttggatgggagtgttgggattttgagctagggaacttggttttggtgacccagggcatgaggaagcatgccaggttttgtaagaatgagttttatgctgcacctgggattaaggaaggcgttagttcttcggggtgatggctgagggagaagtccctttgagggagaagtctcctctagaagggagcatatagggaaagctgctgttggggtccagggtggaggtggtcaaggctggctgcagaaaggaagggagccccctaggaggcactgtggagcaaaaggtggctgctaccaggatgggatgcgaacacagattcatctagaaacagctccacttgggcaagacttgtttactaggatatccatagctcccatagtgggagctcagtaaatatttatggaataatgaagtggagaggcaaaggaatcaacatgacagcagcatttaaaaagttctccaaaaatcttaaaagacagaaggattgctagccagggagaagaacatactaaccgatgcccaaagtatttacctgaattaaaggcggggcccaggattgctgccgccggaactgaggtggcatgtggcccaccctgtgactaacaggccttggacttacacgtaccttccaccttgcattgtaacctcactgccccagccatggtcatctcccagggcagggactgtcatctccctgtggcagatgaagaagcagcaatttttccaagccatgaagtgaaagaatgatggggcagattcccatccctgggcttctagtttagcactcctcggattacagcagggatttgtttgtaagggagctaacatttcttaagtacctactaaatatttatgagacatggggatagaggctctgcatgtgctgttttatttaatgcatgcattaaattaaatacactaaattagacacaaccccattttacagctggtaaaactgtagctgtatggaaagtggttaacacactgtttggcatgtagtaagtgctttataaatgttagcagtaatcatgagattgtttttatggggtcatccaaagtcatataattaaaagtggtagatctgaggctcagactcaggtctgattccatgcccttccttccactgcagctggctgcttccctgaagggctaggtccagtttccgaggcctatccaggagccatcagctgggtgctcccatccaggccaggggggaagtgtcctttagagaggccctgctggttcactgtgtctgtttctttacagatacaatgaggtgaagaagaaaatggatcctggctttcccaagctcatcgcagatgcctggaatgccatccccgataacctggatgccgtcgtggacctgcagggcggcggtgagccacccaggactgtctccgctttctaggactccccgcccctagccagggcccagctccttgcaaatacacacttctttattgtgcagggcaggcaggcaggcggcgcccaggaaaacaaatcaactccttcatcctagtgctgggaaggtttccagatccctgacctctgctccttggcctggctccaggcagtaagacccagaaagacttctcacagctgcagggcctggagccagggcaggggagggcggaaggcctgggccaggggagaaggaacatgggctctgtgccgtggattcattctggggtttgatccaggcccatttgcgttttgcaggaggcctgtgaccacctcccattagcagaaggatggctccatttgagacaaggcaaactttgtcatgctctgttgctcatgtggcaaagatcctccactcaaccagtttgcccctggccccctgctgattaaaacacaaccagtagcagcgagggatagaatttggagtttgaaaatcatactcttgaggaggcatctgtgagctttctagggtcctggaaatgggtccagtttggctttttttagaggagatttcaactaaattccacagatttttttttttttgagcacctactgtatgctaagcacaggccctgacctccagtagctgaaggtcttacatgtccaagaaaatgcagtgtacaatcagatgctagattaggagttatcttcaagaataaacatctattgagcacctactacatgctagcatattaatagtaaatgagattatgtatgtcaggagtcacaaactccaacagctccatgtgtcaggcaggtagcacaaatgagtaaagcaggcaggggcagacagtggggaactgtggagtctgtgcggaatcagagcacatgcctcatttacaggagacactttcttctcaccttcagataattattggcgggcaagattaggggcctaggcagctgccatggttcacacctgtcatcccagcactctgggaggccaaggcaggagaactgcttgagcgcaggagtttgagaccagcctgggcaacatagtgagactctatctctacaaaaaaattttaaaaaacattagctacacatgacggcgcatacctgtagtcccagctactggggagggtgagcagagaggatcgcttgagcccaggagtttaaggctgcagtgagccgtgttcatgccgctgcattccagactgggtgacagagtgagacctggtctcaaaaaaaaagaatggggcctggtgttgttagatattctatattagatattctagtttttttaaaggaagccagaaatctgtacttctgtgtgactttttggatgtttacatgttggcaagttattcagatttaaagacaaaacaaaacaaacttgtgagagtcaaataaaacccatctgtgggcctgacaggactggatatatcctgttttgccacctctggtacatggaatgtgcttagtttgatgcttgtgttaagtggagttattgtttttaataatagcatatgttatctgacttaatgctcactgcaagccctagaaggttgataatctttatcctcatcttagagatgagcaaacagggaataaaagagcttatttcacagccatttcccttcttccactcccagagggggctcttctgggcttttgttgtgttttggttttgtttttgttttcttttcttcaatcagctcagattgaaacaattgaatttttttttttttttttttgagacagagtctccctctgtcgcccaggctggagtgcagtggcgcgatcttggctcactgcaagctccgcctactgggttcacaccattctcctgcctcagcctcccgagtagctgggactacaggcgcctaccaccacgcccggctaattttttgtatttttagtagagacgaggtttcaccatgttagccaggatggtcttgatctcctgacttcgtgatctgcccgtctcggcctcccaaagtgctgggattacaggcgtgagccaccgcgccccgccacagttgagtttttttttggcggggggacaaggtcttgctctatcacccaggctagaggcacaatcatagctcactgcagcctcgaactcctgggcttaagcgaccctcccacgtcagcctcctaagtagcttggactacaggaatgtaccactatacccagctaatttaaatatgtttttcgtagaaatgggggtctctctatgctgcccaagctggtctcgaactcctgggctcaagcaatcctcctgcctcagcctttcaaagctctcttctcgtttaaaagcttcttccctatgccaggcagaaattcaaagttcccaggaagcttctgtgtgccagaatgtcaggataagggggtcacggtctcttctttctctatcccaggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaatcttattgatgaagagactgatggctcaagagaagtgatttttccagggtcccatagctattagggacctacaaggccaaaggatagcctagcagaggagctttagctctcaaaccagaatctcaccaccctccgccaccctcaaaaacacccccaccaccttcaaaaccgctcctgctaccctccaccacccccaaaaccacgctgggtaaacacagctaagggagaaatactgtgctttcttctaaacacagctggtattaatggataagctcgttactccttcctaccagtctacccactcctaatctcctacatagaaattctggagctactgctgaacagaaattgaaggcctggggtttttctgaggccctttctggctccgatagtctgattgatagtatatatattgcttctggcctcttatgatggggctggtgaggaaggtgcgtaaggagtgaactctacaggtgacctcctcagtgagcctgatgtcattgtttctatctcttttttctgtttttgagatggagtctcactctgtcacccaggctggagtgcaatggcgcaatctcggctcactgtaacctctgcctcccaggtttaagtgattctcctgcctcagcctcccaagtagctgggattacaggtgcacgccaccatacccagctaatttgttttgtattttggtagagacaggtatcaccgtgttgcccaggctggtctcgaactcctgagatcaggcaatccacccatctcggcctc

SEQ ID NO: 13809 - DNA, 50062 bp, Human
  misc_feature (1)...(50062): n = A,T,C or G
tacacacatttttatttaaccatcacaacaacccatgaactagctattattatttatgttttatagatgaggaactgaatgatagagccaaggtttaaacggggtttgtgttgctccaaggactgtgccagctccagactggtgaccttgggcaagtcacttaacctccgagtctcagatttctcatttataaaatgggcatgatagcagtaattatcacattgtaagagcaactgagataacacttaacatcctgcctgacacacacacacagtaagtgctcaatgattttcagcaatcaaagtccacaatccccatccacaaatttcatagcatatctagcatatgagttggttaatggttctgggcaaaatgttttctcgaatagctcttgaaccacagtgagaggaagttgtcatacctggccccttctttattcctcgaaggtgtgctctcctgggaagcaccatatgctgtatgaaaaattactttacatggttatttgcagaatgtacagcaacagaaagtacaccccatctggtggaaagtgcacagaatctgcagttctgccctgtccaggctgtgtgactacaggaagtcttcaagcctctctgaacttattttcttatctacaaaatgagaaaaatggatggtgtggtggctcacgcccataatcccaccactttgggaggcagaggcaggaggatcatgtgagctcaggtgttcaaggccagcctaggaaatatactgagagccccatctctataaaaaatttaaaaattagccgggcgtggtggcgctcacctgtagtcccagctactcgggaggctgaggccggaggatcgcttgagcccaggaggtcaagggtgcagtgagctgtgattgtgccactacactccagccagggtgacagagagagaccctgccccccaaaaagggggaggggggaataatactttcccccaaaggatactgagatgatgcatacacaacctttagcacactgtccaacacaaagcaagacctacttaaaggatctgtgtaacattataatcagatactatgcttcattttaagtcgaggaccagatagatttataaattacatactgtcaaaattaagtattaaaagtagaggaaaggtaagaggattttgcaaatcaggtacaactacagcttatcctgaaaagccgactgcctagttctgagggaacaagccactcctcaccctcaagcttgaggagagggctgtagaagcccgcccacctccaccgccccgagggctccgcctccagggccgagggacgcaggcgtaagccccgcccactggggggggggggagagagagagagagagagagagagagagannnnnnnnnnnnnnnnnnnnttttttctcattttgtagataagaaaataagttcagagaggcttgaagacttcctgtagtcacacagcctggacagggcagaactgcagattctgtgcactttccaccagatggggtgtactttgtgttgctgtacattctgcaaataaccatgtaaagtaatttttcatacagcatatggtgcttcccaggagagcacaccttcgaggaataaagaaggggccaggtagagcgactgcatagagaggagagagaggagagagagagagagagagagatatatgccctggtcacgtgagcggggtgcggaagtcgtgtttcaggcggcgttcgtgattggccgcggccgagggtcccgggggtggggtcaggccctccgacgcttcgggaggagccgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaagggtgagtgtcggccgagcgctccaccggaggaagaggtggcggtgctgcctgcccgcacctcctaggtcttctcgcagtggggggaggggaggcaagttggagctggggagggggaacagtggagacggcttagtcttgagggccatgaccaagcgtcaagagacgttccctccatccctacctggaccgtgaagccactgtccccagccaagcccctggtggtggggggccctttttggcctgtgtgctgcggtacaatttatttgggggccgaggggctcagcagctctgcaggtggggaaggagacacgcgggtcctggcgcacactggccgtctagtcgagcatgggatcttgcttcgaaggagcgaaaacagcatctgggcaggaaaagggaaatggccctcctgagctttgtagttcgcgttgacgggggtgagctccattgtccattgagtttggagcgcttgtccgcagactggcgagaccacaacaagcccagaggcgtctgagcacgtttgctgggagggaggcgggggcgggggccgttctgggaggctggggagcagggcaccggaagacaattcaatgggggagtttttactgagtaatgtgaggagaggaaagcagtcgttcatactcagtgatgatttggaaggaaaacaaaatgaaacaagccaaaccaaactttcctcagctttctattagcaaccggaattttctcacagtgctaaaggaaatgagtgttgcttgttaactccttgatttcatccaggttgtttgacaggtttctcctatttcttctgcctttcagaatagaaaggactgccttctgttcccttacaagctatcctagctcatctttgattgctcgattgtttctttggagatagagtcttcaactgcactttgtaatatccacttcgtagccattaaacacatgcaagaagatcaattctgatgtaacttttagtttcttattagaaacttgtcagttttctgttttaaatgtcaaacatgaaaaatctgaaaactgcaaagttcccaggtcagtactgatcaccacagaatgtcccttgctttttactagttgctgctagcttcctatttctgtagtggtgcaagctggccgttgtatagtcaagtgttgtagaaaatttaaatggtattttaggtgaaatactttatcgattatgcagtaaaatacatttatactacttcttaatatttccctggaaagttttttttcttcaccttactctaatttagatgggaaaatgctgagttgtaaatttactggtaatatgtgtatccctacctagaaaatgtgatatttattagaaggattgatttaggggttaatttttaaaatagatgttttttccttgattgaaagttcttaatgcttaggttggcaaaggttatctctggcggtagagatcagagatgatcagaaattttttgtttgactttttatggaatttgtcaaaagcctaaattcttctgtcttggcatttttttttcttgatggtatcctatacagtctactaatgcttgctcactgattaaatatcactactttatcggaacattggcttggagggagttttgattgatttttacatcattttagctcctatctttaaggttcttgaaggaaaagagattctcagttccttctgctgtggaaaggtaaagtcacccatgaaggtgtatccagatttttggggagtcatgtacctgtgtttattaaaagtatcaaaaatgcattacacagcatgcaaaaattaaaggtgcctaaattatggcccttagcctaggagcttctggtctaatctgagaaacaaattaccccaaaattaaatagaaatgacaggtggcaaatgaatgagtgttgaagtgaatgctacagataagtgcctcaggagttcagagaaaggtaactccttgggaattgttaggattaggagagcttttggaggcagtagtgtatcttgaattaggttttgaagatgggcagaatttagataatcaggcctgtctctcttacctggatgcttatcagagtctttttaattgttcttcctgcttctggtctcatttcctctttcagctgtcctgggatctattggatcattgctgtccaatagaagtataatgccagccatgtatgtcattttacattttctagtagccgcagtaaaatataaaggaacaggtgaaattaattctaatgtaatctctaatacattcaaaatattcaacatgtgattaaagattattgatgagatattttacttttgtactaagtcttctaaatctgatacatattttacacttactgcacatttaaatttggacattaaattttcatcagaaataattgatctgtatttaaagttcattaaatacattttttttttttgagacagagtcttgttctgttgcccagactggagtgcagtggtgcaatcacggctcactgcaacctctgcctcccaggttcaagcgattcttgcacctcagcctcctgagtagctgggactataggtgtgtaccacctcacctggctaatttttgtatttttaggactatgggcagggcacccgccaccacgcccggctaattttttgtattttttagtagagacggggtttcaccatgttagccaggatggtctcgatctcctgaccttgtgatccacctgtctcggcctcccaaagtgctgtgattacaggcgtgagccaccgcgcccggcctacatactctttaattgttccaaacatacataaaaggtttttgataactgaattgctatcagttaccaagtttacattaattaaaatttaatttctgtcacactagccacatttccagtcagtagttgtatgtggcttccgtgttggacagcacagtgtaagcttttctagagtcctagacaggtgtaccctacttaatattattcagtggctgctgctggcctgcagaataaagtgccaacacttcctgacctcactgatctagcctctgctctcccttagccttagtactccagcagtgccagactcaatacagtgactgtgattgctgtactggatgctcttactctacatgcacccacactgcctgattcacccacgcagctttctggagtcagtgtaagcatctcccttgcctccaggaagtgcttcctttgtcacccctaattattggacctcttcctctgtctctctttcattattagactatgagctctgaggtttgggactgttttttttttttttttcctctgtatttccagcctacaccttgaatatatagtgtaaatgttgaacacatactctttgttgatggtggtgattgtgatggaatggtgcctcatgggtgagaacaccaccagccaaaggcctaagttgggcaatgtgtgttagaaatgatctggaagagcagcccaggtggagtagacagtttagggaagtagtaacagctcacatttaaaggatgcatctccagtgccaggcatacatgtaaagtgctaagtaagcactttatatgaattttcactctgtaaaaacacccatatgatgaatactagccacattttagagatgagaagctgaggaagtgttagaggggttaacttacttgcctagggtcacacagctaataagtggtgtactcaggcttcaaattagaacaacctgatttcacactactgtcaatacttcccagtgcaggtaaaatagggtcaagttatgttggcctaaggagaatctcatcttgaggccattacagatttttaaagcaaggaaatgacatgaaattaggattttaggaatattgatttggtggtagtgttggatgcatcagtgtgaggaaagatgaaaaaggagaccagttagaaagctgttgtaacttatacatgcagtggttagtgcttggaagtttgaagctccttttgggaggttttgacattgtcaatgtcctgttcggaacagaatcccacaacagggattgctcttttatccttatgaagtaggtattattattgtcatcatttcacaaaaaggaaaatgaaacttagtaaaaaacttcaactttataagcttgtacgtagaagggccaggatttatatatttattacaaatatatattatatatataatatggtcattttaaaaattgggattatacgttatatatggttttatcactttttcttttctttttttttttttttttttttttttgggacagagtcttactctgtcgcccaggctggagtgcaatggcgatggcgtgatctcagctcactgcaacctctacctcttgggttcaagcgattctcctgccacaccctcccaagtagctgggactaccaatgtgcgccactatgcctggctaattttgtatttttagtagagatggcatttcaccctgttagccaggctggtcttgaactttgacctcaggtgatccacacaccttggcttcccaaagtgttgggattataggcatgagccaccgcgcctggcctgttttatgacgttttcatctgtatttctttatatccttcagacttctgggtggcagcttttaatgactgcattgtattttgtcatataaatgttcatcctggaagatacattatatttatgatcacactacaattaatgtggtgataagcctacttgtcataggtctgtattgctgcttctgattttcatagcctgtattcctggagcataattgctaattcagagggcaggcacagcaaagcgtttgatgcatactaccacgttgtcctccagaatattcccccttgcccctcaaagtgtttgagggacccaattcccttgattccagtactgggattttcattaaaaaaatctttactaatctccgggtgaaaatatcatatttaaatcttgtagtcttcatctttgtattcagtaaggatgtactcagtgtttgttgagtgaacccattttgattgtttagttctgtagtttttttcctcccttgttggcaagtttttagaattagcctccttttagaatttgcaccttctaatcagacaaaccctgaagaaaaccatgtaactgagcatgtggagacagagtataagtgagccactcctgtggataaaaggtacaaataccatggctctttgctattttattgctgtggaggttttgtgtgtctgatgaggatagttttttgtttgtttgtttgtttgtttttttgagacggagtctcactctgttgcccaggctggagtgcagtggcgcgatctcggctcactgcaagctccgcctcccgggttcacgccattctcctgcctcagcctcctgagtagctgggactacaggtgcccgccaccacgcccagctaatttttttttttttgtattttcagtagatacggggtttcactgtgttagccaggatggtctcgatctcctgacctcgtgatcctcccacctcggcctcccaaagtgctgggattacaggcatgagccaccgcgcccagccgaggatggtttttttgtttgtttgtttgtttttgagacagagtctcattctgtcacccaggctggagtgcagtggcgcgtcttggctcactgcaacctccgcctcccgggttcaagcacttctccctgcctctgcctcccgagtagcccgccatcacgcccggatagtttttgtatttttagtagagacagggtttcactgtgtttaccaggctggtcttgaactcctgacctcaggtgatctgcccgcctcggcctcccaaagtgcttggattacaggcatgagccaccgcacccagcatgataacagttttatttccaggtttttggctgtggattgatgttgaaataatgacataagtaagctgatgagtaagatggtatatgttatgttgtgttctttaaccttctctgtctgcatatctagctttattaacactagattatgagctcctcgagggcatcacgcattctattcactgttgaaaaactgtattggtatagtcactgtgaaaaaaataacccttgtttgttaattttggcctagtaaaattgaatgtaaatcaaatttaatactttctaaaaagcagaatccagtgtttcgttgtaagaacaaatttgcaagcctttattataaatttgagtgtttaatattatttagctccttagtttggagaacactatgcagataagtgaaagatatattgtgtaagattttgcagtagagttgagatgctgtggagattgaaaaaaaaagaaagacccatgctgggaatgctggtcaatctgggccttaaaggaagtgtctgctgaggtgtaaggctcttctaggctggggaaacaactgagtggaagtcaagaaccaggaatgagaaagatgggaagaagacctgccaactgaaacagaatttgttcagtgagaaaccatgcttgatactaaagtcagccagtttgggttaggaggaggagtgggagagggtttgaatacctgcctgaggagtttaaatttaatctgatttctatcataaattctaaatcaggaggcagtttttaaactagcagttactattcacttgcttatagtcagcttttaagggttcaaacccagatcttctgattctacaaagaaaacagatttgtgggccaggtgcgatggctcatgcctgtaatcccagcactttgggaggccaaggcaggcgaatcatgaggtcaggaattcgagaccagcctggccaacatggtgaaaccccatctctaccaaagatacaaaaaattagctgggtgtggtggtgggcacctgtagtcccagctacttgggaggctgaggcaggagaattgcttgaaccctcttttgcagtgagctgagatcacgccactgcactccagccctggtgacagtgcaaaactccctctcaaaaaaaaaaaaaaagatttgtgtggaagttttggaaaaatgcaattaaataagtcttggtaatagaaagtgtcttataatcagggttggaagaacttgaggcaagcagccaatatgtctgagccccaaggtctcttatttatgtttaaggagcacaaactagattatcttgaaagttctttccagatctgaaaattcagtgattggatttaagtagaggttgtgcaaggtaaggaggaggaggagtcaaaaatgactcttgtctagacaagtgttgaaacttggaaaatggtggcactattggctaaaatgaggaagctagaaagggaagcagatttttctattttgtttgttttgaatacattatgttttgtagggaggatatgattaatttggttttaggcaaatggaatgatcctataggcagctaaaaatataggaattaagcctggctgagtggttagggttggaagtatagtgggggagtcatcagcttaagaggggtgctttgaacttgtgaatgctgatgagcacatagaggccacaaagagtactgagaaacattgggatccagtggaggaagaggaaggagaaaactggtagaaaactagaacagcacaatgtcacagagacagagaaagtgagagtttcaagcaaatagatataatgggccatagtgtcaagtgcaccaaaaatgaggacaagttaaattcactcgtgactttgacctgcagtgtcattggtggagttgtggaagcagcagtaagttagggtcaaaaattgtatataattgtaggtaactgagtaaaaatgatgtttcattttcacaagagtaattacaaaatatgtcacagtgtggttgaatttggaaatggcaataaagtcaagtaaagggtgtgcatgtgtttcctttcaaatacaaacgatgtgaatgtagaagtcaagcaataaaaagagttcctctctttctggagagatgagtggtgaaaccaggtttgtggggtatggggcaggaaccagttggagaagagtgaggagtgggagtctgatgtgttgcagaggctcactcaacctgaatttttcatgtttcattactagaatggaaactttcagccttgactagcctcttttactgtattgatgaaatggggatccctctgtaaagacttgcagagtaggtgctgtcccagataaaagagttgtggcagattgtattttttccattgatggctgcaccaataaatgttctgtcctgtgttgcttttctttctttttttttcttttttttttttgagatggagtcttgctctgtctcccaagctggagtgcagtggtgcaatctcggcttactgcaaccttcgcctcctgggttcaagcgattcttctgcctcagccttctgagtagctgggtttacaggtgcatgccaccacacccggctaatttttgtatttttagtagagacggtttgactgtattggccaggctggtctcgaactcctgacctggtgatccacccacctcggcttcccaaagtgctgggattacaggcgtgagccaccacgcccggctgtttgtttttattaaattgtgaagctggcattcttttatcaaactggagtttgtattcccttcctttgaacctgggcagacctttataaactgctttgactagcagattgaagcagaagtgacgctgcttgactcctgaagcttaagtcataaaagacaaccactataccttccatctgcatctttcatcttgggacacaagtataggctaccctgagctaacatgtaacaagtccagttacattgaagccactctgttagagcatgtgtgcagactgtggagagatagagagatgtgatgcctttacagccccagcctgtttaatattttcagctgaggtcccagacattgtggaacagggacaagtcagctctgctgtgtctgattcctgatctacagactccatgacatgataaatggttgttttacaccactaaattttggggtcattgttaaacaaccacgataactagaacatgccaattcagagtctgccagcatgggcaaagaagaaaggataaatcaaaacgatgaagggggaggccaaggcaggaggatcacttgaggccaggagtttgagatcagcctgggcaacagcgagaccctgtttctacaataaataaaaaaaattagcttggcgtggtagtgtgcacctgtagtcctagcaacttgggaggctgagacggaagaatcctttgaacccaggaattcgagattacagtgagctgtgattgcaccactgcactccagcctggttgacagtgagaccctgtctcaaccacaacaggaaaaaggatgatgggggttgtggctacacttacgcaatttgttggtacaactgaatgacaaatactggggaacaaagctccctaatggctgagatactctttcttctcattttacttggcaaacttggttagatgcaagtaagaaaactttgtgattttttttttttttggactgtatttggactgaatgtattacttgtggccccagaggctagtttggtgatgtaccatattgggaggttgtatggaagaggctcaactatctgacgagggatcaatgttgggctaacttcaaaaataaatgaggttggtttgccagaatcaactttttatttatgaagaatggaagaattggctgggcgcggtggctcatgcctgtaataccaatactttgggaggtcaatgtgggtggatcacctgaagtcaggagtttgagaccagcctgaccaacatggagaaaccccgtctctactaaaaatacaaaattagccgggcgtggtggtgcatgcctgtaatcccagctactcaggaggctgaagcggggtaattgcttgaacctgggaggcggaggttgtggtgagctgagattgtgccattgtactccagccagggcaacaagagtgaaattccatctcaaaaaaaaaaaaaaaaaaagaatggaagaatctgaatgctcagatgactttattttgtttttcccaaaagatgcattcttcaaagatgtgggcagtgtttccatttttgacagctacttactgggaaagttctgcattgcaagtggtcctgtgggcattgtggtgacttgccatgaagagccttcattctggtgtctgtagggagtttaatccttgagaagatgacaggttccatgattttgatgggctgttttgtagacagcagggaggaaaagccacatccctagaattgccaacactggctcttggtatctacgaaatgctacctgtatcagatgaaactgatttgggcagcatgtgtgacggatagcgcaagatttgcttgatgtgtggagatagccgtctttctctttcaaggatttgaaaaaggcttctctgggtcagcagctaaaactataattcctaggaaagtcatcagcaagttttcagtgaaatgctgccagatgtgattctccaagctgtgggtgagcagattgttatttaccaagaagtttgctaagctgaagaactctgacaattcaaggtatacctgcttcaaggtatatactgcttcatggtatatactctctcatggaaagttctgggtatcaaactttaatttttctgattacatagttgaggaaaaaaatagctaaatcagacataaagataagggataaagaagcactatctgtgattgtcacctttctggagacagacaaaaatggatctctgttgcctgagcagtcagcagttgtatctgctcactcaacgggaagtgctcctcaaagtgaagtgctcctcccaaagtgaagtgctcacacgggctagttgtgtagaacggacaacagtggtgggtagacatttgtgggtcatgcctcactagccaactgatactgaaacaactcccttgcctttcctgagaaagaaatgtgaaatcaagtagatgggcacttctcttataaaaaccctcacaaatctcaaataggtgacatgattatatgttactgttttatgaattgacttacttggaatgccaagtaatcttcagtttttagttgcaagtacttacaagtggttctggattgagagggttgtctccctggttagatttgtacattattaggtgtgtcttgtggctcttgaagctgttagaaatcccacatgctttagaaaattctggttaccattaatagttggcttccaaataagacttgtgaccaacattgttttctgcttccagttcatgccttctttttcaggctaacactgaaatgatattggaagaacagttgggaggttttccacttagagagacctctttgcttgctattgagatgggattccctgatacactgcagattctggctgtctttcaagatctgagccattgctggcagtttccacctttgtgatcccttaaaacatccatcttaaaaatgtaaaataacgactagtttacctttcttatgtctgtgttactaaatgaaaactaaacatgaatcctctttttaaaaataagagctttagaatggaataagccaagttgctggtcaggcctgtagggtgctgagctttattctgcaactgctttgtagcatttttctaattcctgccatttctttcatttttttcctcaggacatgctttgcttcttgcatacttaaggattccttggcttcacactcagtgctactagaatccacccatgcacactcctcaacttcagtctaacagtgtcttaagacattgtagttctgaaagcatggcctgtaaatcacaagggatccccaagatcctttcacagaaagatccactagctcaaaactcttttcatgataatattcagatattatctgcctttttcaccatgttgacatttgcactgatggtgccaaaaaaagctgtggtggctaaaactcctggtgccttaccaaaaatcaaggcagtggtgtcgtgccatgctttctgtggtattcctcatcagcttgtactaacagtaaaaaaaaagaaaaaaaagagtcatattcccctaagaatattcttcatgaggccgggcgcggaggctcacacctgtaatcctagcacattaggaggctgagccggttggatcacttgaggtcaggagtttgagaccagcctggccaacatagtgaaactctgtttctactaaaaatatgaaaattagctgagtgtggtggcgcatacccataatatcagctactcgggaggctgaggcaggagaatcgattgaacccgggaggtggaggttgcagtgagctgaaatggcaccactgcactccagtctgggtgacagagtgagattctgtctcaaaaaaaagaatattcttcatgaaacagtaaaaattaataattttataaaatcttgaccctcaagtataatttttctcatttttttaaagttataatttacctacaataaaaagcaacctttttggtgtacacttctgtgaaattgactaattcatatagttgtgtaatcatcacttccacaagcaggatatagcacagatccatcaccccaaaacgtttctctgtatgccttctggtccttcccccatgtcgagcacctggcaaacactgaactgttttctgttcttataattttgccttttccggaatgttatgtcagtgaaatcgtatagtacgtggccttctgaatctagcttttttcacttagcctaatgcatttgagattcatctatgttgttgtatgtagctgtagtttgttcctttttattgctgaatagtattctgttatacatatatactacagtttatccactcattagttgaaggacatgtgggttgtttacaatttttggctgtgtgaacataagttttcatttcacttaggagtgggactttggggtatggtaaatatatgttcaagaaacaaccaaactctcttccaaatggctgtactattgtgctttccaccagtaaggtatgagaattccagttaccccaccacctttccagcatgttgcattgtcattttgttttcattttaatccattctaaatatgtagtagtatgtaattgaagatttaatttgcatgtcattaatgatattgggcatcttttcctgtgctatttgtcatatgtatgtctttggtgaagtgactggtcaaatcttttgcttttttttttttttttttggaaacaacagtcttgctctgtcacccagattggagtgcaatggcacgatctcggttcactgcaacctctgcctcccaggatcaagtgattctgctgcctcagcctcctgagtagctgggattacaggcacccaccaccatgcccggctaatttttttgtatttttagtagagatggggttttaccatgttggtcaggctggtcttgaactcctgacctcaagtgatccacctgccttggcctcccaacatgctgtgattacaggcatgagccactgcagctggctttgtttaattgggtttttcttattaagttttgagagtttaaaaaaatatatattctggatatgtcattaatcagatatataatttgtaaatatcttctcccttagtatatattttaatattccactggcaaaatggaagtttgcgtgaagcatttttgtgatgtattgttaaataaaatggttgtctctaggaaaagcacttatgtgattgagttgtgagttgaaatagctgttttccccccgccccgagcaaaatctcatttttactggagagaatgacaaactggtttctcagacttgcaggctttctcaaatctcaaatttatctaaaaaattctcgagatattttctcacaaatgagtgaggtgaacctgtcacttcatggaaaataaatgacagtatttttaccagtgataaaattagagccttttgtttaaaaaaaaaaaaaaaaaaaaaacaattttggaaagcttatatcaactactatgctcttacagatttccaacacttaagtttttctgatgaaactggtggtgataataacaaatatgattttggatactgtgtattgaaatgagctggcatttggaggttctgcaatactcagtagactaatactttcctaatgaccagtatttgatgttataaaatcatccaaaagtaaaagatccaaattacaggttgagcatctcaaatgtgaaatgttccaaaatccaaaactttttaagcaccaacaagatgctcaaaagaaatgctcactgggggcattttggattttggattttcagattggggtgctcaactggtaagtacaatgccaatattctaaatctgaaaaaatcccaaacatttctggtcccaagcattttggataacggaatctcagcctgtacaagattgaccaatggatcgtagtataagggaaacaaagcgccctaatgactgagatactccttcccattttacttggtaagctaagaaaaacaagaaaattattactgtaaaataagaaaatctaaaaagttctttaatacagttttaggatccacattgcagctaacctttaacagccagttgtcaagttttggtatactatcaaaaaagtacatccacaattgtccgaaaagactattaaaattctcctcccttttccaagtatgtatctgtatgaggctggattctcatcatatgcttctaccaaaatgtatgtccacagactgatggtagaagtggatatgagaatccacatttattgaagagatttgcacaaatgcaaaacaatgccattctcactacattttttttgttttagaatttttaaaataaaaacattgttaacatgtaagctcacattttaaagttgacaaatatttttaaaatgtctgtttgaattcctaatatagtaaatagattagatacatagtatacataactctgagctcttcggggtcttcagtaattttgaagagttcaaaggagtctcctgagaccaaaaaagttcatagattgctacttagaatttaattccagcatcatcattgtgtactggtggtggagaacaaacctaagccctagcccaaggcttcttggtttgaggcttctagttctcaagaaggaattcatatttactttacagaattgatatattttatattctttaaaagatgtctttacagataacctcttcaactctgtcttccattatcataaatgatactcagtacttacaaataaaccaatgcaatcagccctccatctctgtgggttccaaatctgtggattcagccaactcaggattgaatgtattcagtaaaaaaagaatggttgcatccctactgaacatgtacagacttttttttcttgttccctaaacaatacagtataacagcaatttacatagcatttaaattacattaggtattataaataatctagagatgatttaaagtatgtaggaggatgtgcgtaggttatatgcaaatactatgccactttatgtaaggacttcagcatctgcagatttggtatcctgtggaggtcctggaaccaatcccctaaggataccaaaggatgacttactttgcattaaggaatgatacatagctctttctccactaaatcacccagatcccataaagagtaaagaaagtagattttcacctcacttaattcttccccattttatcttaaatagggtttctcattagcactgaaagtctaaaggctgacgtgaaaggaacaatgaggtgacttgcctaagccttaaactagatgaatagacgttggtagatttgttgtccatatagtttgcttatttactcagcctgcacctagaagctgtattctctgtttaacgttccgcctcttagctctcatcagtatgccatagacctaaatattgtaaggtgctttttttcatttttgttagcgctttcttttttccaatacttgaaacatcagagggtataggatgcgtgtgaattctgttttaaagccatagacaacaaacaccctaatcagctagaacacgtttttgtggtctttgttccagaagaaatcatagaaggatcaaaacagttcttatagttcaggagcagtgggattatcatctttgaacatgagagaccatatgattataaaatgactcctttttggcttttatatgtgatagtattagattataacatttaaatagtggatattggcccaatggtgggggtaaaagttcttaaaatcttgtgactatatctaatctaaaggcatgctagatcatagcacttaatggcctagtctcattctctaaacaagaaaaacactaatgtggctgggcgtggtggctcatgcctgtaatcctagcactttgggaggctgaggcaggtggatcacctgagatcaggagttcaagaccagcctggccaatctggcaaaaccccgtctctactaaaaatacaaaaattagccaggcgtggtggcgggcacctgtaatcccagctactcgggaggctaaggcagaagagtcacttgaacccgggaggtggaggttgcagtgagccaagatcgcaccatttcgctccagcctgtgcaaaagagtaagactccctctcaaaaacaaaacaaaaacaaacactaatctggtatatggtattgcttaattaaggaaagtaggtatatttaaagctaataatgtttggaaattgaatgagattttgggtttaagaatttctcggattaaaatacttaacctataataaaatggtagctatgtaagagtaaccttccctccagcattctcattcctcccacaccaagaaaagaaaggccatattaggacttatcatctgagtataaattattaatactgtcacaccaagtggaagcatgtgggaatgctcattgccctttagttaatttgtaggattgcttcattatacttttacgtatagtctgttcagagaaaaatattaaatttgtccttccccaacaaacttgatattgtagctgcttaaataatggctattgtattccaagcatcagctgagaacataatactcagactgtgtatcaaagttttgaactttgatatttgtctgtgaagagccttctgtgggaatggtggttgctgaggatggtgtatgatcataaatgttaacctaaatcatgcagtaacttgaccatggaatgttgtctgtgatttctctcctttgcctcatcttgattacagagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcaatatccttttctgtggtgtctgtgccattcgggataaatagacaaatggacaagtttttctccagttgtttccagtatgtagatgaaacattttataatcgattaatgtttgttgctcttacttgtaccatgacatgtttaaagtatttgcccagtaacttaaggtacagtagccaaattcttatacagtgtgtgacaaatcctgtactataaatgtatatatatatataaaggcagcatagtgtaatgattatgactgtggaccctggagtcagatttctggtgttcaagtcctgcctccaccaatgtaaagggaaaaaaaaaaaaccctttttttcttttttttttaagtctctaccctcacactcaagtcagtatgatatttctgacactgtctacttggagatagcatcaggtccacaggttaagagctcagtcccacaagactgcccccacttcagatgccagttgcaagccctaggttgtgaccagcgcttccaactgaccacgtataaattggagttcccacgaccccctccatagatcgaattaatttaatttgcaagagcagctcacagaactccgggaaacagtttccttaggtttatccatttgttgtaaaggatattacaaaggatacagatgaatgaccagatggaagagatgcatgcaaggtatgggagaaaaggtgcagcacttccaggccctcttcaggtgcctccaggaacctccacatgttcacctatctggaagcttcctgaactctgtccttttggtgtttgtggaggattcatttcgcaggcatgattgatcacatcagttggccattggtgatcagctcagccttcagcccctttcccctggggtggggttaagcagggggctgaaagcttcaactgtctaatcacatggttggtttctctggggaccagcccctcgtcctgaggctatctagaaacccccagccatcaattatcccattaacatacaaaagatactcatctggagattccaagggatcaaggagctgtgtgccagaaatgagggggcagagaccgaatttgcatttattacagtatcacaaccagttaccatgtgacttgggctcatcacttaacctcctgtgcttccgtttcctctttagtggaaagttaggataacaagagtacctagctcataggattattgggattatacaggtaaagagtttagaatggcacctggcacacagcttatgtaatagtgttagcagtcattatcatatagaggtccatacaggccagtgttacacttcggtaattagagatcaaaaaatctttttgtagactgtcttcatgtttaagaagtgatgttacagtgctaccgtccattgaagagatgtcttgttccatgaaactgcatttagtaaaagcagatctgctctgctaattcatggtattgatgtgaagtaagtccactgatctgactcatgcactggagaactgtaaaaacttcattatatagcctttttttccaactggaaatcccacttaaccaaaactttagatggaagatatgccacttgcatgttctgagttctgttttgttttttccctaagtgagataaaacataaggaaaccagcttctgtcaggatcaccttatagttagcacaggttcgtatgcagttgatacatggagtaaataatttttgttattcatgatgaccctggtaccttttacattattaaaaggcaagtatgttctctaaaattagtggcaaatatgtgagggggcaggatcaaaagcacagttacagggagataattcttcccttgagaaaggagggaaggaaaaaaagttaggggagatagagaaaatgtgagattaaaaaaacaaaagttttaatagatactcatcattcaaccagcaagtgtttattgagtatactatgtgccaggcattttgttggttacagagattagattaataaacactataccagccctcacagaactttgagtggatagggatgggggacagatggtaatcaagtaataacacaaatagatacctgcagactatgaaagagaagtatagagagctatgcaagtgtctgacatggtgcgtcggaccaggctagagggtaagggaatgagggcagcttctctgaagaaggcccgatctctctagattaagaagtagggttagcatcttggcataatgggaagtggtttggaatggcaggagaaaaaggcttgcaaaagctgtcttagtaaaggtgatcaggagtcaaaaaaggatagacacaagtgttggcaaacaggaagagcccagctcacctgtggtcagatagccctaagtgtttgcagtgaagctcatcagcaggggctatgcttcctaaccagacagatcatctctgtcttggagcaaagggatcctccctcctgtggctgtgggcagaggaagtctgagaatgattggtgtccagctgactgtgttttcagaaagtttgagccagattttatttgtttgcatgtgagagattcagtgagttaacaggatgttgtcaggctttgatgatgaaattgttttaccttgactttttgacctacgcatagttgaagcaaatcctagaaaatttaaccttgatgcaactgaattgagtataagaaaagccttcattacaagtactcggcaagttgtcagggtaaggaatatgatcttattgtgttatctgtataagaaatagccagacttcttagagctctttcccttaattgtaaactaataggtcacctctgaaaccactttttaaatatgaattaaatgtgagcttccccatatataatttctctgattggctgcgcatggtggctcatgcctgtaatctcagcactttgggaggtggaggtgggtggatcacttgagcccaggggtttgaaaccagtccgggcaacatgatgaaaccctgtctctacaaaaaaaaaatataaaaattagctgggcatggtggtgcacacctgttgtctcaactacatggaagaccaagatgggaggctgaggtgggaggatcaggttgaggctgagagctatgatcacgtcactgtaccttaaaaaaaaaaaaaaatttccgtgattgaagaaaaagaaatctgtttttaatctttctttttttgacacaaggtctcactgtgttgaccaggctgaaatgtagtggcatgatcttggctgactacaacctctgcctcccaaatagctgggactacaggcgtgcaccaccacaccaggctaattttttgtagagacagggttcaccatgttgctcaggctggtcttgaactcctgaactcaagtagtttgcctgcctcagcctctcaaagtactgggattactggcgtgagccaccatgcccagcctgtcaggcttatttccgagagcaaaaatgagacagtaatctgctggctttgggcagggtacattcaaatggtgtcatcctgaatgattagacccttgtccatacctctagtttcttcaagctagttatctttctcactttttatttcttagtgtactctatttcttgacgaacaaaacaattgctattgtagaaaccatttggttttttgattgattggtaatcacttcgcattgttgaagagtgactcttagtgggtttggatagcggcctcttccgccatctgaattgcttctggaactcttgcaacccaagatactgacatttccatatgtaactacttgacagccgttccagagttatccagagcaaacaagcatctatcagagtgtaaaaaattgatccaagtgaacaaatctttagttctaagttatttagaataatacccattattaaagaatctaagaaaaaatattaagtacaatcttgtgtcattaaaatgtttcatattttgaaactatatggctaagccatttgattagcataactagatgtaagagaaccagctgtctttaacatatgtactagaaagcagcttccttgaataaaaagacttgggatcataccagtgctaacatacggctttttaagagtcatcttaggcaggaaccttagtttgtgtttgccaaagtctttatatcatgtgatttccttttgaaattatttcaaatggtagattatcactgaactttatatattcttgttacttgttttattcattagttgcctttctatatacatatacgtaaattgtttatagataaacccacattttaatgagggagaaacctttctggacctcagatgccccatccacagtgagtgtttggattggacattcttaatttctagccagttcaaaatactgttctgatgaggaagccttgttgttaggtgacatattttttgtaagataagtaaatccccaattattttgtataagcttttttttttttttttttgtagtagtaggttttttgaaggatactcctatagacgttaatatttaagtggggccttgcagtgaagcatatgtccttaaccttaatcattatatttatttctgcaaggtagacttaggaagtttgcaaattgaaatttagaggttcgtatattaaaaattaagttcattggtataatggaaagaagaatccaaagttcattttctaatatctgaaaagctttttaaagtacattcttagaaagaggttgatatgatttagctgtttccccacccaaaatctcatcttgaattgtaatccccataatccccatgtgtcaaaggagagaccaggtggaggtaattgaatcatgggggcagtttcccacatgctgttctcatgatagtgagtgagtctcatgatagctgatggttttataaggggctcttcccactttgctctgtcactcttccctgctgccttgtgaagaagttgccttgcttctccttctgccatgattgtaagtttcctgaggcttccccagccatgctgaactgtgagtcaattaaacctctttctcttataaattacccagtctcgggcagttctttatagcaatgtgagaacagagtaatgagaggtattccaaatcaagtcagtacttcaaaatcttactgtccttttagagttgagatctaaaccatactcaactatgtgatccacctgaatattttagggttttaaatcattcttgtttaaatttatgacccctttgggggaagctgttagtatttaccagtggtaggctaacagtacctaactgagcttttgctgatctgattgtaataaattctagttgaaagtcctatagaagaggaggaaatagcaatggtgctaactcgattaaaaataaaatataccttgtataattccacattaccacatttagctaaacagtgtttgtatgtagagatttctgggttctgggtggaagagctcgatagagagggagcagagggttagcagatttggaaaatgagatgaaatgaagttcaaattaggaatttgtacaaatttatgttagttcttctgttactattactagtgggctttcatttaatattgctccaaaattttgattgactttatctttcaaacagtgtattctacttatgctttctcttttgtaggcaggggagtcagtgatactctatgcattttgtggtttttttttttctttatttgcttcaacctgaagaagtaaatcgcctgtttcttcttgattaatgtccattggttatgcctttagtaagctttccttgtttagagttttgtgtatgtttttccaagcatcttttaagtctgtacaaatccagttttgctggcagtttttagtgaagaaccaaaatactcacatttttgtgtaaatagctttcatatttttgaggtaatcatttttactcttgtggagtcacctatacatcaaagattccacatgtgaaatttttgtgttttagaaatatatcctagaagtgactttggttttactttaggatcaagaggttttgcagtatatggcagaataatggtgaatataaggggtaagggaacctgagttctaggctaagctgtgaccttaataaatcttaaccatggtaagtcattcaacctccctggatctcagttttatctatgaaataatcctcactaacattctctgactttaaaagttagaactattaccctctccatgaaaaaaccgaacctgctccaatgtaagaattgtttacagtcaattgtaagtcaagatggaaatggctttggttaatcaaaaagggtgaagtatccagtgtgagcacagatgaccttgaaatgtaagaattatgagtgggaagcactggggtttatgatgtctcattcattcagcttggaagacagtgtgaaatgggaacagaagcataaataaccaggacatttgttgttcctttggcagatgaaccatattttattgggacttgttgcttgactgctggttctaaacgtcatgtgttagaaagaagatgagtaattatgtttttggcatgatagattgttataaaatgtttaaaactatttagtaacatagtttaagatcccgaattccaatatgaaggtgttgtgtggtatctgctaacttttgacctacatggataaagtgccatcttagaagtgaaagctggcggggtgtggtggctcatgcctataatcccagcactttgggaggctgaggcgggcagatcacttgagggcaggagtttgagaccaccctggccaacatggtgaaactctgtctctactaaaaatacaaaaattagctgggtgtggtggcagctgcctatagtcccagctacttgggagacagaggtgggagaattgtttgaaccggagacagaggttgcagtgaactgagattgtgccactgcactccagcctgtgagacagagtgagactcctcaaaagaaaaaagaaaaaaaaaagaagtgaaagccatagatccttagatccttacccgcggtggtggtggtcacatacaggatgcctacccacagggctattggaggaatctgcctcatcagggctaacacccatgcaggcacacacataaccccacatggtttttattaagcataaaactttaaaaactgcaactttagaatacacatttaattatgataatgcaagctcaaagaaaattagagaaaattttcaagaagtaaaagtaggaaaaggaatctaaactcagaataatacatagcacaagactttgcattttcttcataattttcctcccaatgcagggcagttgtatttttacatagttgtgatcatactgttatgcaatcatagcattttattttcttaggttaaaaataatctgtacttggtatttataaaatgcaaataatcctgatgaaaaaactttgaagagaaaatgcctcttcgttctccaatttcactccctagaaataattagtgtcaacaattttatttttcacagccattttatggacattgaaatatgcaaacttttaaaaagcagtggcatgataatctgtaactttttttctatgaaaaattacattgtggacatagtcttacaatgacacagataaatctagagaagtgctgttcagtagtaataaaatgggaacctcttggtcatttttagttttctagttgccacattaaaagagtaaaaataggtgagcttaatatattttatttaacctgatatatccaaaacatgatcatttaaatatgtagtcaatataagagatattaatgagagatttaaattttttaaactgtttttgtaataaatctggcatgtattttacactcaagcatatctcaattcagatgtgaaattttcattggaaatacttgatctgtatttagagtttacagaacttacaattgaaaaagtagagtcacaaacccaattttttctagacatacttcaaagttttctaataactgagtatcaattaattaaagtaaaattcagttcctcggttgcactgaccacattttaagtgctcagtagctagtgggtcctgtattacccaggagcagactatcctttttaatagttgcatacgtttatttgctgataatgtttattgagtgcttactatattgttggctactgttaatcaggcttcatgtgttacctctattaatccctacaatgattctaaaagatattattctaaatgtacagaagaaatagaaacttagtgcagctattaaaaagcataactaagtcttaaacctaggtctttgacatgaaagatcatgctgtttccctctcctttaatgtggctctgttatgatttatttaatcattgacctaccagtagatattttggttattgtttattagtggaaattgcaaaccatgcttcagtgaccatctttgtgagcataacttacataattgtttcgtaaaaaattcaatgagaatacacattttaaatattcattgccagtcatgatggctcatgcctgtaatcctaggactttgggaggccaaagcaggaagatcagttgaattcaggagttcaagaccagcttgggcaacatagtgagacctcatctctaccaaaaatttaaaaaataaataggcatggtggcacgtgcctgtagtcccagctacttgggaggctgaggtgggaggattgtttgagcctgagaggttgaggctgcagtgagctgtgatggcaccaccgtactgatgatgcctgggcatcagagtgaaatcctgtctcaaaaaaaaaaaaattgttttcaaagtatcctacaaaaagaccttatcagtcatatttctgatagagtatcagaatataccttcactaagtattatcaatctttttcatctttcttggtctaattggagaaaatgtctcttagctacacttctttgattaccagtgggttattgcatctattcatgtttgatcatttgtggggtttttgtgaattgtctgttcactgaactctcttcataagcacaatgcctagtacataatgcctagtatataatactgcattgtgtggattgtgttgctgttcccttatttgggcttgctgcttatttctactttttttcttattataaataatactgcagtacacatctctgcatgtctttttttgtatctattttatgttatctccttaaaataaattcctgttagtggaattactgggtcaaggcagtgaatattttgagactcatggtacagaatgacaaatttattttcaaagtgctgttctagtttaccatccagccattgtttgggaccagtagtattaaaaatacatatatttactaaaatataacggtacagaaaagtgtaattaacctaaacatatagcttaataaatttataaactgaacacagccatgtcaacagcacccagaagcattgcagggtgttaccagcacccccagaaggtgcctgtgctcctttttagccaatgtctctaccccccactgcactgacttctaacagcaaaagtatgttgtacatgtaatgttcaaaggctaacatgtcactttcccatacttgcatgttgatatttttattatgcaagtaatgtgttgttttaaaaaaacactattataaaatgcactgactatatttttattttattaattttgtagagatggggttttgctatgttgcccaggctggtctgcaactcctggcctcaagcgttccgactgccttggcttcccaaagtgctgggactataggcgcaagccatagtgcccagctgagtatatttttaaaggcatgtattatccccctagtgaatgttgctctgcgtagtttttaataatattaaataaatcgggctgttggattgactgtcagaatgtcatcttaaactctgattgataatcagaaaacgaatcctgcagtccaggagatactagcatagtgatcagtttctcttgaaggcttctagatttccattgtaagacaaggaatggggatggggagggggcttgttaaaaatgtgccgtcaagagtctgacttcgtaggtctcataggggcctagggaactacatttaaaaaatatttttaggccaggcatggtggctcatgcctgtaatcccagcactttgggcggccgaggtgggcagatcacaagatcaagagatcgagaccatcctggccaacatactgaaaccctgtctctactaaaaataggaaaatgagctgggtgtggtggtgcgtgcctgtagtcccagctattcaggaggctgaggcaggagaatcacttgaacccaggaggcggaggttgcagtgagccgagattacgtcactgcattccagcctggtgacagagtgagactgtctcaaaaaaaaaaaaaatttttttttaaatttcttgatacataatggttgtgcatatttttagggtacatgtgatattttgatacatgtatataatgcgtaatgatcaaatgaaggtaattggaatatccatcattttaaacatttatgctgcaaacatttgaattattctcttcttgctattttgaaatatacgatagattattgttgaactatagtcaccctactgatctattgagcactaggtcttatttcttctaactgtattttttacccattaatcaacctctcttcatcctcctttccccctgcactcttctggcctcaggtaaccacctatctattctttgtcttcatgaaatccaccgtgagtgaaatctcatccacttatgagtgagaacatgcagtatttgtctttctgtgcctggcttatttcactgagcatagtgacatccaggggaactgcatctttaacaacactcacgtgactgactcaggcatgtcatcatgatgtgaactccatgtgggcaggggcctagctagtatcattcactgctgtatgcctggccacatagtagacatcagtgagtgtttgctaaatggatagatgagtggtttgaaagttgaatcaggtggttctcactcacatttaccacagttctgggattgtaaaagcggtggcactgtctcatctgtttacttgtcatgggtctttaaagaagtttctaaaagtcttacactttgatgtttgcataaattatattttgacgaccttttaaaaactgttgttgcagtcatgtattcagttcaaatcattctatagtagattggattgtagctaaataagcagaatgactcatatttaataaagtgttttgcttcagataaagtaatggatctattcacttttcattccatacaaaattatttttgacaccactctggaaattcactctgatgttaggaatagtctatacctttcatgaatccaactcagaaataaaataagtgacctgttgtaccactatttggaagtattctttggtgtttaatggtaaatatactttatactaaaagcacatggttttttacatatattgtaaaaaagatgcaagcccttgaacacgtgcttttgtgtttgtaccccagggatgttctttattagtgatgtgactttgagaaagtatcatcgtctttttggacctaggtctcctcaaccttaaaatggaaatagtaccagcttcacagggtccttgtgaaaattcagtgataatgtgtgtatgtgtttagcactgtttctgacctgtggtaggtacctggtaaatgttaattcctttctctttcctcctattcaaattagtatccaggttacttctttttaagggaccatctttctttttattttattttctttatttttgagactgaaaataaagccaagaaatgcggtcttctttttaaaaagtaataataaattgtgtgttttgctaatgtatgaaatgttaactgtgattttgtttaaggatatttttcatttgttttcgtatcttctttctcattaggacatgaaagatcagatgtcaacttcatctgtgcaggcattagctgaaagaaaaaatagacaggtgagaaaacatcagaatataattatcaatgacagaaagcatacagttagatatttggaatttaaaaatgctgaccatccatggatcatgtaatcaagaggaagacttctgcttgcaggccctggtgtgaccatgggaggttttgtgacagtccaggcagcctgtcccagcaccctgtcaacatttccctcccctcctcttaccctctggtcttctcctctgggctccatagcaccttttgcctacccttactatagcacttatcacagagtacttttacttttttaatgtgtttattctgtacctattgaacacattttgtgtgccaggctctttgaagggctataattactgtctttctctctgctgggctccaggccctttgacagtgaggagagatgtgtgtcatggttttttgtttcttgtttgtttgtttgttttgagctctctagcagttactacattgcctacccatggaacacattagacatctaaggattgacatttgatgtaaagacattagaggaaccttaaacttgtgtgttaaattaagtttctctttgttttaagtagttttaaaagaattacatactttggcatattgatagaagctcctttctaattgttaaaatacagtccttttaaaaaatgtagaatgatcatctagaatttggactttcatttagattgagatttgatttagactttttttggtgggatagaatgtttttgcctgttgctaaactgttaggtaatttttttgacagaagtagttttttaaattctgtggatatccattttccttagaagtaaaaaagacttcatgaaaaatgatactatttgctttaaatgacttaccttagtctcattttattaagattccagaaagttatgaattgtccatttagtaggctcttgagaaatttcactatttatactaactagcaatcagtacttcatacctgtgggtatttgtcaagacacttaattttgaaaacaaatattatggaagcttgaagaaggggcagggttctataaatatcacctaacttaattttcctgtttccttttcttgcattccatttttcaagtcattgttttgtttttggctttttaatcttatttgcctcctttgctttctttttgagcaatatagctaggaaaagccactagctggtccattccatctggctccctctcttgaaagaagctagtgaatgccctcaagttggctagttttggagttctcttcttatttgcacttgagcttataggaagtggaagtaactgaagtagttgtgacagtgaggtcagtaacacctatgctgttactcttaatttgaatgttttattctctagatagtatagttgggctaatgtaaataaaatttatatttatatatttataaatatatataaatatataaatttaaatatatatttatataaagtatatatacatgtatgtatttatatattgcctatctagttatggcttggaattttgttttaggctatgagtgaaatgtcaagttgcaaattttcaaggaatagcaggatcagggctctctaagcactccagcaggcatgggccttgccacgttgtgccaggtgccaggctctgtgctgctccttgcctcaccagcacccctgctctggcacccacacacaggtgcatcttccagtccttgggccctctctcaatctctatcctattatcacaaacatttgggatcagactgatgaactttaagctatttcacaataaaacgtggatgatttgccctatacttagctctacctaagtgtacaccatggaaaacgtaggaaaaatagccctgtgacctcaggagcacacaaggccctggtggtgtcccagttctctgtccttaggccagtgatgcattatagcatttttctgaccctaaaaaaattgtcactatttcctcatgtcttccatagaggtccttagagtgtggatcataatgagcaggatcttttcagtcttgatagccctaagaccaggtcagggcagagccacccacaaaaagccttggatctgctttacaccagagacagtcaccatccagctggactgaagctctgggcccctggaagctcttgtaagaaaagcttctaataactgagcttccctgatcctagcccctgaagtctggccatttgatggagttcacccctcgcagtctgagaagaggtcagtgtcagtatggaggaaggtcatggggctgttggaagggttttcagacagaaccaagtaaccaggcaggcttttaatagtgcctgagattttttttaaattacccgataggaaaatttggcaactctacaaggaaaaagagtcttagttgctagcgtcttctggctcttgcctgcggggctggtgtgagcagttactttgaccagtcaggaaggcttgtggggatctggtcagaaccaactgctgagatggaactctcacattcctgcctgtcttcttcatgtgaggaagacatacccatttatggctgcaaacttccttgaattcatacttgggaaacccgacccttgtgtctgggagccctggtggagaactctgactttagggcagcccttgcctcggttgccagggtcaggcattccttgtggtcatacctgcctgtaaagtaacccccagttgtcatctggaaagcctgaaggaccctggattctattcatgggttaaacttaacagacattgatggttcttgtgcctttgtgtgtgaagggctatggcttaccttcttgtcattccagggaactctcccttttccccccaccaaaaaaacccacaacttcccctgggtcacactttttttaaaaaagtactctagatcttcggaatcaggttgactggaacctatgggttgctgaagttccacaggtaccaggaagagctcttttacaagagattgaatgcttttcaattataacacagtatatagatgggtgtttgttgatttagcagacgtttatttgcactttaaggggacaaagcccattgtgaggcctattgggagagcttaaagacatagagggcccttcctggaattccttaaatagtaccacccaggcaccaacctacaccactacataaaagccttgcccaggggaaaatagacaagaaatgtgaaaactctttatatcactcttgatgcatcacttgttcagagatagtaattgtttgtttctcctgactcctctggttgttcttctcacacaggcactgctgggagacagtggcagccagaactggagcactggaacaacagataaatatgggcgtctggaccgagagctccagagagccaattctcatttcattgaggagcagcaggcacagcagcaggtaccccaaggaccccagacttaggacgggccagtgggaaacaagacacccccttagttcctttgccagccatggggtcttgtggcttagtgacaaggagggtaagccagagcttgtcctgtgttgattgtgtttaataattgcatatgtaaagggtttcaaaatcttcacagcgtgactgcttcaagagaaccaagctcagccaggcgtggtggctcacacctttagtcctagctactgaggaggctgaggctggaggatccttgagcccaggagttnnnnnnnnnnnnnnnnnnnnagaccccagctcagttagttctttaagaaaaaacagtcctttgtccatctcagcaaagacactttcagaaagatctctcatttttttcttcgaaaattattgattggtttcttttttttttttttttttgtgagacggagtctcactctgtcacccaggctggagtgcagtggcaccatctcggctcacggcaacctccgcctcccgagttcaagcagttctcctgcctcagcctcctgagtagctgggactacaggtgcacgccaccacgcccagctaattttttttttgtattttagtagagacggggtttcaccttgtttctcaggctggtctcgaactcttgagctcaggcaatccacctgactcagcctcccaaagtactaggattacaggcatgagccaccgcgcccggcctattggttggttttgttatatgtaaagatgactgcttttgtgtaggttaaggggtagaaggaaaatgaaattgattatgtctgttgatgcctttgatatgtagctgtattaataaaagcaagctaatgataatgtgtctggggatttgaggagcatgtacccattgaaactattgattcttaaatattgtgttttatgtatacatgtagtttatatgttcttttgttctttacattagtatgtctgcttaaccagttgtctacttaaattgctattaaacccaggaaattttttttctatagaaagtgagaagaatgcaacacaactaaaagtaaatatttgtcagtcagtagttgtccttgaggtaacttattgccacagggcatcctttcgtttgtccttgaagagagaggaaagactgcatagtttccccacatccagagatttgccagactctcttgtatttaagctgtggcagtctgttgtggattgagaccttgatcttggcaatgggcttcctcctcccaaacatccccatgtctcaatggtcatctgcacgtgtgctttcaaccattgtctgctccattattggacgtcagccaaccagagtaaatctctcttggtggtttcaagccccgctgactgttcacaagttggatcagcaggagatatcagtagcttaacaatccagccttttgagcagtgtgttctcagaggcaacggtctggtcctttgatttctgggctttgcttctgaatgtgaattgtcccaagttggcaaagaaactagcagctgctagagtgctgggcttggaaccaggtaagatggattttaattgcttatttcccatttctctggcaccagttgatcgtggaacagcaggatgagcagttggagctggtctctggcagcatcggggtgctgaagaacatgtcccagcgcatcggaggggagctggaggaacaggcagtgtgagtattgagacacccctctcgcttcagtgaaattgaggggcagagccatcctatgacacccctaaaaagcctggcagctacgtggctggtaaaatcaaaagctattttattcatagctgcatttttattctgttttacagattagcctccccaaaagaagcaattctacttcgtaaattttactacaggctttaggtgaagttgttattatttttaaacacctccaaaaacagacacagatttctctgagcagatactcgaagtatagttatgaatgggaatatgaaacagagaagcctctgtaacctgtgggaatttttgttccagagaggataggacatgagctgactttatcatcccatgactctcctgctatattgaacagatacgttttgctttgaatcttaaattattgtaactttgtttttttttttttaaaaaacttacaaatttaacgccagttaacaaaaactctttcctctcagaaaaataaataaaaacaaaacataacctcagtttgtttttccttatgaacaatcccttttgcacccagaagttcgatggcaaaaactgcattcttaaatgctgccacatcattttgtaaatcttttgaaagagaaaaatgaaaaaacagtccaccaggatatttcagaaactttcctgtctcgatattacgtttatcatgacacattgattgattatgaattcttagtgggcccgtgttctacaccgggccttctggaagccaagggatatagaagggaacagagcagacaagacaacccatctctgccaaagagtttgccgcttgcagggtagaacggatattgggtaagtggcgaggggtcattaggtgatggcagtgaagtgggagggcccctgtgatggggccagtgcatgctgcctggagagccctgacttagcccaaggtccctgaggaagaggggtttaactgaaatctgaaggatgtgtggatgctagccaggtgaggtgagagttggtgtggaggcaggtggtgtggggtgtgtagaccaggaggaagaaaatgcacctgtgaagatggagaggtgcacacgtgcatggagcagagaggttccatgtgtctggaggcagagaacaaaccagggaaggccttgtcagcatggtaaggaggtacgactacttattctcagcatgatgagagaccagtggaggtgaggtgaggagtgatggtgtgatcaggtgtgatttagatgatgtgctgcagtggagtcaggtagggagaccaggtaggaagctggagtagccagaatctgtttcatgtctatctaaaatgggtcctgaccctaaagttcagtttgaggaggggaaaggactaatggcctgagcttctctgttgatgaggcagcctggctgggcagtgggtaatagagtcagagggacttccagttaaagatggtgcattgacacacccctacctccactccctctccacagctcactagaacaatagtaaaggggtttgtttttaagggcatgaaaccgctgggcatggtggttcacacctgtagtcccaagtactagggaaggaggctgaggtgggaggattgtttgagcccaggtgtttgaggctgcagtgagctatgatggcaccactgtactccaacctgggtgacagaggagaccctgtctctaaaaaaatagaaataacagataaatgggaaaaagcatgggatttggacttagacctgtgccatccagtataatagctactagccacatgtggctgttgagtaagtgttatgtggccagtctgaattgagatgtgctccagaggtaaaatgcttactggattttgaagacttcatatagaaaaatataaaatagcttattaataatttttatattacatgttgaaattacagtattttggctatattaaactaaatacaacagaattaatttcacctgtttcttttgaaatttttacaaacatggctactagaaaatgtaaaatggcatatgtgactcatatttttgttggatggtactgagatagatttgggctagcaacttggttggtgagtgtccatggactgaaggtcggatgatgtgcctgatgatgtgcctgttttgtcttcagtatgaaaagtcatacctagcgcagaaaggtagctcttgctttttagagtttggccctgcctggataggcctgccagctgcagcgccaagatgctgccaggatctaaaatgagttaaatattttttaatttgaaaatttaggtaagggacaaagacttattttagttgtcaacatatatgtaacagttgatttaatgaagagttggttgccctgaatcctgcaaggctgtcaggtgtctattgtgggcacagatcaagaccaggagtttctaactgccattgatgctgtcagagttaatacagcctttttagtaagactgttagtactaattggcatattacattctagcctcagaataatcatttactaatcaaaagttgaaaagtctggaatatttagtgacttatgaaataggcactgctgaaatagtattttggggttttctttcccagctgcacattggacagcaaatagtgtaagcctgctggagtcagttttcctagtgggaaatactggtttctctgtgaggacagatggggaaatgcgcgtgtgcatgcacagacacactgtcacacaccccatcagggatgttagtcctgaggccttctgggtttataataaagcacgtagtgccttataggaggttattttattaaagtacattccttaactcatattgacataaagtgcttttgtttattacctggttctcacaagagccctgtgagggaagttgagctgataggattgccctattttacaggtgaggaaacagtcccaaagagttatagagtatgttgtcgaaggtagcaatgtaaacaagtggcaaagcctggttgtctgcctcagatagcattgtttctaccacattgcactgccactgagtttgtgttattgtatagacaggtctatagtcttgcagttctgaaatctaggaagctctaaagaaatctcgttgtttttttttctttaaatttgccgcaagctcatgttacagaaaaaccttacctgaactgactccaactgtgattcctcatagttttctctgcagaaatattaagtatctgattacggggactgccccagaccctcctggtggtgtcctcctagtggtgtcaactaatacaaaggatatgtaatttaggctttttttaatcccgagaattccaaaatcaaaatcctatcttgtcccaaggattttggataacagagtgaggtcctgaaacccagtgttgcctattttgtttgctaaaatggaggcctggtccttttaacccagtgcaagtgcactgccaaggctttgtgcttaccagcgaccttctgtgtctgcttctctctagtatgttggaagatttctctcacgaattggagagcactcagtcccggctggacaacgtgatgaagaaacttgcaaaagtatctcatatgaccagtggtatgtatggcgtttaaagcttaagcatttgtacttaattctagaactctgtcttgggggtgttgtctcatagttatgcccatccagatccctttcttattttttacagatccctttctcttttttttgagacagagtctcactctttcacccaggctggagtgcagtggtgccatctcagctaactgcaacctccactgcctcctgggttcaagcgattctcatgccttgacctcctgagtagctgggattacaggtgcgtgccaccacacccagctaatttttgtatttttagtagagacatggtttcaccatgttggctaggctagtctcgaactcctgacctcaggtgatccgcccgtgtcagcttcccaaaatgctgagattataggcgtgagccaccgtgcctagctgatccctttcttatggcacattttttttttttgtgatgccttagaatcagagaatggaagacttgtatgtgcagtctttatcttctccttgtagctttaacttgggaaaagttaaggctttgtgatcccccaccgtgtttggtttttttcccagtagagtcactttcgttgtgtttttttttttttttttttttttttttgagatggagcctcactctgttgcccaggctggagtgcagtggcgtaatctcggctcactgcaagctctacctcccaggttcacgccattctcctgcctcagcctcccaagtagctgggactacaggcgcccgccaccatgcccagctaattttttgtatttttagtagagatggagtttcaccgtgttagccaggatggtctcgatctcctgacctcgtgatctgcccgcctcggcctcccaaagtgctgggattacaggcgtgagccaccgcgcccagcccagtagaataactttctttgcagttacaaaatccttctttattttactggttttttaagatttccttgccaaaatagggaacttatgtaaaacaacagttaagccagttactgtttctcctgaacattctttcattgatagaaaaatacctactacttcagaataagatggcatgtgtggatctattttaaattgttatgtttaaatcaatactgaaatatttcagcaaatttgcaccaggatgaggatgaataaacaattttcataatagttactgtataagatatgttccagtgactctttacatgggaaataatatattttaaattttaaaaaatccagtatctcttctttatctggtgggggttgcttggtggaaggagaaactgagatgctccttgaggtaatctgaatgttccctgactgtagagcacctcccttgtgttagaacatgccctgtttcttgacaccttttcttctgttggtttcctactgtcaggtacatgttataaggtctaataggttagctttttgaagcaatatttaaatacatatgcaggtttacttttcagaagtttaactcataggttacataacagttctctggggctcagtttcttatctgtaaaaatatgttgagtcctacctctccaggtaattgtgaggattaaatgaaataccagtaaagtagaagtgcttaactgcgtttaccatttatttattggtacttagtaaatgtttttaagaaattgtaaggcaacaaaaattgtaatggccccaaggcgcaatggacctattacatccaaaacaaagagaagctcctatctagagtcattttcttctttctctttagggacaagtatctttgtttctagcgggctcttcattgcctgaaactgtgcatatatgggaagcaggcaccagcttagttcatctgtcacacatttagagaaaggtttgcaaagtcttttctgattccctctgttctctcttctgccttctcccctctacttaaaaacaaaacaataaacaaaaaaaaggtgttttaatgaagaattgtataaccagtttaaactccaggcctctcactcatgtatgtagtagttgcaaagtcaagtagctacttcagcaccagttctgtttggggaagagcaagtgaacaaagatgcactgtctttgtttcccagcattctgggtatgaataatttagaaaagtacttgcattgtgagaagcgacccagtgtgtataaatagcactgaagtttgcttatgctttattctactttttcccaaaagaaaaattggggaagcaatgtaataactttggttatatttgtataggaaaaagagccaggaaacagagcatttatcctgaacggtgcttcacttttgacaggttgcttgtgttttcattttaatctttgcttgctacccaaagaaatactccctaaggacctcttcctgcttggtgctttctgcttcaatttgacaaacaagcaatttgtattcgtctctgctctcctccataatttttgcagaagttcactgctttagtaatcaaacctgtacataaaggaagcctatggaggcacagcgaagtgtgattaagtagttacaggcacacaggcggaccatctccgctccccgtggctgtctgcttcatggggagaaaccaaccaagactccacatttacttttttgaatgacccaagagagacactaattgtattctcctacccacagaagtattttattttaagtagatactgagatttttttccctcttactttccaacattccattaatcttttctctttaggggagaaaaatattttgagagagagaaaaaactaccattggagttcttttgttcccctctgactttttgaggcaggtcctgagcttgcaatgctgcttaaaactttccacttgaggtcacaagagcccctgtggttagtacccgttccttctatgcatgaagcctctgcgggaagtgctgagaagtctgctggggtaacagctccctggggttacctagttcatgcttcgtagaggcagcttagccacttcagaggaaaacggctttaaaagaacatcctcgggttgtgctggcttgtgtggtatatgcttctccttggtgaaaattcctacttaatacagttgtggaagagaaggtgattggagggtggtaggaggcatgagtagaggctgatggaaagccaaaaaatggaaatctggttcagtgttggaaatctggtgctgagaatagcgagatgcctgagggaagggggtaaacataggagtgtgtgaggttgagggcggggttggagaaggaatactttctccgtttttgtcctgaaagaatcgcaactaatcattttagcaaagtggttttaaattattgtaagcattttaatctttttaaaaaattaataaactatttttagaacagttttaggttcctagcaaaattgagcaggaagtacagagagttcccatatagcccccttcccccatgcataacttccctgactattgacatcaagcatcacggtggtacgtttgttacaatcagcctacgctaacacatcattaatcatccgcaaagaccgttgtttaccttaggattcactcttggtattgtacattctctgggtttgaacaaatgtataaatgacatgtatccatcattgtagcatcacacagagctgtttcactgccctaaaaaatcctgtgttccacctgtttatccctcccttcccccaacccccaaactactgatcctttgactgtctccatagttttgcttttccagcttgcatatggttggaatcatatatcacagatccttttcagattggcttctctcacttagcagtgtgcatctaagtttccactgtgctttttcatggcttgatagcttatttctgttttaacactgaataatattctattgtctggatgtaccacaatttatccatttacctactgaaggacgccttggttgcttccaagttttggcaatgatgaataaagctgttataaacacccatgtgcaaattagccaggcgtggtggcgtgcgcctataaccccagctacttgggaggctgaggcaggagaatcgcttgaacccaggcggcagaggttgcagtgagccgagatcacaccactgcactctagcctgggtgacagagggagactctgtctcaaaaaaaaaaaaaaaaaaaaaaaaaaaaagtgcaggtttttatatggacataagtttttaagttcatttggataagtaacaatgtatgtggttgctgaatggttatggtaagagtatgtttgggttttgtaagaaactgccaacctgtctaccaaagtggctgtaccagtttgaattcccactaggagttaatattgctccacatccttgctagcatatggtgttgtcactgtttggggttttgaccattctaataggtgtgtattgtttcttgttttaatttgcctttccccagtgacatctaatgttgaacatcttttcgtatgcttccctggcagctctttcatggtgtttttttttttttttttgagacagagtctgactctgtcacctatgctagagtgcagaggtgcgatctcagctcactgcaacttttgccttccaggctcaagtggttcttgtgcttcagcctttcaagtagctgggattacaggcctgcgccaccacccccagctaatttttgtatttttagtagagacagggtttcaccatgttggccaggctggtcttgaactcctagcctcaagtgatctgcctgccatggcttctcaaagtgctgagattacaggtgtgagccaccttgcccagccccatctcttttttgatgaggtgtctgttcaggtcttttgcccatttttaaaatcaagctgttttcatactggtgagttttaaaaattctttgtataatacattctggacaacagtcctttatcagatgaatcttttgcaaatattctaccccaatctgtggcttgtcttctcattcttttgacagtgacttcacagagcataagtttttaattttaatgacatcccaatttcaattatttatttcatggatatatagtgtctttggtgttgcatctaaaaagtcattgccatacccaaggtcatctaggttttctcctgtgttttcttccaggagtttgataattttgcattttacatttaggtctgtggatacattttgagttaatttttgttaaggtgtaaagtctgcctccaacttcatttttttggcatggatgtccagttgtttcagcaccatttgttgaaaagactctctttgctccgttgtattgcacttgctcctttgtgaaagatcagttgactgtatttatgtcagcctatttctggactgtctgttccattgatctgcttgtctattttcctaatactacattatcttgattgatgttatggtaagtcttatagttgttccacatttctggaatattctgtgccaggttttttttcagtctttttttcttttttcaggtttctgttgacaaattgtgaagctcagagatcctttccttagctgtgtttagcctactaatgagcccattaggggcattcttcatttgtgtagtctttttgatctctatttttttcattctagaatttccatgtctctgcctacattatccatgtgttcttgcatgttgtttactttttccattaaagcctgtagcatattaatcatagttttaaaaattcctcttctgataattccaacattcctgctgtatctgactctggttctgatgcatatgcagtttcttcctactgttgctttttcctttagtgtgccttttacctttttgttgaaaagtggacatgatatactgggtaaaaggaactgtggtaaatagacctttaccatagatggggtggtgaggccggggggtggcattttctagtcctgtgattaggtcttagcctctggtgagcctgtgcccctggcccgtgaacttcactagtgcttcccagtttttctactgttaggtggaactggatggctagagaagactggagttgggtattttccttcccccaggttagtcagactctggttagtttcttttgagggcagactttgtttagaacagagtgctctggagtatttcgtagtgattctttttcccctccgcctgctggaagcatgaggggatttttcccaatattcgctgagaacctggtcaagctcctggaggtaaaacccacagaagtgtgggggtccccttcgcctgggtccacctggagtgtttttgtttgtttgtttttcatctcagacttgtccacactgagccttcagcgactcatcaattaaagctaaggttttcctaccagaacactggttcctatggagtttgttgcttcgtgggtttctgctctgataagctgtgattctctgtatgcatctgtaggtttctgcagttttaggggcagcagtttaccatgtgacctcacttctctgatggatctaagaagagttttgctttttcagtttgttcagctttttacttgttacgacagagtgatgacttctaagcttcttacatacttggctggaaattaaaaatttaacatttttaatcagatgagagaatgccagttataaaagttttcttgaccattgaagtaatagttaaacaggtcaaagtgtgacctgcagtaggccatctctgccttccctagacctttggaacagtcctacctgagaacaacgagtgatggacctggggtctttgtcctgctcagagttaactaaatgagtttctagtatgtctgaggtagaccaaggtgatcaccacttagaaggtacttgctttacttataatttggtggcagttctcttgtccagttctaagactttgatatccataatatttaaaataattttaagtacatgttttgccttgtggagagtttagcagtttattttcatagattgagatctttttgcaacgtgattctcaataactatagtgtgctaaaatcagtgggctttcaaagaaactttagtgaatcaatatgtctttatatttctatttaaatggaactcttattcctagtggttgtactgcattttcatacgctagtgaattctgttatcagtcgggccctttgtggaagatgccaaaactcatcagtggaaggactgctcattttttctacatgtctccaaattaaggaagcatcctgatgttgacagcatcctctgtgccctaggtttgggtattgcacagtgtgtgtatgacagggttgtgttgtttaattctcacaacagccctgcggggcagctgttgtagagttgggaccacaggattgtgagctgcagcagggctcccccagggcctgtctgggcccttctgtctcacagggcctccctgctctcagccatttggatggactctagtcaagttgtttcctgtgcctgctgttccaaattgttggtagggcagaaagtttcagaaaaaacattccactttcatttacagaggagctgtacaaggtactttaacacagttactagttaagtaatcttacttgactaggtgtggtgtgaaattaatcatgctgtctcactggagcttgctttttcagctgtatatttcctgaagtgaccagcagtagctttcatctcctttccctcctcccgttgtgctcattgagaaaagaatgtgattattgtttaattaaatgacttgacttttatgggagattaaagcaggcaggctttgatctgtaacaccattgccaacaccttttttgaggatatgctaactaccagcagaaagctaagatccgcagattttaattaaagacttgagacacaaagcatgtaattattacgagacattttcaggggactggcaaagttgtgactgcatgcgaagtgcaggccaagaacagagcagcattagagcatcaggcacctaggcaggtgtaagatcatggccccgtcatttgcacgttctgccccttttctgcttcaaagggtgccataaattccatataactgtatcttggggaatgtggagtccctgtgagagctaatccccatgtcctgccttccagatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaa

SEQ ID NO: 13810 - DNA, 16547 bp, Human
  misc_feature (1)...(16547): n = A,T,C or G
atggtcagcaaaaatccatccagagagctctgctagtgaagaaagtgtgttatatggcaggaaagctttagagcaaaagtatgaatttgcagctttaaaaacatcctacctcaaaaagcattaattcatgaaagaaacatacattcataataaagtataacgtaaagcaatgcaaatattccaaatgatataatgatactggattatttgatgagtacctcattctattcttcattattatttacccaaagacgcaaaagttttcagttttgattggtgactaaagtaacaatataaaaacaaaaaattgttttaattttttgtacatgtacatgtaccaatttttttacacataaaaagttattagaattatctagtgattttagatatgtcctctattagtccattttcatactgctatagagaactgtccaagactaggtaatttataacagaaagaggtttaattgactcacagtttagcgtggctggggagtcctcaggaaacttacaatcatggcggaaggtgaagagaaagctaggcaccttcttcacaaggcagccggagagagagagatagcaaagggggaagagccccttataaaaccatcagatctcatgagaactcactcactatcatgagaacagcatgggggaaaccacccccatgattcaattacctccacctggtctctcccttgacatgtggggattatggggattacaattcaagatgagatttgagtggggacacaaagcctaaccatatcatgtccatagaataggctgttgttgaaatttaattttgattaccccagaatgcttcaagaatacagtgttttctgaatcttcagaggtggagaagtcttcctccctgtcacataatactgagataaacctttgcattctagaaaaatcttcataggccttcctttacatgagatatgacaaacccatttcaattaatatagcccatgattcaggaagttgtaccgagcagtaaattattttgctcaactcaggagtggagatttcaccaagtaggtaattgtgtcattcaaatacatgtcctggtattctcggtgttaccggtacaggattaaagcttgtcatgtcagttgttaaatgttttaaattaaaaaggaataatttgtatacagattatatagaaggctcatcctgcatggatagatgcaaaacttatccctctgcttttttattccattatctgtctataagtgatgtctctctgtaggatatctgcatcgtcttggactgggttttctgttccctgtgactctctcctcttcctaataccatcctctaatcccaaatgcactggttttaaaacacaagtctataactttttactttaagttctactattgctgtgttatatggtttggctgtgtccctacccaaatgtcatcttgaattgtggttcccataatccccatgtttcatgggagggacccagtgggaggtaatttaatcctgggggcatttatcctcatgctgctcatgttttttcatgatagtgagttctcacaagatctgatggttttataaggggcttacccctttgctgagctctcattctctctcttgccaccctgtgaagagattccttctgcaatgattgtaagtttcttgaggcctccccagccatgtggaactatgagtcaaacctcattcctttataaactatccagtctcaggcagttctttacagcagcatgagaacagactaatgcactgtggcaattgatattttgcatatttttccgtattaggtgatatgtggtaaaaagatttgtactgagtaaaacattagatgtgccttcacccctaaagctgctttgatcaagttaatttcaaatatggcagaatagaggtattcaactttttaaccctgaaaattaaatttatgtcatattttgatataaagcaaaggaaaatcaactttaatcaaaacatacttgttttccctctcctatacagaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtgagtttttaatcgtacttctaaccttgtcactcatccccctatataaaataagaatcaagaagctatgtttattgcattggagtctgtcttttgtcacacgaaattcataacctgtcattttaatttattttagaatattatttactacttttcaactataaataacattttcctagaaaagtattaagtggcactctctcttgtctcccaaagtgtacaaggcaacccaaatcaatattttactgatttgcatagtgtgttttctacaaattcttaagaaatctttcaaaacttgaattattagaatttaaaaacattaactctgatctgagttaaagtcctcaataagagcaagtgatcatttccctactcttaagaaagaagttaaaagtatgattggcaaatatctggaacatgagctttgtaagctcttgctgcatttttatttatgtgtagactcagccatcaatcactggcttcttatgaacagaatgtgagaccaatcatgctgttttccaagataagagagtttaagtgagaatcacaaccacttccttctcctatgctagacgctattgacaggaataaggatattgtgacatgtgagatgtgtagcataggcacagaagctaggccagatttactgccaccctgggtattcttgattgccaagatggctgtggcttccagttgatgtcacaaatctactcattccctgagaattgggaaagaaaacaaaagaaatggtaactggaagccattgcctgggaagttgaatcacggtttttttataatgtgctggacctgatctgaaagtcaatacatggttgtgtaggcttagcaaactccctgacaacccattcagggttttcctgccttctctcctttccagtatctgggtatatgtcctggcagaattttccctttaaaacgtattcactaaactatacttaaggaaactgagtaaatattacatcttttaggctttgcttaaacaataaaaaggccagaatttttttaaaaaaaattaaacttacctaaaaagagcctttgactaaatgattagtgaagaaaggcttgaaatgtcctgtgtcaacttattgagaaagtctgtgcatatttcatggctaagtcattttgaaagtccatttcacagtaaaagatattcggatatttgtaaagcactttactgttttaaaaaaactgcttttaccatctgtgatttcactgaagtgtgcagtttgaagtaactctgtaaatcaggaaggggttatgggtctcaatttagagataagaaaataagactcaaagaggttaaatgaagagtttgtatttgaacctagaacttgggtcctaaatctgatgtttgctgcctcatgaggaaatgacagaaggtgtctaatttaagtttgcaatatgcctaaactgtgttgaaaatcatacttgcacttgacatttaaaagtgagagtacatgtgataattctggaaaaaaataaagcaaatatttattctgcactatgaactttgattatagtaattgagaaaaaaacatgctgagtgaacccaaagaatttgagtgctgacaaaatccaaagcaacctcaactaatgaacgttgtatctttcaggtttataatgcacaaggaccgaatggatcttcagggaaagcatttaaagtgcatcttcagctttgggacactgcgggacaagagcggtaatagtaaattgctttatttgtggctacacatagcttagaaaaacttactttaaaatgaattctgtatgtgaacttgaaaaacaaataatattcaactcttctcctggtttcaaaatagacatttgtatccagaaataaaaataaatgatttgtaattaattaatcacagtagcactgtgcagttggtatgaatttcaaaaatcagactttcaaaaatctctctgaagattcttgctatgcactgtctttgcacttcttagaaggaaaaaaaggttctccagaatttaattgaatgaagatgggaaattaacgccgttataagtgctacttgaagagggagttgaagaaagggtgttaagatcttccttgtctctttctgttatttcagcacagcctctttgtcccatgccatgcgactggctttgtcctttcagactttgatcttaaaacaattgccctccagctagaatattttactccttcccactttttctgatcctctccttgtaccaggcccagctcatatttcttctcttctatgaagcctgtctgaacatcccagctgaaacaaactcccacttttactctgaactactgcagacaccggttatttcacccttaaggtctaaataattatatgccaccttgtctgaaatgaacattctatttgtatctttaactgttgttcactgattcacttggggccttctcactccaacaaaattgtcatctttacaggtgtggagatcttgcctggctttccagcattgtctctggtacagtgtccaagctaatactcggtagacagtagtgttaattccttagagctggaggtactattccattgttagatggaaaaacaaaagggatccaaaatttcaaagtgcaaaagaccccaagctaatgaagcttttcaatattagattaaattaaaagtggcaaaaaattggcagagaggatatttagaaggcacatacctccaaatcctgcatcgtgtgtcttagaatgcttatgcttgtaaacacttccatctttgaaatgcatccaaagcgttctcgcttttagcgagtgtaaatgccaggagaggtgctgggccctctctgttagcttttttgactgtgaattccatttacacacacccttcaacactgctggttcctctgaagccattcctcacaagaatctctgttcatatgtcagttttgttgtcacaaagatgtatgttttacagagcactttaattcatttttgaagaagtaatatgagaaaatgtggttcccatatgtcctcgcacatgatatgtcagccttgcatgatggcagccttctctgtctgtcccctgaaggcagctgctgtatgggggaaatggggaatactcagggcagccttcagaacacttgggttattcatcacttgagaattttgcattctgtgtatatataaggtgtaactaagcaacaagataaacaatgcctcacacctcagccctgtgcctaaggacatctggctgtgcaatccatgtaagataatgggtattgatagaagtcacatcatgggaaggaagagaaaacacatggcccttaaggaaacttaaaggatacaaggcacagacttcattcccagtgagggggaggagtgataatgtagctttggggtctgtttcttctgtgaacctagtgttctggagcaaaaggggctcatcactcaatgcgctagaagccaatactatgacactggattttgagaaaaagaaaggttttattgcaaatcgacttgcagggagacaggagggtcaagctcaaatctgtctttttgttctggctttttgaagtagtagttttattagaaaaagttgtggcaggggtgggttctaaaggggagggctggaaagtccttggacgtgggcagttatctccgcattctatctcaggggtcacgtgtggaaattcaaggggagttagtatgaaacatgtggtagaaattcaggctgtgacattagcaagctcattctgtacagattccagtcggccatatcggttccagtcgatttcagccagttctcttatcttataagcagagggagtttcagtgtttcagcaagttatttccttctttatctgccatcctgcaaactcaatttctgttcatcattggtttctgtaactctttggaacatggtttcactggttcctccaccctgctgactcaatagacagaatgagatgggtgggggaggctggaaacgaattacttgtctccccgtgggggaaatgggggatatcaaagatactggacagaatagagcaagatgtctgttactgctctggaacaagcgtgtcctatccatcctgctggggaggagaaattgtttgccccaaacagatcactacagcaagcatgtttttgagtaactttgtcatacgctctgggcaatgagagggaataacacacagttttgttctcaaatgagacacacacacttaaggagagaacaaagagcagttttcctggcatgacacaattatggtcaagtaggagacaattttgtgggtacagctagtttccaaagagggagaattattcaatcaaagcactataatctctgtgggcttccaaggaatggtagaaacaaatccacaagaaaaaattgaataaatttttttggtatttctgctctacagttttagatcatgatgatgccctacaaacaaatcctactttggaaataaatagcagtgaaaatatctcttctcccatcttttggtatgaaaagtatcattctctgttgcagtcatttaaaatatttaataattgtatatcttttactgtttctttctttcacttgcactgtttaacttcacaaatatttagtgagcaaataccaggttctgagccatgaaaatatgatggatagcaagttagaaacacagctcccttccccttagagcttacagtctagggtagaatttggatgaataaacaatcgcaatggagccttaggatactaacaggaaaacaaagacataggcaggcccaccaggaggagcgcatagcccacatgcagtgttgggaaggccccttcgggaagtgttatttcctctgataccattatgtatttgctcatgcacaatgtatgagtgagtgctatccaggctcaacgaaggggtaggaagaaaaggaagcactaagactaagtaacccacagaaagaccagcatgtgtgaaagcccaggggagcagagtgaactttctaagaactaaaagaagatcagcatgtctgtgggtagtcaaagggatgaagttggatagatgaacaaagatcacttcctgcagagccttgccagctttgtaaggagtttgtgcattaccttacgagtgatgtctaatcattaaaatgtcgttagtagagcattgatataatctatgggaagaaatggagtggtgataggagtagggtcccaaacaaaactggacacgggaagcctaatcagaaagctgttgaagttgtccaggtgagagagaatgggtttggaagtagagtagtggcagagtagatggccagaaatgagaaggtcgaaagatatatgttaactgtagacaccaggtgaaggaggaagggatcatggcaaccagaagggtggtgatgtcataaacagaaaaagaaattaggaagagtggccagtttggttttggatgtatgaagttggagatgcctgagtttccaccagctggaagtatccaacaagtaattaggcatctaatgtgaaaggcagggaacatctggatctctaattttgggcttctcaacacacaggctacaaatgagccacggaagtggataagattatccagtcaatgtatatagagtaagaggggtcaagaatagacctctgaggaaaccaacacaaaggatctataaaaaggctaaaataggagaccaaaaattagaagaacatttaggataggaagcgatatctctagttcaaagttatgtgcctttctaaaaacccattgccaaattcaaaaccttctctggtccctacatgtggtctctggttttgcccattgctcttattgaagtgaatctcagcacatctttaacttcactgaagatggttggtggtggctggggtcgggggtgagggcatggaaagctgaccaggcagggaaaaactttgcattgcacacgaaagagcaaattctctaaaatcctcattagaaatgagagttctttccttctttccccaatgactatgtctcttttctgtcctgacccccactcagtcctccaatcatcttccttttcctcgtgaatcctagatgccaacctgaagctcagttttacccccaaacagtgctttttgaaaagagttttgtcatcaatattcttccttacaaaagaattccaattcctgtagctaacaagttgcggtttccttcatatcatcacaggcattcattttcaggctactgtgtgccaagctttcttctgggcacagacaagaaagatggaaagtataggttaaagtccccactctaaagtgctttacattttaaatgtggaccacaaaatgcccacgagccaaaaagattccaagaagctgtgtaagcaaatccatgattgaatgttacaaactgtgtgtataaagtgctgtgagatcagaaagccaggaagtggtcttaaaaaaaaaaactacaaccaaatcttctctcttggttcttcagcaatttctctgcccacattcccatttccctaagatattccataagggccagtcacggagaattcatacctgaaagggaaactgttatttgtgttgttgtcaaagatatgtggactaactttcagaactacccactgtgtttccttggcaggttccggagtctcaccactgcatttttcagagacgccatgggcttcttattaatgtttgacctcaccagtcaacagagcttcttaaatgtcagaaactggatgagtaagtgggactgagtaatgtgcattggccgctttgggactcaactgctttaggtgcttgttggtcttgcaagatgaaaccagattgggtaccacagattaactttcaaagtcatgagtttagtgttgcctgtgccactgtgtcaccttcaaagtggtggcctttatgtggaccaccctaggtagcttggaatagtattttctaaatatctaaaaattgatatttttagaggaagcctatgtagctttatcaccacttgtatttaagatctttattattgtcattgaaaggccattgattccacttttccagtaagtcttgaaggacttcttaaaactaagtgagctactacatttgacctggagagatcacagggaaaatcggcagtattttctgaggggacactggcactgaaggtgtgttaaacactagtgggttaattaggtgtgaaaccagagcagaccagtcgcatgatgataaggtgaggcatagcacagtgtgtcagtcagtcagctcgcttgggaattttacttttaaaaaggggttcaaatgtgaggaaaccatgtaaagacaaatctccagcccctgtggaaacttcgatatagtacaaattgaaatgttgcctaatcaattactaaagtcatattgacatacatcaccacaggagagaagtattggaattttcctttgttttacttgatgtcataataaagggcatatttcatttgtattttttattacaaataagaattttgatcctagcaggatatacaagtagcaggacagctgagtcgtcctatggggctgctcttatcatttccagatttgtctgggccatctgtagctagagttgtattttttaaaaactagatcatgttattttcctgctcagagtccttctgtaactttccatcttacccggaataaaatccagagtccttcacttacctacaaggtcactgtgatgatgtctgggcttcctccgtaattccctcttacttgggccccgttcactagccttcagccaaactgcctcacatgctattcccagtatgaaaatcttgccattccctttatcttttttctcttctctcatttacagccctgtgctagtttcttcattcccttcaagttctggccaaactttatttacctcttgactgaccactccatctaaaatagtactcatcactgtgtatcccctcaacacactttataggtcatggccatcacctgataatgtgttatgtattttttggtttacttgttgtgttagttcattcttgcattgctgtaaagaaattcctgagactgggtaatttataaagaaaagaggtttaattgactcacagttctgcaggctgtatgggaagcatgttgctggcatctgcttggcttctggggaggactcaggaaacttacaatcatggggaaggtgacgggggagcaggcacatctgacatagcaggagcagcaagtgagcaaagggggacgtgccacacacttctaagtaaccagacctcatgagaactcactatcatgagaacagtaccaggggatggtgctagaccattcatgagaaatactcccccaggatccagttgcctcccactaggccccacctcccacattggggattacatttcaacgttggacatagatccaaaccatatcacttctacacccacttcaagttttacccaaaccttatttgtctcttgactgaccaccccatctgaaatagtactcatcactttgtatcccctcaacacgctttagagttcattcagtcccagccatcacctgacatgatgtgatgtatttttggtttacttgtgtttttgatgctttctaccactagaatgtaagctcttatgagagtgcagacttttccattttatttcaatgcaatatgccatacctgggtgagtgcctggcacagagtagatgctcaaaatagatatatttcttatcactacatattatacaaaattgataatgtattttgtatataattcatgattatatataataattatatagaaccactctcggtgtgggttcaataaccttgtaactaatggggaaacaaattctgactttcataattgcttctccaaatgaacgtttatcttaggatctgtcctttatttccatttaatattgtatttcattacccaaattttggtggtagctttagattcccaggagacaaggagataataagcttattaaattctttcagagaatggtttgtttatcctttttcaaggcagatgagagtctcccttgtttttaaacgtctccagaaggatattgctgagatttaagataattaattgtcatgcctaataacactttaatttttaacacccaagtaattggtgttacagggttagcctttctttgtcttcttcctctagtcttggcaaggtagcacacagcatgccttatgatagacattagagcagcctctgtaacctcaaaaacacagcttgacaggtttcttatatttttttccctttttttcttaccatgcccttcctgccctgccctgccctcccctcgccaactctccctccctttcctccctccctccctccctcccttccttcnnnnnnnnnnnnnnnnnnnncagatgccagcaacatgcttcccatacagcctgcagaactgtgagtcaattaaacctcttttctttataaattacccagtctcaggaatttctttacagcaatgcaagaatgaactaacacaacaagtaaaccaaaaaatacataacacattatcaggtgatggccatgacctataaagtgtgttgaggggatacacagtgatgagtagtattttagatggagtggtcagtcaagaggtaaataaagtgtggccagaacttgaagggaatgaagaaactagcacagggctgtaaatgagagaagagaaaaaagataaagggaatggcaagattttcatactgggaatagcatgtgaggcagccctccctccctcccttccttccttccctccctccctccctcctctttctctctctctcctcccccctccgcccacacatagtgttttttggagaaaagagaaaaacaaattactggtcttaaaattgtttctacatgaatttgtagtgattaaaaaatgctccacactatagatcatcatttcggaggttagagaaaggaaaggtaacaacttcctaaaggaaaaaacaaatttacccacttaaaaatcatgttctatttacctccatctatatttgaggaacaaatggtgtgaagcagttatggccatctcagggagcatttccccagatgtattccgtatttactgaatacttactatgtgctagcaacttggtatgtattattagaagatatactgtattattagaagaaatccccttatttattattatgtatgtgtattatgtattattagaagaaatccccttaaccaagaatagcacatggattgaaaagatcttccagaggaatatatgtgatgttttaatgaattacttaataataaaagcacctaacatttactaaatgtttggtattgacagaggtgcttcatatatattattagaagaaatctccttaagcaagaacagcgcatggattaaaaagatcttccaaaggaatacatatgatgtattaatgaattacttaataataaaagcacctaacatttactaaatgttgggtattgatacaggtgtttcatatatattattagtccccttcataatctgaaatttgtaaggtgttatctccgttttacagataagcacattgtgactgggaagaggaagtaacttggccaatataactagtaagcaaccaaactggagataagcaattagatcaggaatctggaataagagcagtcatttgacatcacttatttatcaataacttgctggttccatctgctttcttttcaaggccaactgcaagcaaatgcttattgtgaaaatccagatatagtattaattggcaacaaggcagacctaccagatcagagggaagtcaatgaacggcaagctcgggaactggctgacaaatatgggtaagtcagttacactgagatggcatgtgacttgcacactgctgttcaacaaatggagcagagacattagattgatattagaagaaatccccttaaccaagaacagcatgtggattaaaaagatctttcagagagatatatatgatgtattaatgaattacttaataataagagcacctaacatttactgtatacctataatgtgctagcaacagttcctagacattaactcattttaacccatcataactagagttatctcattttatatataagaattgagtcacagagagattaagtaactgatggaaggccaccccacacagttagtgacaggcagagcttaaactcaatccagacagtctgatatcaaagctcatgctcttaaacactgtattcttctgcctctcaatcaatagatgtaaaactccaagaaataatccctgacaagggtatgaaaatgtggtctttatcccagctgagcttgaatggcagcttaaaaaaaaaaacagaaacaacaccccatgtaattgtaaattgacttccgtggcagaatctgtcattattctttaaatttaaagtagttttatcatatctgccaattttttatggaagaattctccctaaaagctgtacaatttacacgtctttcttgaaacttttaaatccaaataaacattgactgtattcacacaaatatccttattcaatgcatacctattttttaaaggagatttccagataattgagtggaagggaagcaatattttaatagtaacattggtcagtagttttattgatcagagggtatttttcccctcctaatttttttaaacagtgataatgccttggcttcaacttcctgactacctcttgtgtcaatttccttgcccataaaactggttgtaatcatactaaagagcagctcaccaatttttactcactgaggaaaaaacaaggatgctttccaacttagccagcaaaaccataatcatttcacaatctctcagccagccgtttttgcatgtgtgattcacttgtacatcttgctgtatctgttctgatttcttcctctcaaaaatatttgccatcctttctatgctagcataccatattttgaaacaagtgcagcaactggacagaatgtggagaaagctgtagaaacccttttggacttaatcatgaagcgaatggaacagtgtgtggagaagacacaaatccctgatactgtcaatggtggaaattctggaaacttggatggggaaaagccaccagagaagaaatgtatctgctagactctacatagaaactgaacatcaagaaccccaccaaaatattacttttaaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagatttcccaatgtgatctcatcatcatggatactcaatttgttttttcttatagagaaaatgagtatataagacaatatacaagaagaaatatcagtgagttttaaatcagaacaagttacctgtcacattgaagaaaagggtaggcactaaagggagaacacagaaagaagaatttctaaaatattggatttacttcttatattgagtcagatgcatacttttagatttgcattggggaaaatgtactagctaaaaatggatacacaatgaagaattctatttggctaattaagaatgatatactatgtacacccaataagctgtactagaatgaataaattactgataaggttacaaataggtaaatgtcacacttctgttaaaatgtaggagatagtgtcataatgccgtctttatattcttaataaatagcactttgacaagaacaggactgtaaatgacgaagtacaagacaaataccctgggaaaaaaaatgaaagtatgagaaattggcatttctacagctgaaattcaatgtatctgttagagatgtctggaagggttacttagccaaattttactcaagccaattaggagctgatattatcagttggaattaagagaactccagaggtttccatttcaaacaaaattttagaaattggtttggtgttcagcttcacatttcattttttcttagcacatgttgataaaatagtcacaaggagaaattaccagttacggtttattaaatctcttttaaaatgcagtcaaggaaaactagccttgaattttttttagataaaataagatggtgatatgaaacaaaaagtggcaattattgcaggtttccttttagtttacaaaagtactggaaactaaatcatatttcttccctccaaatttcacccattcctgactttgaatcaattgcagaaatgcaggtgtgttactttgttgatcaataactttggaacaattatggatcaattctatggtcactctgaattttcatgtcattaatcacataaaaattgataatacctcattctgtattacaatatgattttattttgccaaaggcaagacacctatagttgagctgtattttgggggattgggtgaggaaggacttctatcttatctcaacaaaaaactggccagtatttttgttaatgtaaagcttccttttctttctaaaaaatagtaacaaaattatttttcattggcctattctgttcttgtgtctaaactaacattacattaatttttaatcttagtttctgataaacacaagccattcctatcaaaatattatttatttcagtcaattttaccaaataacaaagacaatatattttcgttttttttttattatgagcatatgattttttgacaggctgtttcctcgtcgtatagattttttccaatcaaacctactttttccatactctgtgcatattttttgtgaagttatacacattgaagaccctaaaaatcccagtccatcattcagcttacctctgcgaacttctatctggtattgaatcagtttcagaaacacagacagatccaaggaaatgtctctttataatgttcttaggatggactagacccataaatgtgccatgaatcaaaatattaataatttgaaagctttcatgctgttagcccctgatgaaattctcagcattaactggccagctcctctgatttctgcagcatcgcaacaggttcgaagatgggttgtggctgggtattccctcccatggtgtttcctctgggatgctcttcattatctcaatgcctgtaccatgaagatagaaaactgtaagctaacatttaagatgtttcttctggaaggaaagtgagcaggaacaagttatattgccactgctgtggcaaattttggtgaacttttggggtcattatatcaattttttctttggattcaaattgtaatgtcccctgcatttccttaatagggaatgtgaaacctttataaaactctaaaagtattctgttttgatatgtctttttgtttctattcattttcagttatatgattgatttacttatgccaag

SEQ ID NO: 13811 - DNA, 11387 bp, Human
ctcttaaccactatggaatactgcctctactgtaactattatacccaaaacccttaatcctaagtcatcaaaaggaagagcctctattttacacaatgaagaggcatttctaagaatagaaatttagggacgagcacagtggcttactcctttaatatcagcactttgagaggctgatatgggaggttcacttgaagtcaggagttcaaggtcagcttgggcaacatagtgaaacacagtctctacaaaatatttaaaaattagctgggtgtggtggcatgcatctatagtctcagctacttgggagacagagggaggaggcttgctcgagcccaggagttcgtggctatagtgagctatgatcatgccactgcactccagcctggacaacagagcaagaccctgtctctaaaaaagaaaagaaatttggaaatggtttattttgtattaacaatttataatttacactgaaatttattatgataaaacttttccctgtgttaaaaagctattaactttatgaaaaatttcttttaggtaaggttgattatatatacccacacacatacacaggttaaaagttagtttcatgtgacataataactagcattttgagcactacctgtttgcccagcactgttctaagtgctctacatgtattattgttaaattatcataacactatgaattatgtactataattaccccagctttacagatgaggagactaatccatggggaggttaagtaacttgtccaaggccagacagctagagccggcttttggacccacaccacagtctgactccagcacccatattcttaacaatttcaccatattaatatgtcaagattaagcagttttaaaggatgctattttctcacaaatttcttaatatgaacactcaataagaataatcactaatataagcatttagtatttttttaacactaagttggaagcatagtggaacatttatttttagaaatattattaattggctgggctcacgcttgtaatcggctgggctcatgcctgtaaattttgggaggccaaggtaaaagaattgcttgagcccagtatttccagaccagcatgggcaatacattaagacatcatctttaaaaaaaaaatgttattaatctcctctttttgttaaatgtatattatcaaaattgttactaagctaacaaacttcagaaaaacttatgatgggcaagctgcttgtgacattgaaggtatttaagattcaattctagtttggtcctagatgaccacatatccattgttccttcaacgagcacatggtaaagagcctagaacacagagacacagaacacagtggagaaaagggagtgaaatgtctttaatgacacttactatatatgggattttgtgacaatatacaaggatggttaagacatataaggtgatgcaaaaaaacatattaacaattatagtgacaaaaaatgaggagcatataattatacattgatttatacagagtaccagaggaacacagcattgagagccgtaacaccacctgagggagtggagaaaggcttcagagagaaagtgttttttggaatggatcactgtttccaaaagaactaaagtacagtttgagaaatgcatacttaattcattacttttttcccctcaactttaataataaatttacccaacaaaaaagtttatttttgacttgtaaatctcttaaaatcataaaaaagtaaaattagcttttaaaaacaggtagtcaccatagcattgaatgtgtagtttataatacagcaaagttaaatacaatttcaaattacctattaagttagttgctcatttctttgatttcatttagcattgatctaactcaatgtggaagaaggttacattcgtgcaagttaacacggcttaatgattaactatgttcacctaccaaccttaccttttctgggcaaatattggtatatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaagtaagtagaaaataaagagggttcatgtttatgttttcaatgtggatcttttaaaaaaaatatttctaaggcatgccatttgaaatactttgttgcattgttgaaatacttttttttccaagaaaaataatctccagaaaataaaatttcctattataatttcaagttagttttttgtttccctaatgttatatatgaaaacactgaaaatttgcattttatatgaaaattacaaatcggttaaattatacaatctagaacactatgtcattacactattgtaaattactgaaggtaagtaaaaagttaaaaaaaatttaaaactattctccagtgtttaaaacagattaaataatacagtaaatggaaaagatttattcatatgaaaatatgctgggctttttcttttaattgaagttcagaaaatcaaattttagagatagtacaatttaaataaaatgttaaggacaaaaatatgtgctatttgaaagaagcatacaaggggaaggaattgccaatattcatttttcaaatccattattagtttaaaaatttagattatgatagtgttacaggaaattaatagaaaagaaagaggaaagcaacttataaccaacctactctctatatccagacttttgtagaaaaacaagataatagcatcaaagaccttctccagaccgtggaagaccaatataaacaattaaaccaacagcatagtcaaataaaagaaatagaaaatcaggtaagtcagtattttaatggtatgtcccatctttcacacaggtctgtaaaaacactgaatcctaaaattatttacaagctttaactggatcatgagtaaaattatcacatcagcataactgttaaaattgcaggctctgaagctaataaactacctgcatttaaaccatggctctaaaactttgtgtgaccttgaataaattacttcacccctttatctctcagtttcctcacatatactacaaagataataacagaacttataggattattgtaagaaaaaaaattaattcatagcagccaatgtcatcttactaaaattcaaattagatcatgtttctctttgctcaaaaccacacaatagctttccatttcactcatattggctctttagaccaagattacccaacccttcgtcatctcactgacttcacctcctctactctagttattctgaccgctttaccagtattcaaacacatcaaacatactgccacctcaaagcctttgcccttgttgtttcctctaactggaacgctcttctgccctggtatctacgtggcccactctctgatttcccttagggtcgttatcaaacaaaaaattcccaatgaagacttacaaggtcacttaaccaaaaatcacaaccgcctggtcccatccctgaaaacttctacttccttagctacttttctcctgcacactcacctttatttaacataacataaattttagttatttatctcttctattcctgcactaaaatgtaagctctgtgaatacagggattttttccattatcttcatattttccattatttgtatatactccagaatatagaatactgtatggcacacagtaggcatttctgttgaattaataaatgtaatgtcatattcacacagaagcgtgtgctatgattattattacttggattactagaaatagtgtgcctcataattaaaggtcaacattcaacaatgtaattaatctacaatgtaaacatctggtgaagtgacagagggaagcacttgtttagaaaaaagctatgtcagaatccatgtattctaatatgcagtacaatagtttaaaaatattaataatactctcaaacagctattcaagaggattcaaaaaacataatataaactcagagaaactggtaaacaaaatcattttcaagagatataaaacaaatattattaccaatttccactaaacaaacataatgttagtagtgctgctaaaaggttttttatcaactacttttggtttccatactttccttcttatgatgttattattctaaattcttttcaattatatcttttactatgattaaatgaacctgctccccaaagcaaaatgttactatagtaatatacattgtgtctaaaaataaaaatgtgtgaagaaaccaaaacaatgaatttctgagttggaagaagagttagatcatttaactttctcatatttaaattaaaaaaacaaaactctaaaaatttaagtaactttaagatcacatagttacttagtagaaaagagtaatacccagcaagcaaactttacaatagatccttttaaataaggtcctaggaaatatcattcatgccagcatcaaaaaactaacactaataatgcaagatattatatattctgcttttcttactgtcaatgagaaaaactatcattcaataaattgcaaacccaacacacttaaataaaaataaaatgttactgctaaactaacgataaactactgaatatatagaaagtaagcaaacaaacttgccaacctgccaacatctacagatatgtttacaggtcaaaaattatcaaattatcaagaaagcctggttcaaattatgtattatgtctttatcacaggtctgaagatcagtaagacctaaaactgaaaattattaaacttaaaatctgaacagaatatcaaatatattttattcatataaataaaagaatacattacaatattctaagcaaagcagtctctacttttggccttgctctgttttccgaccaatgtctgcttttttgccttgctttatttttttatcttattaaataatgtccctgattaaatattttgagaacaggtaatctgtacaatctgaataacactgtttatctaaatatcaaacaccgttataacattatgaactgaaagacaaactgtacttctgacatccttactcagatttcccctaattgtatattcagtatcattttaaaaaacagatttatattcttttatcagctcagaaggactagtattcaagaacccacagaaatttctctatcttccaagccaagagcaccaagaactactccctttcttcagttgaatgaaataagaaatgtaaaacatgatggtaagacactttggtgggtttccttcttgaagctattattatcaaattccctattcttaggacttgttctagactaaaagatagttaagagatatccatcaaatacaatgtatcaacctaaactggatgctggggttctttttacaccctataaaagacatacctaagacaatcagagaaatacaaatatggacttgattattagataatatagaaggtttattaattttcttagatgtgatcatggtattgcagttttaaaggagaacaatctcctgtttaagagatacatgctgaaatatttacggagttaaaggtcactggactccagactggtgatagaacaagactctgtctctaaaaaataattaattttttaaaagaaaatagtttggtaagatgattcttacattcttaaataacacgccatctaagaaaaatgctttaacataaacattactgaaaaaatgctacatttgccacaacttcataaaatgtcaagtgaaatctcaagctccaaagatattattcctattactaaatctgatgtaataacattttattgattctaggcattcctgctgaatgtaccaccatttataacagaggtgaacatacaagtggcatgtatgccatcagacccagcaactctcaagtttttcatgtctactgtgatgttatatcaggtaaaacctgtctaaggagaatagacagtagttagttcaacttactcattacgtattaggaagattaacctggttatcattgttttatacatatatatatgaaatatatatgagtattcgtataaatataatacttttaccttgtttatgtatttactcaatattctccttttcctctaaaataatctgaagtgactattatcaataagtttactatgccaaaattcattaattgcctttcacttaacttttgggaccataataaataataaaatgtattgccataacattaataaactaccttacaaaaccaccaattaaaatcaaacaaacaaaaaagtgttatttacatctgtcaacataaatctactaaaaatacatgatttcattcattatattcaggtagtccatggacattaattcaacatcgaatagatggatcacaaaacttcaatgaaacgtgggagaactacaaatatggttttgggaggcttgatggtaaggggactacattcaatcattcattcacttgctaatctacaaatatttactgagaacctcttatggaccaggtattaggaaaagtagtaacgaacgagaagcagtctcagccttcatataatttattatcaaacaattacacatttgttagtaaattacacttattacaactgttattatttgaattatatttatcacaattacatgtctgttcttaaatatacttatcacaatttaattccacggcttacaatgatcataactataattattaaagacaattttgattaaatgttatgtcataagtagtaactgttacaaataagctgtgaaaagaaccactcctagcattagtcactctattctctcattaacgttttacatatcaattaattggaagttaaaaggaccaggaaactcagacatacagtatacattttaaaatttcaattatttaaatataatatatagaatgtatggcttataatgaattagttaactcaatgcaaattattctattttgattacaaatagtaaaataagcaagataaaataacagatgtttaaaatccaaaaagcacatacaaaaatccatgaatgatgtctaagtactcacttataaagtagaagacattcattattatatcaaatttttaaatgctcagtactatttgaccatttaaaaattttgtattcaaactaccagtgaaagccctacctagaaggtatactcagtgataagttttgtagctccaaatcttctaatagtgagtgtaaccccaaaataaaaggctgacaggtaagtcgagaatactcacttaattctggtaagaaagcaacccatttgtacttgtatttaccagcaatccttaaaatgaagcttcctactaactcaatagcaataagacaatagtgaatgtttaatgaaaacagtattttataaatactttaataaaaaggattgtgatgaagaacaatctatttatatttgttatttgtttttaattccaataaaaataatttttaaaattacagaaaaaagttattaagaaccatgcttttaaatttaaaatgattttttaaatttattcctgtctttttctacaaagaaagcatacattaagcaaataccaaaggccaggtttacatttgaagaaagtgacattattattactcaagtctctaggaatacttaacacatctcttgactgtatatggatgttaataaatagctgacagtaaagtttatccatataaagacttgcaaatattcctctaccaatgacgagactttaaaatatctataataatgtaacacatttcactggtgaaacatgtcttgtcatatgcattatagaaaggataatcagactttcagttatattaatatttttaacatttttgtgcacatagctatcttcaataaaattgttttaaaaggtattattttaagatacactaaaatgatcaagggattcaagactaaacaactcaattagttgcaccaataaaaaacacttaaaaaaactgtcagtgtccaacctgtacttaataactcacagatttttaaaacttttcttttcaggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggtatctttttctgataccaatactttattttcatatcttcaaagtatcttcccacattattagctattatctgcaatgacaacttttaaaaatccgaatcccaaataagcgttttctctctagacgaaaacctcttaactataatgaaagtgttcattctagttcaatcaggtattttacctctaatcttcctcagattttctattttttggtagtgtatagattatttatacagattatttaaaattgggacttatacagattatttaaaactgggatacatgcatctaaaacactgtaatatttataagaaaggaagataaacttacggggaaatacagtaacagtaactacatacgagtctgtacccattaaattgcatatctatctcctttaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaaaaaaaaaaaaactctcataggacatgtttcattttgttcctttcaggagtagtaaattagacgttttccccatataaagcttttttctaccagaaagatacttctggtagaagaagagaaaggagctctttatggttcacacgactgtctcctgtcctaactactttgcttaaagtgctcaaattccatcactactcacagttgtctaatctaagtctaatcccctttgatctctcagactaccttcccttttatctctctactacttaataataagaatatctttttttcaaacttgaccttcattttgctttcacaatactatactctccatggattatcccttatctgaatccatctttataaccctattcctttctcatatttagtactgtgggccaatggacaaccttcaatcatcttttctacactgaccctcagacattctatctgctctcacggactcctttatttaccatgaataaagttccaaaatctacatattcatcccaagtctctttccagttccccttcttacattgcctatttgccatttctcccttcaataccctatacttcactcaaatt

SEQ ID NO: 13812 - DNA, 15648 bp, Human
cagaaaggtgcaagaaagttagagacattcctgcatatgttctttctcaaattccttcagttcaaagtattcaatatgtctaggtgccatatttttgggtagcatgtcccaaaccccgtcaggtggtagaagcagaggttgtgagaactcgttaaattcgctacatattttgaagattaagccagtaaggcttgttatataagatgtaaggcctgagatagaagactcaggtatgagtccttagcctgagcaattaagagaacgaggtaactgttcactgcattaggtccatgggatatttgtttttatttaattatgtacttaataattccaggctattggttggacacttaaaaaaatttatacgataaaatacacagctcttaggagttcatcccatgaactttgacaattctatgtatcggtgtaatatttccattacctgggcaaattccccttcgccgggccttaagcataatctacagaaaaaactacgtacataaatatacgtttacaactcaatgagatttctaaagtgaacccacctatctataatcagtgtccaaatcaagaaacattacctgaacctcaaaagccccctggtggctctttcatgtcattgtcctccccactatgctcattaacaccatgggctagtttttaaatggaaccacgcaatatgaactcttccatgtctggcttctttccctcaacttcatttttttgtgtgaaattcacgcatgttgcgtttcggtaatttatttttgtactgtacttccgattctttactacagataatggtcagcctccattccgctaacagctttttttcctctccgagttgctgattctaattgctgccttggacgatctataaagctgagtgcgcgctatgtgacctctcaggggtcgctgccttggacgatctgtaaagctgagtgcgcgctatgtgacctctcaggggttgtttccaaccgtgttgttgacatcttgagcctgccaaggactagaataatctgaaaactaggcttctctgggggtctcactgagtgacagggttagaaccagaagagaacatcgtctccagaagacatttcaccattttctttgatggtaaacaggctcacttataccgaatccaaacccaggcgagaactacggactcttgaaatggtcggtgaaaggggcgaaagcaccaggaaatcgtgcttcaacagtccatgactgaaaggagggcctgaaactgtggccataggcgggcccttttgttagggccttgacctgggcttccgctacagggcccggtcacgaggccaacgtagctccacctcctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcggtacgttatttccggggctgggttaacgcagcggttccgagctgcgactgcgcagcgtggcccagcgcggtcaaattataatacataaaagttgtcagggcggagagcaagacattactcttctcggattgccggttcgctcgcgagacttgagcgttgctaggagattcggcaggcgggcggagccagactcggcggggcggggaggggtggggctaggctcggcgaggcgaggaagggtgggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctccttctgcgcggctgcagctcgggacttcggcctgacccagcccccatggcttcagaagaggtaagtggtccggccccatattccttatgccccccggctggagctgcagcgccagcctcccgccctaccgccgtttccgtgggctgagccgccctgcggccacccggtcccgcgccagtcagtgcgccgccttcccgggggacacctcactcgccccttgctgcgccgtcggctccccagcgcttccactcgacctcgcaccccactcgcctgctgggctcgagcgggggtgtgcggcgattatccgtgcaggcggtgcggggagtgggtctgggagagcggccctttgcgcgtgttcctcaggccctttctgccctggtttcccagccagtggacaggaagcttcattcaagcaaagctgggtgcaaacatgagtgtcgttcttggtagagggcggttggaaggtgagttctcagtgctagcacttgaattctcctagtcaggttttctctacacacgaggagctgtgttactctgggcaagttgtttagcttctctgtgtcgcagtagcatccatttcatagggttgttaaaaaatatgatttctaggtgtttaagtcagtgattggcaaacagcaatctgctgtatgtgatttttaaaataaataacttggaaagttagttgtaattaatagtaagaaagcgaatggcctgtgttaaagctctgtaaactctgaacgttggagaattaaattttgtggagacttagtttgctcagttagaaaatgggaatgatagtacttgtattgctcatttcctggcgtaagtgggaggtgaagacgggacagttattcacagttaagtgttgggtgtgtattaactagatttgctttatgaaaacaagtactggggagtcccaagcttttgttttgttttgtttttgttttttaaactcaaaatcttttctttaaatgaagaaaaactatgaggtttgtgtgttccagtattaatctgggtatcttgtgacaagtcttttaaggtaggtcttgggtactatgtgcccctaggagataacttcacagtcttgcaggtggatagctcagtgttagtcctcttgaaagtagagatcgttctcagtttaggcacttagaaatatacatttgagggcacttgatttttgttttgtttgagataaaattcaagtttttaaccattttaaagtgtacaattcaggtatttgttttttgtttaaatatattcacagtgtagtgcagccatcaccactgtctagtttcaggacattttcatcactccagaaagaaaccatgtagtgtgttttaaacaattgcttcccattcctccctcagcccctgacaactactcatcttgtactttctgtgaatttgcctattgtaggcatttcatataaatggagtcacgctgtatgtggccttttgttttttggctccttcaacttagcactaacattttcaagttcatccatggtgtagcgtgtatcagtacacatgctctttatggctaaataatattctattatatgcatgtggcacattgtgtttatcctttcatccgtttatggacatttatttccacttctttgtttgagacggagtctcgctctgtcgcccaggctggagtgcaatggcgcaatctcggctcactgcaatctccgtctcccgggttcaaaggattctcctgccttagcctcctgagaagctgggattacaggcgcgcgccaccatgcccggctaatttttgtatttttagtagcgacggggtttcaccacgttggccaggctggtctcgaactcctgatctcaagtgatccgcccgcccgcctcggcctctgaaagtgctgggattacaggtgtgagccatggcgcctggccttatttccacttcgtgactagcataaataatgctgctgcgagtactgtatccaagttttttgtgtggatgtgttttcagttctctggggtatatacctaggagtggaattactggttcatatggtaactttctgagaaactgttagactgtttccagagtggttgcatcatattcctgtaagaaatgtttgaagcttctgaaagtttctccacatcattatcaacatttgttattttctggggtgttttatttttctttttcggtttatgataccatcctactgggtgtgaagtggcatcttgggaatttgatatgcgtttacccaatgatgaagatgttgagcatctttaatgttcttggtgtccatttctgtgtctttggagaaatgtgtgttgaattcctttgcccatttttgaggcacattggtgttaatgcctcctagtgaaaaattaggaaataggaagataaagcttgaatgccttatgggtagggataaaagagaaataaaatttttatatacgtaaaacaaacacatgccaagaaggcaaggaaaattacatgataaattagataggaaactaggacatcttaaagtatttgtgcagaaaaagcatcaaaggaatcacctttgttggtttcaagtctgccaataacagaactgaggaactgtctcagttttaagttttttcagtggatacttcataataaaaagagtactttagagtcaaaactggcaataaagagggcttgggaattcagccattgggggaatcccttgcctaattcgaagtacctttctcattctgctagataaagtattcctatttcagtcaaaaagcaaaacctcttgcttagacttaatatatttcattttacatttcaatatttttattatgaattaggagttgtagaatcagcgtttttttgaaaccattacaataaaaatattactttgaactgaaacattttggttctatgctcaaaagatgagtttgcaagattttttgtcatagtaatatgagctgttcttggaagggtcgagagtgtggacaagagggttgggcagagttgatttttttttttttttgggagaccgagttttgctcttgttgcccgggctggagtgcaatggcgcgatctcgggtcactgcaacctttgcctcccgggttcaagcgattcttctgcctcagcttcccgagtagctgggattacaggcacgtgccaccacacccggcaaatttttgaattttaagtagagacgggctttcgccgtgttggtcatgttggtctcgaacccctaacctcaagtgatccacccgctttggcctcccaaagtactgggattacaggtgtgagccactgcacctggccagagttgaactttttataccatgtcatctgttatagataggcaaaactagggcatctgagttaaatgagataacaaaagacttgtagtaaaagaaaagaattagttctgttattgcattttataagactattaagaaacaggctttcaaactctgttgtgcgtctgatattctgagttataaagcactaaaagacttttttaaattgagcttttgatatcaagctgtgacacaagatttttttggtcaagttggtagtgtcaagccagagtgtaaagttattgtaagaaaagtgaaacagctgtttggaaagatcttgtgtatttgcagtatgtcagagggtaattgggggaaaaaaaacttaggctcaataattttctaacattgtctttaactcttgaatttcataaaatgttgcctctatctctagaaagtagaaagtagtagactttaatagatgatggattggcaagagaagaaaatgagaacgtggtggctttttcaaaagataatttccaagagtatgttgcattttcggtcttttgtcaccttctgtgcaaccaactcctacacttctgagtgtaagactgacccagcttcagagcaagacttttcctcaaaagcagaaatttttttttttatcttttgtcttaaaaattaagactttttttatgtgaggtatttgaggtgggaagataatgaagaccaatcagtgacagaaagtggagcattcattacctcagttaagtttgctataaaagcattttaccatggtcactgcatgttctctcatctcttaaatattttaaaagtgtctaacatctaatgacactcggattagatgttacaaggaaatctatgaatcctttgtcaaaaaaaagttctttgttttactttttaggtcgcagacgtttcttgtaaatattttaaaacataaactggaaaatttaggtttgaagacctatttattgtttgttcaagattgttcaaagttttccttttgaaaaaaaggaagcttgagttaattacagttaataagccagatggaagaattgaagttgcaactcaatcctagaaaatttagatgaacttcttaattcttagtgcttatttcagtaagttgaaatgagtgatacgcacaatatcaagccatttccttatttatcatagctaacttattttttgtcttaacacagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggtatgacttgcttccctatagccagttctgcctccgagcaacctattcctcatagtggtctaacaaattcatccccaatgagttttgagtctgtgtttttggtggtttggagcaagacccatcagtttttatttaataaaacttttttaagatataaataggaaaggatgcgttctagaagctgttaacaagagtaaggtgattcactacaaaatgtaacaacaaggaaggaacttattctgaaattgttcagtataagacacagctttggtggtggtggtggtggtggtggtttttaatcatgttttatgtttcactctgccaaccaccacaattaactgaggagaggaatccagttaaattcaggaaatatttttgagcacctaatgtgtatcactattgtgctttgacttacggatacacaacagtgactaagacccagtccttgctcatgttgtggttgggacattgacgtataactcgtagtataacaatgtagtaatactgttttccttcaatggtgtatacagttttttgttttggcggcagcgcaacttgaatatgaatgatgagctctcattggagcaaggacagtcttgtttttctttgtgctaataatgtctagcacataataggtaacatagctgaagaaataattctggaggtgaggaacagggagaattagagagatttgagtgtgaagggtgagtcgtacattcagcaagtcaaaaaggaggggaacagcatgagcagagaatgtgaatagagagttggaaggcatgatctattttgaatattgttaatagtgaaaagcatgtgtatgtcgtgcttaagagatgtactatatagtaatataggaaattgcaccgtgtactcagttgagtataggaaactggtctgaaggtgttgaggattatggtattttaaccaggaacatagatttgtgttgagggagaaacttgtcaatccggaggatggactgactgaatgggaagaaactattaataaatgaagttctctggaccccactagggcattttttcatcaacactgtttctttttaattttcgagggtacatagtaggtgtatatatttatggggtacatgagatgtttgatataggcatgcaatgtgaaaaacgtcatggaggatggggcatgtttctattctataggactaagtgagcaatagtcagggatatgtatgtatatattcttgataaacagaagatgcttttttgtgaagttttttattttctacaaatgtgatggtattttgtgaagtatttatatatatgtcttttatgttgacagagttcttctaggtcagagacgtgctggtagtttgataatacatactgaaatggcatttaacagataccagtaggtttgtcagatttggatgaagaattggagtcttttacattctactttgccctggaaaggaattaagagagctaggattccatttgtttgactacttacagaagtagaaatggttatggaattagtattgatacttagccatccagcttagtggagaactaccaatatttagatgtcggacaaaattgtttccataaaagctgtaaatgaactaatcttaaagaatgtatttagtgatcatatttttattctgagggataaaaagagcataggttttgtattcagaaacctggatttgaatctgaattctaccacttgttagatgcctagctttgggtagagtacttaactgctttgaggctccatttctcaacctagaaaatttcttatatttcaaattttttcatgtttatatgactggattttcataattttactttcctgacttatgagccatgtgcatttgctgttctaaagatagtttcagaggcttacttacgtcccatcttttgttgtcgttgccaggatgggatcagtcagataagtttgtgaaaatctacattaccttaactggagttcatcaagttcccactgagaatgtgcaggtgcatttcacagagaggtgagttctcattataatgggaaagacagtgaattaacagtcaacattgccttatcttgagactctcttctttgcagtttttaaaattcttaaatttagaattaattatcctttacaactactttgaagaggtgagcgttaactggccaaatgcacaccctgaaataaagccagcagcttttttcccacaagaactatggagtaagggtacctttcatagaactagaaagatgatgtattcaccattgtgttgcaggtcatttgatcttttggtaaagaatctaaatgggaagagttactccatgattgtgaacaatctcttgaaacccatctctgtggaaggcagttcaaaaaaagtgagtgtgctttttttgattgtaatattgtgaaaccttaccaaattgaacctggctgatttagaactgagatgaactggaatgaatttgtcctctgtaacagggaccaccgcctgttttgtgaatgttttattgggacatagccaggcttatttgttcatgtgttgtttgtggatgcttttgtgctacaatggcagagttaagtggctacagcagaccatatggccctaaatgaaacctaaaatatttactatgcggccctcgacagagaacatttgccaactccttttgtagaataggctattgtaagaatattccattaaaatcagggaggaagtaaacgtttgaaggtagttaagagtgagacttgagttttatgccaggtttacagcttattgtttgtgacctttggcagcttaatcactctgtgcctcagtttctgcatttatgcgatagtaataatttatttcacaaagttgaaatgatacactgaagtgcaataccattatgtaaagtgcttaaattaatgctagtgttagcattgtgcataatactcgtatacataaaaggaggtcttaagcacttagcctccttggagttagaagcagctataaaaataaggaaactgtcttttaaaaactactctttgtaatttttactaaatcagatagtccctgttttctgcctaatgtgaataaatgaagtttaatgcgttaggtatatagacatgacattctgccatctgtttttataatacataattacttaacagcttacaggtgatactcaaatatagttggattcgctgtcttactgcacccttctgcatccgctagtcccataggtagagtaccaaaagatccctagtattgatcattgtttaaaagacctgtacattgcccttctttctcactttcaaatgcctcaccttgccccatactgccttatacgacttggtttcttgcctatccccgacccctcttattatattactgtctttttcagtcactaaaatccagccactcctcctgctcctcaaacacaccaagatgatcccatcttggagccattctgcatgctctgccaactgccttctcctgaccttaggcttcggctcagatttgcctcagagaggccttcctaatgaagttcctgcccccaccccccattaacacccgctttgtcttgatagcactttccaggatatcagggtattcaagttttacttatttatggtcttttcacaccatgaatgttcagattttggcctattcatacaagtattactggcacccaaaataagtctatacatactagggacttgatcaattgaatagataattgttttataaatattcatgcttatctccatgtcttctaagctgtatttgttttcctgcttttcttccaggtcaagactgatacagttcttatattgtgtagaaagaaagtggaaaacacaaggtgggattacctgacccaggttgaaaaggagtgcaaagaaaaagagtgagtctacttccatttttttaaagaattttagtgtattgtttgagatcatggatttttaatagtttgtctttatggataatgtatttctgctttcaactgtcaaactacctgaagagggcacgtccagcaagttgctttttaaggtctttgtagttaagggttggctctttagtgtggttcttaaccctaggcgcagttgtgcttctatacaaataactgtgcccattcccagatactctgtttcggtagtttgagaggggcttaggtacccctgtatgttttaaatttctcagatgcttctgatgcgtagttttcattgtcactggtttatagtgaaaaagataaaatatttttatccttcttaataatgaccttttaaaaatgtgtattcaatgatacttgcgttctaggtcagttcatcttctaaaggtactgactaaattaattcaagacccaggcccagatctgtgtatctcaggcttaagaggagagtttttctaattaaaaaatacatgagcttcagggtacatccatgtgtaatgtttatgattttccctcaagtgttttttttcaaattatgaggaaacatgcttttaaaaaatgaaaacaagttagaaaatcaaattcttattttacctgtcaaaaatcacaggaggccaggtggggtggctcacgcctgtaatcctagcactttgggaggctgaggcgggcggatcacctgaggtcaggagtttgagaccagcctggccaacatggtgaaactctgtctctactaaaaatacaaaaattagccgggcatggtggcatgtgcctgtaatcccagctactcgggaggctgaggcagacagaattgtttgaacctgggaggcggaggttgcagtgaaccgagatgcgccactgcactccagcctgggcaacagagcaggactgtctcaaaaaaaaaaaaaaaaaaaaaatcatgggaaatccctgtgcctaaaaatagcccctaactattttgatgacctctttcgtgcaccaagtgtgtgcatgcttgatacgtgtgtgttgttttcattaagatgaatttgtgcgtgccgttttgattgtaaatatctttgggtactctgtcttccttcttatccctctacttcctgccagtgttaacaacctgaatgatagtatcttccggtgctttcgtttccccattgttgtatatgttttctttttaaaggaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttcacttgaaaaagaagtataaaaacaactgtattgagttgaggctgtggagaaataaggacacatatatgggaatggaatgcaaaagttaaactttggttaacaagaatatttgggcaggtgcagtggctcacacctgtaatcccaacaccttgggaggccaaggtgggcggatcacttgaggtcaggagttcaagaccatctggccaacatggtgaaaccctgtctctactgaaaataaaaaaaactagctgggcatggtggcagatgcctgtaactccagctactcgggagactgaaggacaagaatcacttgaacctgggaagccgagggacgagaatcactggaacccgggaggcagaggttgcagtgagctgagattgtgccactgcactccagcctgggtgacagagtaagactcttgtctcagaaagagtatttggtaataaccatcagaatgacatattcatttatcctttgacccagaattttaacttctttctgggctctgaaaggtacatttagaaaaatttggaatgctatatgcaaaagattaaaaatactcgtgtctatttaacaggaatgtattatggtgcatccacatgagggagtacttaagtcacaaaacaatgaagagttctatataacgtaaaatggtctccaggatagagtaagtggaaaagcaaagtgcagaacatttatggtatacccactacatttgtgtaagaaagggtgagaaatgtgaatgtatgcacataggtgtatttgcttatgtttcaaaaagaaacgagtaaacccaaagctaataaaaattgttagcaggggaaggaaggagatgaggatggaagctattctgtgaatttaactttttctagagttttgactttagaaccatctaaaatttaacatgactgaaaaagtaaaacatgaccctaaacctatcaacacattgtcttagtctattcctgctgctgtaacaaaatgccatagactaagaatttataaataatatttacttcttgcacttctggaggctggagaagtctaagatttggcaccagcagattggtgtttggtaagggcttgctttctgcttccagtacggtgccttctcgcagtatcagaagggtaaaagggacaaactctctccctcaagccctcttagaaaggcactgatcccatccatgagtgtggagccctcctggcctaatcacccctaagggccccacctcttaataataccaacgcattgtggattagattttaatgtgaattttggaagtacacaaaatgttcaaactatagcatgtatatatatcaagttggcagtataaactacttgcaagtaactttagaacacaagtgtttgcccattggtagtgagatggattctaagttgagatattagctagaacattccagttggtaagttgtcatacatatttaagaaatatgaatccaaactagattgtgataattccctcataacttcacctccacctgagtttcggactctgctatccagctgcgtactagtcttcatcagatgacacaggcatctccaacaccgcatgactggaacctgaactcgcttatcttctgtttcccctaaatttgttctttttccaaattttctatcttggagttgccctcttggaattgccctctaccatctatctagacacttttatcaggaacccagagaaccatctttacctcttagatataatcagtcttgtaagtcttgcccaattttctttcctaaaactttaaaaatctgtcctctctcctctactaataccacaatgttagttcaggccttcatcttcctcaacaactaagacatcctcctaactggttgtcttgcctgtagctttttcctctcatggccatctgccacacagctgtcacttacctgtattacaaactgatgatgtcattcctgtgcttaaaactctgtaatacctggtatgtcagtcttaattccttcacatgatttgtga

SEQ ID NO: 13813 - DNA, 23849 bp, Human
ttgaggaatgggctgtgtatttgcgtggcatgggggaacttacaaatggcattcagcagcatcaatgtggcttaaaccctgacagctttgccacagacctcagggcattgcctgaagaaggaacagcacccaggttcagaaccatcctacaatcatcctccccagaagaaggtgatttcagtcaagtagaccattctgagagatactgtgactgttctcaatgtctacttttagggttgccttgtaaggatctgcctacccaccctagttaagggagaagtatataacttgagcctagaacagtggacagggggtgtgttcagctctggacagtatctcatgtagtgtgcccatgttatgcacatctatgtgtgatgtcctctttctttatcacagtggttttactacactttccaggtaaccttctgttttacaagtactttgatgttactctggcggtggaagattccaaacctgaaaaatctgcattgttttatatgcgtttcattattgagatggaaaaccttaagtaggtactcaataatggataaggccgtttcttagcttcaaccttggttcatctgaattgaccttatcagtcaatagcacgggccgtttcattaaaataaccaatgaataatgtatcatagcttagtttaaagtttcaaatatgtttttagacagaaacattccaagcatgcaagtcaggtgtatttcccagataaataacagtctggggacgttgcccgtacagggaaattctctgttctcaaggaaattttcccttctcgggtttcctgaggttgaaatccagcgcgcacgtcattaatcattcactgaggtcggtccctcagtcaatggcaggtctgggtaagctaaagcgagcagttagctaacccttcctgccacggggatcctggggcgaaagaggacaactgggcggtcagttacatgtgctggtgtccagccgctgcctctctttccccggtcggagcgcgggggtgcgtgtgccctcactctcacgaatacagacggagagcttcccagaaggaaaaacaaattcgtcataatgttcagcgcagccgagagtttccaacaagaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcacaagtgtgctgtagaggtgggagaggacaaggacccatttccacatttcaaccctccgtttctatcgctgcccctggaggactcagctgctaacgccgagctcgtttccacgcggctctggtcctagtcggggaatccgggtggccgcgcgacgcgagagaactgctgggatgcgtggccctggtatgggcgcacccagcgtccggggcgcaggttctctcagcccagcttctcctcccactcactcgctcggatctcctccctccttcacatcccccgcccccgggaccgcgaggctccctccccgcaccggccagtgagtacacaaagccgcgggtgaggggaagcttcgcaggcgtgcacggagcagtgagatcactggcgttataaatatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtaagttactcgctctcctacaaaacccgtcctaggcggccgcggaagattcgggagggacagcaggtattcgccgggacacaggctcaccttcctgagcccaggccactgggaccaagctgatactcagaaacagccgggcgggttgggtggagatgcatctatatggcgtgcgcacacgcacccctctcctgggcatgaggaattgcgatttctcaggtgtatgttacctagaggctggtgcccagacgggtaccttgttttcagtttgctctagcctcaaagacgagtccccagccatgacaggagagaacaaaaaactcatttcttctcactcaatttgtttaccttctgcttatgaactagcctggcatttttcattaggcatcaaaggcagcccttctccctatccataactgaagttattttttgaaaagaagaatcaaatcccaaatacttccctcttccatccgctaccataaacctcaaattaatattgtatatgtatatgtatatatgtatataagtctatgtatacaatgtatacacataggtagatagatagatagatagatagatacacagatagatagacagacagatagataactaggggacaccagacagacattcctgcttggaagaagattgtgctctagaaaactggacgcgtttagagagggagacatgataaacattgaaattactaactccagagttggatttaacaatgtttagtatcttgagaccatgactacaccgtattaggagagtggccagcctttggtccccaagaacagttaggggaaagttccttattttagaagaaacgcagaggttaaatttggtaggggtgcagattttgtaggactttttataaacaaagttttaaattttccctctgagttttttctttcagcacgctctcttttttcctttctcatctcctcttcccttccaccccatctatgtttccagaccatcgcagccactcctctggtttctcttcactgcctctaggcagctgggggcagggacggtttggggctgtgagtaggagtggggagatctctgtggggcttttgctcagtagggccagatcgctcttccagcgcgggttggtccaccaggcagagccccagccagggcctgtcaggtacccagggagaccggaaatgtagccaggagacagcagcgctcacagtcacctggtttcagtgtcagcctggttgctcctagatgttcctaacttgctccatctcagaccaacgactccacgggccattgggctccttcttacacaggctccagaggagcgtggacaccaccggcggtctgaagatttggcagccagcagtctccagaggggggtcggaggcgcgcaagtgggtaaggcggtaggctggctagcctcctccggtgggttaagggggcctaatgcggaagacctgatggttcatgctgagagaaaagcaggtctatgcccgcccctctgcgcctgtctagtctatctgatcgcgctgattcagcagcctgcggcgcacgtggtgagggcgcctggagcgcccagctggagagagggccctccgcacacgcaccagcgagtcccagggcctccctcacactcccgagaggaatctatttccatattttagagtttatttcactcatcgaataactgctcatttgggggataaagggcaagatctgttggggtgaaatggaattttctgagatttgaggaataatcagtaacatctatttatttccattcgtccttctcattttgtctcaacggtcttttgactccatcagccatcacagcttattcccacttccggcaacctttccttctctcttacaagaaaactttctttcttctgttcttcttgtaacgacccgtggagtcattggtctgagatggagcaagttaggaacatctaggagcaaccaggctgacactgaaagacaggtgactgtgcgcgctgctgtctcctggctatgtttccactctccctgggtacatgacagagcaccaacagaggataacttccgtgagctcaagggcggaccccaaactagcaggcagcaagcagcaggttggagcccagggagctcagagaatgcttctggggagggtttaggtgtgctagagatctcagaaagcaaggctcattcccaggatattcaccatcttctctacgaagacactatatgagacgaaggtagttttacagcttaggccttgctagagggggtgttgtagaaaagcaaaggggggaaaataagagcagatcaaaaagagtgcacccagataaacaagacattgaccactacccagtatgtaacatgtacattttcttttaaaatccatgttgaaagatatctacaagagaacagggatgtttcctaaaacagtgccgacaaaaagcttaatttaaactttttcctaatttattcttgtttacaataacctttcagagtttagtttctgtgtctttcacatgacttgctttcattcatgccataaatcatgtacccaatataagatacctatctcactaagcatgatattttggttacttttgtgttgtttgtcttccatagagtttttttttttttccccagaagaaagcatagcaaatattcaaatcatagtaattttctgctttgtgatatctggagtgtctaatactacttcataaaatttttactacctttgatcaatgcagaatttgcatgtaatttgggaatttaacatggatctctgccattacctagctgtaaaagagaaacagaaacttgctaattacaattggtcatttacctctttgaaggcagtagttgatgtttcctgacattcgtgtaaactaaggtgttggccatggcctttcttagagtatgtgaggaaatgtgtttaaatctcctaagagaggctgagagggctggatcaagggccacagaggatacctcagtttgatctcatcttctatttctactgtatgtgagttagtgatgatagaaaacctattctttttgttacaaccctgatacttcagaaaagtcaaagctttgccatgaaactgcattctaacaagttattttaaacctaataatattctgtagtatttgtctgatagaacagataatcatatgtgtttcgcaaactattatttgacagtaaactttttttttttttttgcaaattgcaaatgttttctggtttcaccatgagaagtgcaccatggccatggactttcaaacataatttgtttagtttacatggaccaattaatatactcttagcttctcttacacaataattatcccaagttttgaacacagaaaatgaaatcaagctcattgtatataaatccttattatgaggaaatactgtggaaaaatgaagaaatatgaacaaggcaagatagatgacccaactattgcatggaaacaaatggtttggtttaatttatacgccttcaagtttaatgtcaatacagtgcttctgttgacttaccttgggccattgaagaataggcaatcaagtagttgtcagtttagggaagaaaagtttaaggctttgtcaaagcgtttacataaaatatgaaaattccaagcacatattttggttaatagaatcgtcgatgttactgctttttaaaaaaatctaaattcactaccaattttggggtcatgtggagtcattagacagtcccccaagcctagataaatcagaatctatatctactatgcagaaaaatcaagtggaaaatttctgttgctaatttaatcagtgaagactgctaaactgaatatttcaagattcagatttcataacttggcacagcatatctgttactttgtggatgcaagtagagaaacttcagttttaaaatatttttgtctggggattttcagatgcgttgttgaaagcttctgaatacatggaatatctgtgcttttctatattttattcattaacaaaagagagaaaaaggaaaaatgtgtatagttgtatcaaccactatcagtagagccctattatattaagaaatctgcagaggactaagtcaaaaatctagaaatatgtttttttttacggaagtaagcttacatcataatgcataagtggaatagactgtgtgtataagctgagagacaccaagacattcttgccttcttcagcctaggtgtcaatgctgaaattccacaaagagaataattccttctgttaagcattctcctcttcttttgaccctcttaaatgggaacaccttaagaaaaataacacactgtctgtagcactttaatgtgaatttatttacactgagccacccgtccaccccgtgccttctcaagcaggagaaggccacagtagcaggagagtactaagacacctgtccatacttgtgtatgcatggggtgtcctgacaagagaaaagagaggtagtgagaggatcaaagaaggcagtcaaatttagcaaacagtcattgactatataccatctacaagacaagcttggccttccacagtttggcttagaaatactgccttggcatccataaggagaattgtaagtttccatcaaatttaatatgcgtgactcccgatgataaaggtcagaaaattactgaaattaaaaaaaatcaatgtcagagaaatgttttcagaaatttatatatttgtgatttaaggcacatgggtttaaaaaattacgtagaattcctgaatgagttactgagatttgtcatagcaaaatcaataggcctgtgatgttttggggaggagggcaggaaactgaactgtgagactcattgaatctgctccagaaaacaaggcattgtgaaatcactgctgacattactttggaaattatgatcataacagtgttcttaatattaggtcataattacggtaagatttagaagatcaataccaaagttactcacgtgaaaaataattcattcatctagtctcatctcttacatctcctgcattctttataatgttaaatagaatgacatatgtaaagtgtatttttaagctttcagttaaagataattttcttaaggttataaaatcttttaattctcaggcactatatcatttttatcctggaagttttaagaagaaacccagcaatatgtaatacaataataacactttcacatatattatttcatcttccccatatttaaaatacattacatgcaacttgtacataatatatacacagagtgtacactgtattgaaatacatgttaaatgcatctaaatgggtctttgtttaaagagagaatgagctaattatcagaaactatttatttaagcaaagcagtagtatttctattaaaacaaatatttataaagcctttttatctcaacatcttaaaagttagcatataaacacatacacttatgagactttaatcttttattctaccatgtattttttcattaatatacaatatatctgcatgttcaaaaccagataattttccagggaatggaattaaaagcctctaacaatctagcaccatgagtaaattggaggaaatatacaatcaaatctctcctgtatcaactccatgttgtcccttttgtatccatcattccacacatatacaatttccttctttctttctttctcatttttgaatgcacatgtttacataaatattcacaatcacatcccccatctcccaaatatctaaaatcattaatgctattcccaatatcattccgtatttccaatagaaatttaactttgtatcactgttatagtcatgctttagtaataatattattataacatattacatctgtgtagagtaactttacaaagcatttggtgtgttttgttaatatttgataaaatgataatgcttctaaacctttagaagcacactcaaacaatgttcataataaatcctattataaatagcatttaaaaacattttgaaggaaaggatttatacagcactggtggttttttttttcagtttccttctaaaagcaaaagtagtttccaatagtttttgatttttgtttttcaatttaaagaaacacctattagtgaactggtacctgcagtttccctaaagtgtgttttatttactttgggctaaaaacatctattttttaaataagctgttcagttatcccctttttcacataaactttctaatcaagttttttaagaaaccaagttgaataaataaacagcagtgcttgctagaattatagatgttagctcacattgcacaaaataaatgctcaataaagttactcacatatatttataaaatatttcttgtttttggtaaacagaataattttatatatacctcaaatactgcagggagagtttgctatttcaagaaaatctgatgaatttctctatttggcagagtcctattgagatatcctaattagtatatatgcttagaatattatagatggaaatattgagatgttcttttttccatccctttccttctttgtttccttcttttcttccttccttcttttcctttttaaaagtagagatgcggtgtcactattttgaccaggatggtcttgaactcctggtatcaggcgatccttcagcctcagccttccaaagtgctggaattacaggcgtgagctactgcacctggcttccctttttcctttctaagacaggtccctttttagctctattgagctaaaaatctctttttaaaaattttgaaatagacaactaataaaacacattatagctctattgagctaaaagtctctttttaaaaattttgaaatagacaactaataaaacacattatgctcttttcatgttcatataaaatacataaatttatgttaaataagcaggctttctaattaagtgcagactatgtgttttatcttattaaactactctatgaacagtggtgtgtaattctcttgatccagtggacgtgaattttgaaattactgtaggagacagagggacattgacttcataatgctaactataaaatacaaaatttatacaacaatgtaataaattatttcattaatttttttctaggaaatgattcaaaatgcaagatgtctcaaagcataatccattaaacatttcattgaaccaataatttcaagttatttataatgctttcagtatcttatatgtagtctttaaatgcagtcactaaaagactgagtatggtatatgtttatttgtaactaccattataaccttgataattagagtagaggaatttatttaatgtaaataagtattattttccagactttcaaatagttatactagtcttgagcacagatttgtgctttaatgttcaaagtagtgtattatctttgatgaagaaacaatggaggagaattattttgaaaaacattttttaaatgtctttttaatttctttaaaacctgagaaaacttcatgctcattgtttactaaaagcaacttatttgtccaaataattactgatgaagtagaatcaaatttttgaatcttgaaattattttaaatgaacacttgaatcctagccttctttgtttttaacatagtgaatgtcatgaacaataaggatgttaaatactaagttcttttttaaaatcacaataataaagaatggaaagaatctatgtagaaatttaattcttcacaatgatataaataagagcctgtgttttattttgggatttctgtcatcctaggtgttttggaaatatttgctgtgtctcaggggattgtaggaatacgaggagttttcagcaacaaatttttagcgatgtcaaaaaaaggaaaactccatgcaagtgtaagtagaaccactttatatttgttaaaggtgctataaagattttacatttgtaaaacagaataattttccaaattcataggtaagaaaatttgcccaaagaacttaacttttaaaaagtatttttacatttaaccaagataattttgtgcgcttccagaagtaataatttaaatatttaatttacttaaaagatattacagagtctacaaaaagtttaagcataaatgtatttgaaaacagcattctcaaaggggcagccatccacttatttcttagaagtggcccacgtaagaaggaatatggcaataatatatttcatcacattttaaacttacaagtttatagtgactgtatttgtgctaagtagatgaggttcttatttaagtttacaggctactcataataccaaattgggtctcagtaatgtaaaatattttcatattaacaagcagggagggaaaaaaccaataattagaagactctgactttcatagacaaattttatttaattaatttgaagaatttttatcttgtatttttgtcacatcaaaaataaagacttcttaatactatgaaaactaattttgcattctcaaaaatttattcagaccagttttatatattgtaatcaattcacaaactatttatttgctttgttatgaaagttcccattacctgggaagtattaaaacattttaaagataataaaatatgttcagcttagttttcccactcacagattctatttatttgcattagtatatacacgctgcacttaaaggtgctttatgctttttctctggcatacttattttcttcacattaaaacattttgaaagcaattattctttaaagttagtcctttaatcctgattctttatagtctttattaaataaattattggaatatcactttttcagttttcaaagttatagaaagtttcaattgatagcaataattgaaacttactatatataatttgatttgatagatctttaaaaaattcaatgagaacgccacttggtttaatgtgtaagacttttataattttacttttcttaacatctaaagtgatttgttaatatcttttggaagagacagaatttgaacaatttctatagttatttgaggattcgatgagataatacatgcagtgtgctaagaatactatttggtgtgttataagtgctcaataaatattgcctattattatagggttaacaatctaaatataatctaaatataataaattactaaaatttcagtttactaacataaatggaaatcctttgttaaacacttaaatcactcattgcaagaactattaaacaatttaccatttcattttttgagctggttactatactctagcaagatgtagtataatattcatagaaatatatttttctaattttttcatttgtttaagggacaacattctgcatcactgtgaaaaaagtagggtattacttttttaaatttattttttatttcaataggtttttaaggagcaggtggtatttggttacatgaaaaagttctttagtggtgatttctgagatttaggtgcacctatcaccccagtagtgtacaccgtacccaatgtgttgtcttttacccccagccccctcccctttccccctgagttcccaaagtccaatgtatcattctcagggcatttaattttattttaaaatattagttaaaatccacatacagatgagttctcacgagggctggaaaaaaaagtaaaaaaaaaaaaaatccacatacagaattgaaaacaatgattaaacacatctaaacggaataacttttcctcagtctactttaagtttataaaagattaaaacacctttaaaatctaacctcataatagtacacagtgcatacaaagaaactttctcttactggtttgttttgagtgaaaatcttaactttcaaaatattctgatttatgccatagtacatgcaaaaaaaatagactaaacttggaacagcttaaggataattgccacagaaagtaacatattacaaatggaagccaattagaaaggtcaaactgagaggttaagatacatgattcctctgtcaaaggcaagtaacaaatttctagaaatttgacccaaatgtctaaggatggctggttgaaataatgcagataatgcaaaaacagcatctgttattctttctcatcttggcaggctaaagttatttcatagaataatgacttttaaacagtacaaagcaagtcttgctcttgtcactcactgaagctctttgatataaaagtcattctgatgactttgagctaaattgtagataaaaatattaagcctatgattatgtggattctttttaaaccaattatccaagcccactttctcttatctgagcatttattagcacttttcctctaggtgtaaacctaattaaattataaagtgatttattttttaaagatgttgaatttagaaatagtattaatgctagcaattaccagttttatgcccagttggtttctttcctgttttcacattctagttaaacatgctgggaaattgtttttgtaactctaaatatgactatttgatttagttaatagttttgatttttacgactttacatcatccccaaaaaaggttaaaaactcatagacttttaggattaaacttgtaatttgtgagttgctttaaactaaaaattttgcggaggcatttaaagggtacttttagggttctatctacaaagcaaatgtaaactaaaaatataaaatattaatagaattctgggaaaagtaatcccccactgtactgagaaatattcatggatacttgtaaatattcaactcagtttttgtaataataatcagagtactaaaaattagctactaggcagagataatgtactttcatagttctttaaaagcccttttgctcacattatctcattagataatgaggtgacgaaagagtctcatagatgttaaattattttcccaaggttacacagttaacaagtgattgaaccagaactatatcctcctagaattttctctttctttttaaatgctatagtgcttggtagataaaagttagcttcaaagaagatattaaattttgtttggaatcaattacattgttttcacctcttagtgtatagaaattaatatgtgcgtgaaaatatttttgtattacatatacaaatgaatactgtggcacatcattagaatatttatagcactctatttaataggcaaataaacaggcaatttaagacttatagttaaaattgtaaatttccccattctaggtacctctttttctctttgattcatatcaccttttttgaactggtgtttcccccatctactcctgggtctccagtactttactttagaatctagagaagaggggatgtgtctgccacagaattttacaaatgttggttattcattgtcaatgatgagttgcatagggaactcctgcctcccgagataaactttcaaaacagaaaagagatctgttttgctcacagaaaacttcatttagtaaatattttactgccatagacacaaatatggcagactgaaagggtaggccagagcagattcaggcagcattgatgctgattccatttttgtgctaaatttattaatcccatcagataagttttatttgagcttcagccatctaaatgtgggctccctggactcattcaagcccctgatctacaggcagctctccttcaaacttttattggtatactctaaatatgcagtgcaaccaaattcttgtcgtgcaggtttttcagcattctttacaaggatgaggatgtatggtcttctctttgtccaaatgtatcaagaatcatcaagagcaggaggagataattactttccaaagagccatgagggctactccaagccacagctgtggcctgtactctctttctcaacacattcccatgctaagataccttctgagactgagcactctttctccctttatctgtctgtctgtccctgctccctcctgaggttggcatccttactgaaagtcccctagagagcctttctggatttatctgaggtgggtccagactaggagtgaaaggccttgagtgtgatggtaaagacacagttagattgccccaggctgaatcctactctaccacttcctaactgtgtcattttacttcatctttctattccttggttttatcaactacaaaagaaggaaaattaaagtcacaatctattgggatagttaagtgttttaaacaagataatacacataaaacacttagagtactgcctgaaaagtgttccacacttaatgtttaaacagattttcctgaatttgctctcaggcagctgtttgacaatccttaatctttttctttctgattttggggtcaggcaactgtgacccttaaattattcaggccagccccaactcctatttatcactgaccttttcttcctcacgtccaaactttgtgtgcttataggtgtcccttatctactaagttttcctttcaccaaggaacctaatttcaaagcaaaatttccaagctcaacctcttaaagaggcatggatttcctatggttataatcttgtgacttttttcatagctctgttgtccatcttgatttttccctaaatatataaatcttggaaaaggtggttatcatgtattcttcagtcttttcataaagtatgcagaaagctcattgctaattagggaaaaacatgttaccttattttaaagatccagagagaagcatgtggtggaattatttttgtttctcagggttttaggggatcatgtttgaaaggaaagctaattgcagactttatgaaacaggcatggaatgtgtgcttgatcagtcctaagcaaggaatagatcatcctcctttcctggtttcagagggtgccagctggcttgcctgggatgagactccagaatggacttcctgcgctgcaggcagagtgaagaggagtcagcagcccctaaagctgaacatatttactgaaaggggaaatggaggcttgagtaatacttatcatcctcatcaaaaaataacttactaagcactccactctgccagtcaagaccatgcatgagctagatcaaggcatttgaaaagaatatttttttgccctctaagagctttcaatatacagtaaaatggaatgtctagctattcaggcacaaaaatgggtttaaactctgccttcgcagtaaatgccagtttcccctcagttttgcactgtggaggtctagttaaaagacctattttattgaggaaatctggatgtgattgccttgtagattcagaaatccattttagcagaaagtgagacatggtaatatatttctttgatgatttgaagagtgacacttgtcattcatcaatattttaacaggaaacaacttcagagcaagtaagattgtatgagcaaagactaggcaatagctttggtttgtatagtgttatggaaagacccttagtctaggaatcagaagatgcaatttaaatcacaggtctattctggcacttaataaatgcagggtgatagatggatcattttctttacttctctggctgaaaaaaatcagataatactatcctaatagcagccatggaattactgtgagttaaattatatatgtaaaccacctgacacagagtagtctccaatagtccagctatatggagttattaagggcctcagaaagaaagtcatgctataccatgttttgcctggtgtggtccttacttcaagggtatcaaaaccacatgggatgctggttaatgatacatcaagtccagggtctcacctcagacttagaaaaacacagtccctggagatagggcttgaggagctgcatttgagcctgctctctgagtaatttgaaggcaaattatgtaagtgaagaaaagagatcctgtagttgatattctttactgcattatctcaggttgggtgatattaaagccaacttgtgtattttgttggttgctcagtatgaagaactgagatatagaaggaacgaatgtccagtaccaagcaggagatatggccgtgcctgggagatagcatggcaaggctacaactgacccatacacagcttatatagtaaagagtaagaagtagccctctgggtgcttgctatcctgtaccagggcacaagtataaaaaacgaactgagtttagggcacctgtcccaggcagctccattggtggagggaagggatgggaaccaagcaggtctaaaaggagggaggggaattagaagtgatgcatgtgacaaggaaacttagtttagagcaaaatttggtctatagttgtttttattacagtctatgataacctttttgttatttaataatattagtctataacaacattttgattatttatatttggctttttttcccttaactttataaggtttttcaggagaaaggggcaaatcaaagaaaacaagctgaaataaatcattaaaattgattaagtacacacaaattccaaggtttatactggtgtctgttcaaattcactcctatttctatatctcatatcctacatatttagttctgtagttgcacgcaagagtcggtatttgcacagctttaattcatactatacaaggtactcaatcatcatagatggtgatatttactaaggaacaaaaccacaagaagggattttagagagatttttttaaacaatatcattttggaaataatttatttggtttaattgacctgtttaattttggcttggcagaattagtcatttctggaatattgtagttaatcggagttgtgctttctttgaattcaatttgaccgttcaaaaaatatctgttgtttaaaattgatccttcactgtgagaaggggtgaggagagccacagtttacttctagtgaaaaagttctttttttttttgagatagagttttgctcttgttgcccaggctagagtgcaatggtaggatcccagctcactgcaacctccgccccctgggttcaagcgattctcctgcctcagtctcctgagtagttgagattacaggcgcgcacaaccacacctggctgattttgtatttttagtacagacagggtttcaccatgttggtcaggctggtctcgaactcctgacctcaaaagatccacccgccttggcctcccaaagtgctgtgattacagatgtgagccaccgtacccagcagaaagttcttatttctcttaatagtagtgtgtttcctctccttgtaataatctggatattcaagaaaaaatagttcgatttgtttaaagttcttttttttttgtcaattaggagtatatactaaagtacaaaaaacgctgattttaaacatttcattttaattttgcaattatggtttgttgaatgtaacctgttattattcttgccagatcaaggagaaattaaagagattttaatgtaatttaagtcaacaaaaacatgggcaggaccatgttaatactgttttccactgtaaaagtggcacctagcacagtgcctggcatgtgatatctgtggaataaattagtgaaaaatgaatatgaaactttttaaacaaatatttaaacaattgctttcattgtagtggctgatggtggtaaggcaattagatgaaggagtcttgatttcagcaacttatctgaaatttgattcatctctctacttcatactctttaactatagaaaaagtctgttaatttcaggggttttttttctagaaaaataatggagttctatcattttaaaagtgtatattttattagaagacttataatttaaaaaaaagatttaaaaaataaaaatcagcctggaaaatttattgtccaaaattttctaatggtaaatgtatgtattttagtacctctagctaagacctatgactctttgctataaagatggtccatgcacaacattatgtatagagatatactgcttagggtcaccatcttgtctgagccagaccgggaatactaacaggaatagtcaatccttcaagatgagtaaattcactgaaatgtttgtttcaaatgattctgtgttccatcacagctggaataatttttcagacaaaacattaaattaaaagttaattaagaaagccaaaacagtctaactgcgtttactcccgtattaatgtagaatgtaggatttggatggctgaggggctgtgtgtactgtgtagatccttagaactctacacacttctaccctgggtaacagttaggtgacctttgaaaaatctgaagtccaaatagccatctccataaagggctcctcttaagaaagaactttagaatatgaatctcgaggaaaagaggaggaaaagagaaagattttagatgaaacaattgtagggggtggggcaggtgggtttcactcatatgaaagatcctaaaatggaaatgatatagattcctgttttaaaaaaagaaatgctgtggtgtgtgtctgcacatgcacctgtgcatgagtgtgtgtgtgcctgtcatctacattagttaaaaatgacatgttctttctttattttcttgggcactgttgggggaaaatattaaataatgtagtacattgtaaaaacctaactctgtcaaaattgagtaaagcaatcaccgctgtttttgtgaaacagagctggaagtcagatcaaggcataatgtattacacattttcaaaaatgtcattcaactgcattttaagaaaaaaaaaacccgagacaagataaatatacctgatactctttttaatgaaatgtttcacacctttgtaaaattcttgtgatctgtttatagagccagaaacattctagatgtctatagcttttattttgaaataaaatgttgggattatctaattaaatgggaaaaccattttaagagctaagcagctgtagacaaatctacaatgaatttgtaagcaagtctttctaataaaaaataggaatagtcaatgtgtggtcttcgaaagtgatgtcagcatagcagtccgggcctaaatgcaggctggcaaggtgtatcgtagacagggtgaaagggatgccatacataggtggtgattgtttataatacctgccttcggccgggtgcggtggctcacacctgaatcccagcactttgggaggccgaggcaggcagattatctgaggtcaggaattcgagacaagcctggccaatatggtgaaaccccgtctctactaaaaatacaaaaattagctgggcatggtggcacacacctgtaatcccagctactcaggaggctgaagcaggagaattgcttgagcctgggagatggaggttgcagtgagccaagataatgccactgcactccagcctggccaacagagcaagaacctgtctcaaaaacaacaacaataacaaaacaacaacaacaacaacaacaaagaaacaaacaaaaaatacttgccttcagcctgctcgagatcatatccagagattcaccagtagacttgtggaagatctacatatatggcttcataacctgccaatggaactttgttgattgaactacacttaaatataagtaactccagtaaactattgtacataaagtgaatgtgctgttggaaatgctctgatattggttggcttctactactgtcagtaacctgcactgctcagaaactccatgtggacttcaacagtggatctatgtagattgccttgcaatattcagatttttagatttctgtgttatgatcagtatttcaaagaaaagtttggcattattagaaaaaacaaggaaaaaaaggccattttattcccgtataaaacttcttggtttgatatagaagtatgtagcttttagtgtttttatatataggggacaaaatatttggtattctcaaacacgggaattctgtgtaaatagtactccttgaaattatgaaacctggtagtcttaactagtacaggaattcttaattctttgggggttatgggctctttcaagtttgatgaaagctacagaatcctcctttggattctcataacagccctattgttgtaagtgttatggataaggaggctaaggctaagagcttaattggcagaactggtttttgattgcatgtctgactccaagttcacactcttcccccattctcccacatattccttcaaattttactacatggcaaactaagctctttcagagctggtgctgacctacattgtctggctcatctccttacttcccacatgcatcctaggtagaggtcacgctgaactacttacaggtatttgaaagtgtcatgttgacctttcaacaccctgttccttctccctgaaaatcctttcttattttgccttcctctctaatgctagttagagaacattcctagttgtacttgaagactcagctcaaatgtcaccttttataggaagacttttctgccctcttcttggccacctccaccctcttagatgcccttcctctatgctgtcattgtaccctctgcataccgctgtcataattccatttatcaagctgcaccatgacggatgtctacttgtctgcttttccactattctgtaagcatttcaagggcagatattttgtgtgtgtgtaagatctggccaaagtgtagttagtaactcgagtgacttttttcttcttggagttagatatactttcctgtaatgcctgagtaaagatacgttatttttttctaaagaactctaacacgtgcaatattaatgggggccatatgctacttctctctcagcagcctcaatcacactgataacattgaaaaaatgcaagcttgtttcaaaggaataattttgacctcatttctgtgaacaggaatttatattttaccaggcaatcatttcttagtaatatagttccatttattttcttagtgagttaggaggaaaaacagtatgtaaaaagatttgtaactatacatttcaaagtatttaaacaatagtaacagggtttaaatgtatcaagagttctggttacttttatagtcatcgatattatgtcaccaagtaagtagggaacagaaatgtgttacaaagataaatgaagtagaaatatagaaagaaaaatagtaattttaaagcaactttaaaataagcaaacatgtctttataaaaaggaattgagtaggaggaacagagatcaacaaaattattgtttttttttctacaataccttatgttttattacatgctgaaaagatcgccacaacttaaatttcctctttttttctcctccttaggccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccattccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaataaaattttttagtatgttcaactctcatccaaatggcatatgaccctgtttacacagcctaaagctaaaaatattactctagtttattctaatctattgttaagtattgtgcactgtataccaagttcttagggcacatgaaaaattt

SEQ ID NO: 13814 - DNA, 104429 bp, Human
tgtaagtcttaggtcagaattggatctgattgtataagaaaaaaaatcttatgtaaagtgagatgtggacgaaggaatcaacttgtgcactgtggactaactggagaagcaaaagataaaattattaaaataatagcccaagaggaaagtataaaataggaaggaaaataagtagggccccttgtttgagattatccttaccatctgggttgtaaaacatttgattctaattccagaaacttgataccagaaataacttattaccagggacatatgctgaagaattgtcaggaatgacaaagtgtttacttgtttttaatatctgtatcacaaaatgataaagctgataaaccatacagtgatgtgaaggagtgagtcatagcttaatactttatgacacatatatttatgctgtatcttttacaccccaattcttcccttttcaccctataaaaggtcagagaccactgctgataagcaaagaatccttcaaaatctctcctggctgggcgtggtggctcatgcctgtaatcctagcactttggggcgggtggactgcctgagctcaggagttcaagaccagcctgagcaactcggtgaaaccctgtctctactaaaatacaaaaattagctgggtgtggcggcgtgcgcctgttatcccacctactcaggaggctgaggcaggagaattactagaacccaggaggcggaggttgcagtgagctgagattgcgccactgcactccagcctgggtgacagagcgagactctgcctctaaaaaataataataaaaaaaaaatctctcctctctggaggacagtactgaacatatgcagggtcttttcagtttataatctaatccgtagactgcacagtgctagcaattctgttcacagttatcttttcacaacagtcatcttggaagtacttgattcttaccttgatttataatatttattgagctcacattacagatcattactgtccagtcacattgataaaaccatgtcacttggaagctccagttcaccactcctagctgtgtgaccttaagcagtttacttaatcttactagtttactcatctttaaaatgggaataataatagtgtctgtcacatagccaatatatttgaaagcggtattgcaaggatatagaacagcttgaatgttaagcactttcaaatactaagtgaggtgatcacttttgtaattcaaatggaaatagaataaatgtcaatgaattaatgatctgtatcaggaggcagcataaagaatttgaattggagggttttgggtaactggtaaaatggtggttatctttttttaaaagaaaaaccctctttggggattcctttgtacagatgatctcttaatttgccatctttaatcctcacattattaaaggctacattgattagaaggaaatacagcttccttgtaggtttttagctttttggcttgtttttggggagatggttgctgctatttggagaaagggagaaaggcagaaattttaaccttagtctgataccttttctacaagctggccaccaggtcctttttaggtttttctgaaacctgaccaagtttaattgtcatggcataaaaacttggtattgaaggagttaaagggtctcccacacccctttgcatgaatcgttcttttgtgtacacagctgcagtggcagcacgggtcggaaaggaaatggttagaggaagagctggttttcagacaaggcgagtctgcgaggggggctgcagggtggcctggggttttacatgccagatgtaggcctgccccggtgcctgcctggagctgctggcgtggtcacgccgcggccctgtgcgaattgaggcgaggtgatgagttagcgggttgccatggcaacaggctggccacgtgaccagggtgctgctgccggcgctctgacgtcagctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacaggtaatggggctggcacgagagcagcgccggggaccgccgtgagggcgcgcggaaatccagcccgttatataatggagcagacactgcctgcgacccctgctgcaggcatgcatttgtgaaggcggttgtgattatttggtatctgtttccatgtgtcatgttgggtttgcattgaggctccgcgactgcagatggaaagcattttgtgaataggtttgctgccttcgaggggtctccctccatctctttccttccacactgataaaaatgcatgctgttttcccccgctgtccaaagggagacaggcagtagcacttcctttcctccttcccttttagattttaaaggagccattaggtagcagtgccaaaaggcagaaaacgggagggtggggagaaaaacgtttgcgcttaacctggagagtgtgcaggaaagatggaatcctctagattaagctgcagtctgtgatgttaaaccgccagattgatggagctttgtaagaattctgctcgctgattggtgcagggattgacagcagaggtgatagtgtcagacattcaccaaaattttctccatagaaccctaggtttattagaaagagactggactgcaaaggacttgaaaaaaactgggcgctgttatgcattttctaaggagtttatggccaccgcttgggtgggggagcctttccttcttatttacagtaggaaggtgattcctggtcttttgctgaggtctgttttgaggatgggactgatcttggtcattgtattgtgagccttttgattaatgagttggcctgtacggttggcatcatttttacattaacatatctggcaatatgttccagtagataagctcattaaaattgtttgcattgtttgataaggataacaatgtaatggagaatgcagctagagtcttatgcagctcaaggccagacttgaagggagactgatagcttcggtcatatttcctctgaagttcttttgtactggggtagttatttttaaatgttaccttgataaacgctaacaatgcttttgctttgaggcagagcacacatacctctaaagcgcatcctctcagctgatgagcaacaggaaataactctttttttcctttttagagccgtcatctaaacattcagatggtattatgggtagaatattgtgtgtgtaaatgttgcatatcacaaaatagaaccagaaagtaccctacttcctttctctttggccaaagaaatgcagtatttgttgactcaaaaaaaaaaaaattataagcaacctttgccctgtcatctctggcagttacataaatacttggagttaattttggctgtgcccatgaggtcaccaaaatctcatgccttatggttccaactaatgtgttgatatggcattcttacagatttcaagtgcttgttattcacttaatgtaaatcaaaattcctccacaacttctggagatatcctttcagagaccctgtgattggaaatttgggcctcttctcctcttactcctccacctttttcctctgtgaccatcccaaagcctaaaaatagaatttaaaaacaaaaaacttgaagtgattttaaatctcactagtttgaactttttttgtagaaaataaatttgaagccttcattttctaaatgatttaatccctgctgtgtaggtagcagttgcttttaagacagaattcgaattttaccccatgggccaaaggaagttgcctggttgggttttattactcatgtaaactaacttgaaacggcagtggaaaatcatttgacagaaaggttaaatgttacgttttggtgacagattattgctttaaaatgaaattttatttacctctttaattcaacccaggctattatttgcgtttcctaaattatttgcagtttgctttctgagtccctataatggcattcaaaattatgtaaaaaacaaaactgaattttaataaagatcttactgaacaaattcttaagtccctaagagcatcactgcatttgtatttgatataataggattactggatgatatagcgagaggtgtcataggctaaatgaagaaggaagcctctcaaattgcatttgtcttgtgttatacaaagggtgcacatggagacagacacattcgatgtttttcttcttctgtttttctttcaaagtggatgtccagtgtaataattaccacttatttttttggaggggcataggaaaaggaaaaatgtgacacatttttctatccaggaagcattccatcattattttggcatcccaagactggaatattatagccatttaattgctgaggaaacttggaaggcaatttgaaagcgaagagtagagatttaaccaaataaaagttttgccttggctataggtttggtatggccctcaacaatgaagatgtgcctggaagttctgggtggagtcccttatggtggggttggggttgagtgagcccagttccctggcaagatcagagggaattctttccctggatcctttattgacttctaggtaggcccccgaacaggtctttatcttaggctttcttttcttttctttttttgcgacagaattttgctcttgttgcccaggctggcatgtaatggcgcaatctctgctcactgcaacctccgcctcccgggttcaagagattctcctgcctcagcctcacgagtagctgggattacaggcatgcgccaccacgcccagctaattttgtatttttagtagagatggggtttcaccatgttggtcaggctggtctgtaactcctggcctcaagtgatccacctgccttggcctcccaaagtgctgggattacaggcgtgccccactgcacccagccttaggctttattttctacctttgcctgttgtatataaaaatatctagcccccgttgttagagagatattgtgaggctaaactccatatttaaaccaagtaatttcctaaaagagctatgtaacataagaatactgttgttactgaaaaagggctcttgcaggggctcttggacgagaacatgtctcaccttgctggcagcacaggtgagaagaggagggaacacctagaggatagggtggctctcctgagcattgttaatgggcaagcagtcactctttggagaaggagacattactgttatagcatttgcaccatattgttcataagtatgtcaaatttggttcctgacccacatctcttaacccaggtatctgatagtgtaaacaaagcccattttcacagcatggaacagagtgggtggcagctcattattgaaactagcttgcaccttgattagaaaagcaagcttcctttagaaaattacccctggattagtaattccaattgaaaagagtaagtacaaaaatggcttagcagactcatagagacatgttttcactcctgtgtgatttccttctcagcctcagcttcctcactgtgtttatgaatgctagaaatctatgtattttaagacctgcttaaaaaataaatgtggtgtgggccatccgaggtgacactgtttaattcacagagcgaatgagtcgtgctctggatctccctggagaggatgctccccatagctctgtttcatgcagatgctagttggaaatgagatttattaactggctctctgcccactgcatctttgtttgtatactccaggcttttaagaatgaatgtataagtctagaggactatttccacatgggtgttttgagcatgcgactacagtagcacatgtttctgaatactttaaaaaaaaaaattacttggccccaggaaatggattgcagagaaaagcaaaactaaaatttaagcctaaagcattggccataacatccagctttgccagttttaaaaaacatgctgttgttaaggaaaacaaagagaaatatcgtaatattgtgcatgtgtgtgtgtttttttgtgcacgtgtgtgtataaaagagttgtgaaagtgtgttccattcaatagaggctattgtaacatggctcacttttatcagaacataggcttcacatcacattccccaaaacagcagttatagattgcaaaagtctacgttcatgtctttattatgtatttgttagtatcatctaggtttaatactgtcaaaggaggttttccaaaaataaagatttttgtccttactatttttcttagtgtttgtaaaaatcagaagattacttgatgctttagtacatgcccaactctggaacttcttttacggattttcagagcttctgttaatggaatggtcttccgggtgctcttgctttggggagaggctcactcctgctctgtagctggtatctgttgacagtgcattatcttagagcagtgctgtgagattgtcctctggaattcagaaggttgatttccttatgcagcatcttttctttatttacagggacctcttgaagctgcagtgaataattctagattaattggaaggggaaatttgggactaatttaaatattctgtttggtttagagaattaattaattttacaaatatttgaaagtctgctctggccaaggtctgtgctagatgccccttgaaggatcttgagtcctagtaaagtccgatggaaaaccgctcattttgtaaaagacttacagtgttggtattttgcttagtctgatagcgaaagtggtttgcatttcctgaacccccagtgacccaaagggggaaaaaaagtttctctgaagtccagtgtgctgtaggaagctaaaagacactgagagaaaccagaaattttgctgaaaagaatgtaggctttaggatcaggcagaattttcactggcctggccaggtgtgttgggcagtggtagaaaataaaagcattgaaaagcaggcggggtagttggaacttggaaataagaagctactgaaagtttattgactgaagatagtgtaatgaaaacagatgcctactgcagtggatcttcagttttgaaatgagagctaaaaggaaaacgggatcccaatgcaccactgtgtgggtctagaatcactagaaaatacttaatgccatgcgagagcttgagccctctaatgtgcagagatcaggactaggtagatgttctctggctcaggatgtctttccttgagtagaagcaatgaatgcagctttgttccataatgagactggtacttagcccagacagtggcttttatatttgcagatgcccacttcatagctatcagtctaacttttaggagtggcaagtgtggagagctgccactattctgatcttcccaaacaatgaaccaggtttctggttcattatgaagcatcttcccttggcatttaatgatgtaaaaagttccgatgtggctgatgaaactgctcagaacactccctgtgactttggggccaattcctctgacagttagaaggttatcaccttggtggcagactccagagtggatggagtttaccctaaatagtgtgtgtgtgtttacttcttattttagtcaatttcactttaaaggacaaattgattttcttctctcctgtgagaagtatcttttttctacagtgaattaagttagaatatatatctaagaacagttttattcttcctgacttcaggccatctttcagctagctgcctctgtaatactacattgagtatgtcaaacttagccaatatctgaagcactattccaacagccctttttctttctaacactccacacacatcccattggtatcatacaaaccttgtttcttagctcattttaaaattccgattgtttatcttagtgtttctggcccttggtctttattattagattgagagaattctctcaaagtggaaacctacaattcacataggcaagaaattatgcaacatttaccttatagcataaatcaaagaaatttctcctaaatatgtttttataaaatgcctccccaaagatgatcatttactttaatgaaaataaatcattagcaaggtaaagactgaacagagttttataggccaccaataaataatttcttagtaggttacttaaaaaaaaaaaaaaaaacactgtgttttcagtgtcaaatctccccaagtgaattaagattttactcacttgaaccaggacagagtttcttaaagaattactgtcttttctaagggagcagaagtttgtgataaatacatgaaatgatcaagttgacagctttgagtgatggtgtcctctaatgcttatctagttaagaaaatatggcaaaaactcaaactttctgtgatttctaggcctctctttgttccagcaggtaaaatgaccatgctggaagaatctgattttagcaatgactttggaacagaaagacaacatggcaagaggtttaattggcttacagttctgcaggctgtataggaagctggcaccagcatctgctcagcttctggggaggcctcagggagctttcactcatggtggaaggcgaagcgggagcaggcatgtctcatggccagagcagaagcaagagagagggagtggagggggaggtgccacacacttttaggcaaccagctcatgtgagaagtcactcagtgtcatgaggacagcatcgagctatgagggacccgaccccatgacccaaacacctcctaccaggccccacctccaacactggggattttaattcaacacaagatttagaggggacaacatccaaactatatcatatatttatatagtattaacacatatactatatatgtgtgtgtgtgtgtatttatacatatgtacactatagaaagtatatatacacatacatatatacttttagaaagtataattatatatgtgttacatatagtattaacacatatactacatatactatattcacacatatatagtagtaacatatatgtattatatatgtgtgtatgtatactacatacacatagtatttatagtattaacacatatactatatgtgtatatgtgtttatagtatatgtattaatactatacgtacactatactatatatactattatatatagtgtatatatagtatatgtgttaatactataacacaatggtgagaactgggcatatatagtatgtgttaatactatatataacacatatatatgtatatataattatactttctaagattatacttcctaaaggcattttggctatccataaaaatttatacagaagaaaatacaaatttttatagaaattcacattttaattgtgtgcaaaatcgatcctgaagtttatggccaatgtttgttgttgcgtatgactaaaaagatggtgctgttgatgtgagacacactttagatttctgtgatcctatttcatttttcatagaagtaatacttgtttttgttttgttttgctttaaagacattaattttttgttctttatttagtgtcagcctaccctggcaaagccctgggaggtaatttgtcaaaaacgccaggtaatttgtcaaaaaacatctctgggaggctttcttatgttcacagctatactttgattataaacagtggtatccctgattgaagggccctctgtgattccctgagaggtcttcatttggtgctgtgcaagtcaggagaaagtgaagctaagtgagctccttcccccactccctcacgccatctacttcctttttatcattttggagtgccagaaagtgttttcaggttctaataatgtcatttttaaaatccccactcttgggttttacacaattattgttacattaaagtttaagccaaaaatccttctttcagcagacttaccgagttcctttaatgtgccaaccttcctccatgctgggcccttggaatacaaagataaatattgcacagccctcccttgataagaacctccaggggcctggacagtgggcgagagtacgtggtgggagggatgtgagatggagaggttcccacacctgaccccagagtatacacagggtgtgtgttttgttttttgctgaggtgtggctgtcattggttcagaagtcttcctgatacttgtctgaataaaagtaattttgtgattattgtgttgatacttgggaagggcaaaattatcactcctataattttcaaaagctttcagaaatgtagcgtgtaagtaaaaatgtgtgtgtaccctactatgacctctatatttgtcttacgaacatagccttgaggcacaagcttgggcattgttgagtgatttttgtggcaggaagttcatttctgcttttcaaaaagtcgaggaaaagtaaaaggcttatttatctgttttgctcttccaatttttatatttgtattggtcatcactaggttaaaaatatttcagtatgctattacataaaaagtgaaaatgagatcatatattcatactttattcatagagaaactgaaaggatataaactaataatggtaagaactgggaagattaatcactgtgtacctttttatgttttttttttctaaactgaaactaaatgcattacctcatcaatcagtgatgtttcaattagccctttaatagcataggtttttaaaattaaataagtttcagtttgaacttaatgaggtttacatgttgaaatatgttaggaaacatctgatagatactcatgaacttaccaaagtcacatggatgacagtaaagatttgcctaatgcaagtaccattcttacattaaacatcagtagtcacaaatgaaatgtgctcctatagcatctgcctcatttagccctttgaggtttcacacatagcaatccatagtggagattttgtttcattttctccagagtacattgaagctgcctgtgtgttttgtgatgcgtccagcctgtttagtatgctctgtgaatcttacactaactgcaaaataatactctgtgaggattattttaaaatatcctctttgcatttttgttttcttctcatttatcaagctcctgccatttatcaagtacagcaaagggccctaaaactgagattgcaggtaattgccaattttttggccactctgagtgcagtcctctgtcctcctccaactcagcctaacctcccaccttagggaacttaattgggcaatatctggccttcatgtgacccctgtgtgtgatgacggccaggaaacaagccatctgcattcaccatgcatttctgtttcagccctctcacccaggagtctgggtgaaaactgagagaacccccagggagactgaccaattaagaaaaaaacaagaacaaagctttgaatatattatcctcagtatagggacctgctcactgtcagcaactctgaaataaaaaagcttgtggaacttacgagctgaatgtctgctagaaaaggaggaagcagaagacaggatcattgggagatggagtgtaatgggaagtgagtgcagcatggaggacagtgagggtttcttggggtgaacatgccagcctctagagagagtttagttctctgcctccctacccccaccccatctctctccctgtcttttcaagggcagagtaaaccttcccttcgacacttgttctccaaggacagaagaaaatgaagagctctgtgttagcctaggcaggggtctggcaggagaagggaaacaggaccaacaagtctctcccaagtcccttaatggggcctggaatacacagtaaattgttaagtttgagtttgggaagccaatttgggaagccaaattgataagtttgggtttgggaagccaatttctttccccctgaaatttttgacaggcagatagcattgtcataacaatgactttaagatgtcagcatgtacctatttccagcctgtatgataagtgtgtcactgctacctctactccagttcaaaatttggtctgtaccgaaaagggaacctggattgtcccctacctcctttcctaacctccaggaggaccagttggggtcctcaaagtgcacagccaggaagttgcttgaagaggcagtgaggtatagtgggcaaagcttggctctggtgtgagacttttactttctgtcccagctccatccctttctagggcaacatttttttagcttctctaagcctcattttcttaccgtgcatatggaaataatagtagcatcaacttcccagggttcttatgcagattaaatgtgttacagaacataaggtgtgccaaacggtgcctggtgcaaagtaaatgcctcaaagaatgttagctagtattatttcttgcagcttaaatctactcttttaccctgtattgataaaaatctataatctttttgttctaagtaccctgtacaatactttgcacatagcagatgttcattaaaagttcaaattgaacctggaaaaaagtcaaacaaattatactatagtcttttttccccctcatcaactttattaagaatttatgtacagtaaactgcagccatttaaagtgtctgagtcagagttttggcagtgtgtccaccctgaagccatcaccacagtcaagatgcagaacatttccatcacccccaaaagactccttgtaccctttgcagtccaaatcttctctgcccaaagccccaggagccagtgatctgctttctgtcaccacagattagattacattttatataaatgggatcacagagaatgcactcattagtgtctgactactttgactcagcacaatgattttaagattcatccatatgggatgtctcagtagttcatcactctttattgctgagtagtatttcattgtatggctataccatattttgtttatctgctcaccagttgatgaacatttatgtttccagtttttaggaattatgaagcaagtttctatgaatattgttatacaagtctttgtggaggtgttttcatttctctggggaaaatacttaggagtggagtgattgggtcatatggctggtgtttaactttttgagaaactgtttggcaaacagttgtccaaaatggttgtaccattttacattcctagcagcacagtatgagagttctgattgtttcacatccttggcaacacttactatcagtctcttaaatgttggccatccttatggatgtagaatggtatctcattgagattttaatttctattttcatgatgactaatgatgggtatgttttaatgtgcatattggccatttgtgtgtcttctgtagtaaagtgttcaaatctttttccatttaaaaaaataggttatctttttaaatagaattatacacatatgttttgcataataatatagtcttgaattgtattttaatatgtacaggtcttatattcttaacttgaatataaagtcccccccccacacacacaaaaagacctagtctttgttcacaatgacttttacagcaattagttacatggtccatcctcagtaagtacatattaaatgagtctatttagcccgggcactgtggctcatgcctgtaatcccagcactttgggaggctgaggtgggtggatcacttgaggtcaggagtttgagatcagcctggccaacatggtgaaaccccatctctactaaaaatacaaaaaatagctgggagtggtggcacttgcctgtaatcccagctacctgtgaggctgaggcaggagaatcacttgaacccaggaggtgaaggttgcagtgagccaagatcacgccactgcactccaggctaggcaacagagcgagactccatctcataaaaaataaaataaaaataaaaaaacagtatttaatatgtaaatagagggtaaaatagtaacagaataattattttagctgagaaaaaaaaaacactgaatctaccttagaagttttatatgaacatgttacatttgggaggtagtcttggtagataggagatgctcttctagttctgtggagaagaaccctataattaagacattcttttctttgtattgtgtgtccccttcttgctagattccactattaaatttaagaggaaagtgtgcatagaaaattttttttctttaattgtaacaaggataccatatgttctcacaagtggcagctaaatgatgagaactaatgaacacaaagaagagaacaacaggcattggggtctacttgagaggggaaggtagaaggagagagaggagcagaaaaaataactaatggttactgggcttaatacctgggtgatgaaataatctgtacagcaaacccccatgacatgagtttacctatataacaaaccttcacatgtacccccaaacctaaagtaaacattttaaaaactaagtaaatgaaaagagggaggaaaaataaatgtaacaaggagccatttgcatgcttccaaaattttgccaagaatagccaaagcgttggatgccccccttttaaaaatttttgtggtgaagatccctaaacttgatctctttccattcccattccatctaatttggcagttttgttgttgttttgctcctgacttctctaactccctaagaagaaattgtctcaagtaaaatttagagactgggaaacaaaagcttagtaaggtcataggtttgcctaaaaggatcgactgagggacctcgttttggagaagatgaggatccttggctcccagaatctgttcagaaatctttccagctaaaagccagtttcttaactacatatgtttcaaaatccaaaaatgcaaagtttaagttcactaatgatttcacaaatgtcctaggcctactactagatttcgtgggtgccacttatttcgtttaacatttattcattttattgccaaaaggttcaggccgaatttcaggtgagtcgctgcctccatggtggcggcagtcagatgattctctctgttctggttgggactgagtggaccacagccactcaaggatcccttgagagttgcgagtgttctttttgatttgaggatgtgccgtgaacggaagccaaatactaatagacaggacatcctgtgattcccttagtttacgatggccaaggatgtgtgggtttttttgtttgtttgtttcttttttttgataagatgattacttggtttttttcctgttaacaagggagcctagatgatgatgtccatttggcttttaggactcttaactagcaaacaactaagcccctgcaaaatcacatgaagacattggaaaatctttttatgtaaggcagagatgatttggtcatagttcgcaatgaagtgaccgtcagttctattggcttgaaataataatgaaccaaagaggggaaatgaccgaagtcgaagttcttgaaattaaggatgttaaaataaaattctgaaatctagtatactgtggtatacctatacggttaagtattatacaaatattacatgtgaagaaaatatgaaaaaagttcacaaatgtaccaatgttaacagaagcaagatgattattacaaacgtttatatggattatattagttttccagggctcccataacaaattaccacaaaccgggcggcttcaaattgatcctctcacagttgtgatgccggaggctagaagtctaaaaccaaggtgttagtaaggccatgctccctccaacagctctgggagacccttccttgtctcttcccgcttcttttggcccccatgtgctccttggcttgcagcttcatcacgcccatctctgcctttcattatcacctggccttcttcatctgtgttttttacatggtcgtcttttaaggaaccagtcattggagggcccaccttaatccagtatatcctcaccttaactaatcatatctgcaaagacctttttccaaataaagtcataatctgaggttccaggtggatatgaatcttgcagggacactattcagttctctgtgtgtgtgtgtgtgtgtgtgtgtgtatgtgtgtgtgtgtgtatacatatgaacccatttttataaataactgtatgtgtgaaacacatacacacaggtacccctcaccagacacacataaaagatgtttagggccagatgtggtggctcacgcctgtaatcctagccctttgggaggccgaggtgggcggatcatgaggttagcagttcaagaccagccagcctggccaacatggtgaaaccttgtctctactaagaatacaaaaattagccaggtgtggtggtgccagcctgtaatcctacctactggggaggctggggcaggagaatcacttaaatccaggaggcagaagttgcagtgagccgagatcatgcaactgcactgcagcctgggtgacacagcaagactcttgtctcaaaaaaaaaaaaaaaagatgtttaggaagatatgaatatgagtgttataactgggtgatggaacagtggaaattttaattttattttttatctgtattttctgcattagtgaaaatggacagatttttttaatagaaaaatctggctttttgaataaacagtagcactttgacatcttaaaaaaattgtagatttttatttttactagcatcctactttaagtttgttgttactttgcctcatccaactttaatgaaatattttaactttaaataattaatcctttgtagcattatacatatataaatatacataatgaacccattaatatatttgtgatattaaatgtttattatgcttattattataacaatagctaaagctgaaataatataaagtaaaataggtttttgagacattgaatcaaccagtgtgattgtcaggtttttggtttaggtttggaaagccaaaaaaagaaaagaaaacttataattcttactcaattgctgaactcaaacctttttttccttaaaaatgtttttaaagtctctaaccctaggaacctagaaactcggtatggaggcaggatggggagggactttaccaaatttttaaatttcatctgttcaaattggctcaaatactgggtaacttttaacacatgtatctactctagaactacttcatccactgacccttcttatttagacatttgtgcctatagtaacatctctagttatttagtcaaaaagtttactaggtcttgtggtaatttcctttttcttaattatctttgaatgcttattaactaattgttactgttctgtctttatcccaagtttaacaaaacattctcaattcagtaatgacccctatccctaacatttgttaaactactgcagtatactgtattaaaaattttgtcctttgctcctgtaagtcctcatagcatagcgctgcagaatctaaagaggagactgcagttcaaaaagcttccctgcttccactgtccttcccaaacccatggtcttaccatgtatctgcccctctgtttttttgtttgtttgttttgttttgaaacagagtttcactcttgttgcccaggctggtgtgcaatagcgcaatctcagctcactgcatcctccgcccccctggttcaaggtattctcctgcctcagcctcccaagtaactgggattacagacacatgccaacacgtctggctcatttttgtatttttagtagagatggggtttctccacgttggccaggctggtctcgaactcctgacctcaggtgatcaacccgcctcagcctcccaaagcgctagtattacaggcatgagccaccatgccctctgttatttctatacctgatttggttcaaacatggcacaatttttatctgctttttactggaatgctcagtttctgtacttccctttgaaaattgtagtgatattacactgatgctagaaatgttgtaactttacgtttgacctgtgacaaggtagtagagaaggagagcagagagatactgcaaggagtgtgtgcgtgtgtgtgtgtgtgtgtgtgtgtgtgtgtaaactgatatttgtcaggggctgctaggtacttctaatgcaaaagtctgtcagttcattcttcattccagtaaataaataaagatgtttattgatttaaaaaattcttcttctgttccatatacaatatatacaatgatggtatctggttgcccaaacaagagtaccagaagaatagggaagggaaaagaaggatgaactctgatcctgggatggaattttaagaagatacagggaaatccattctctggctgaaatgagagaatcatttcacatgggaaaagaagttttggggacgatgccctacgaagctggtagtgaaataatgctcctagttttgatagtatttccccactgctccaccaacttagctgaacatcgtttatcttagctcagctgtagcaatgaccaaaatttccatttgctactcatcataaagtgcagaagagaacctgtcttgtatataatttgcagtttcttctttggggctggagcatgggtttgatgtagaggcagatcagtaccttgccaactgaacccaaggagttaagtttaatgttgtgctatttcccagtttgaagttttcaattttgattctgtgtcagagtctactatggaaataattaagaagagtagataagcacaaatatggctgggggcataaggatgtcttttggagtcagattcactggaatattttttgccactggcctgtacttcccttgtcctgttaataagcttaattttattggtacttcattttccattttcatttcaaaatgttctcatgagtttaaaaatcaattttaccataatgtaaatacagacctttggataggcaccaatctctaagagtagaatactgagaggcttgtctatttttttttaaggaatagctttttctaaacacatagtcaagataccaatctgaagtctttcattagctttgaaaaaattataagcagtataatgtacatggtctctgtccattttgactaatttaccacaaaaagcaaattgagaggcttgaaccccaaatctgtagtaactagaaatgcacgatgtgatgactcctacgatattaacataccttatatgttacagctggcagatttgccagccaaaaattcattcccagcgataaactgagtaactagccacccaaatctctacattttgagcttttcttcacagaaacttaaaatcatcttggttaaagtgaaaatgtaaaatgagatcttggtagaatttaaaaagacaaaatggcttattaaagaccacaattgtgtcctcacttggaattattttttcttcctgcttaatctcatgacataaacacaagagcagggagagtcttaattaaaagcaagaatcctggaattcatcctaggtccaaatccctgctttgccacttaataatggtgactagacaagtcactaaacctctccgagtctgtatcttttcctacataacataaaagcagcagtgatcacatggcattgttgcaaagattaaattaaaaaattcctgttttactctttcattaggcatgtggaaagttttcaataaatattagttattgtaacttctaatctagttccccttgtttactagtgaagaaaaggagatcccaaagagttgagacacatgtgcccacatttatccaactggttgatagttctggaactagaagctgctgcccctgatgcctagaacagagctctcattaagctgcagggcagctagggagcttttggtatctgtgttccagacatttccctactcacctttaaaaaaaaaaaaatgcctagaagacagggtcctttaattcactcaaccctagtctgttcctagccatctcacatagcactaggggcacgtattgatatttgccttttgtatgatttggcacacctttgtttgcattcattcagcatttatttattgtgtacctactgtgtgccacacacagttccagacacaggagataaagctgtaaacaaaacatattctataaagtttctgccttcatagagcttacatcctgggggcaagaggagtggacagatggtaaacaaacaagataattaccaatggtgttagtatcaccgagggcagagtagagagatgtgggagtaactggaagcggccacttcagaagtgggcatggagggttcactggggagttgacatttgagccaaacctgaagcatgagatgcagccaaccctgccaagtgctggaacaagctgctcttccgtggcatgaggtcttgagccccagttatccctaaggatgaaacttgaggctttgctctgtcatttgtttcttattatgagaagatttagaaaaagcagacaccgaagtacctgagaaggaactagcaccaccaagagtacaagagagctcagaaccaggaggtggggaccactcctacaaaatgtgtgcaccacaggactttgcctagtggcagcatgattgtttgatgaccgcatatgcttctgctatattgcatgcacctgattttatgcagtggactaacaactgagcatgaccacccactatggtaccagcagcacctatgtcctgaaaggttgacccagggccctgctcgttgggggcagcgtgggcatgactggaaaagacctgggatcatgggaaagagctaaggtcagggtaagagggaacgaggccaagtagggctgggaaagtaaacagaaggcatatggtcaagaaggagtggatgtgctgggagctgagttggcgggggagggggtactgagaaaagttggtgccctgaggagaccagccaagccctgtggcatgggaatgagctctaggtcattgaaattattttcagagcatggacgaagccacccactgctagaaacagatggacatttaggcaaatataatcagctgcatttctgaccatatgaagaagcgtatgtctatgtggggcagggaagggttagccttttactctctcattgtacatgtcaagtttcattcatatccatggacgttatgaatgctacaaagaacttttttagaattccaaaattttgtcataccctggataggagccaaatttccaagtcatttcagggctgtagctattgacttgttaagtctgagtttagaaaacaaaacaaaaatccacccgtatatgctgttttgaaagtttgtcttttttgtttagttacgatagggtggctagccaaactaagccctgtatgcaaggagctgcctaatgaatagtagtggatgaggttaatgcagataaataacaatgaggctgttaaaaatggagttgattttcaaggtgacttacggaatgtcctattgtaggcggttggagacacctgtgttttaatgatattctgttggttttttttcttaaaacatatgtagaatacttggtgatatggcaagaaagagcttaatctccgtgttttgaaaaataatcattaatggtaaaagggatgggcaccctgaaaaagagtattatttttatgttcattctctcttggaggtggcagttattagctgtcgttaggagtttgattgtcagactaaatggaactttgtatgcacattaaaagcattatcattaagaagtgactgataatgaagagcacattcatattggaatgataggcagcctggaaaagcctgcagtagagagcaagcacctcaaacctgataaaactcacatttatctcatcttcctctaaacagcatagttttgaagattcttacattggtcttcttcactagttctaaaccatcaatgcctaattttgagagaaaaaaatagtatatttcagtgtctatattttaataaagtatgtgcatgttgtcatatggacagtgtcctgatgtttctccatcatccttgtgtgaagtcagttccgtgctcacacccctgccacatggagaggcccggccgcagggagggtctgtgcctggaggagttggtcttgcattgtctgtctaatcccatcacagtcatagagccccgtaaaaataaaatacgtgcaggtctgcccacagcagcttatgtgtgctattacctggagacaataaatgacttcttaaattcccattccagccctagaatccatgcatacggcaattagtccacaagttaaacagaagctttaatacccagttttaggcgaaactccatagttcctgtaatctctctccaggagattttatcctgtcaaggtttgtctttcagagacaccctctttgactccctctttgctccatcctgatctccctcctcaaacaaatactttctctgtgccccacattgcaggtcacaaataaagagaaagtgatgaatctagaatgatctggtgatattctttccttgggtgaaatgtttaaatcctgcctctcgaggtattgaacctagagaatgaattatgcgcagatgaaaagcgggatatttctggttcaggagacacatttacactgtccctccctatggaagcccagttcattattaggggaggctgtgggagatttaacatcagccttttgtggtgaggacgctgggaaggaggcacgcaggcaggatctgtgtttacaaggcttttcagaggaaaagacgtttggggggatgtctgtgatgggactgaatatcttcattcccctccggaggataacatatattctaatgcagaagtagtctttgagaaaaacttttgaggtttcttcctttggctaagtatttaatctgtgggcatgaatgtacaatttgcaggttattttagaaagatgccacttctaagagaagaaaatattggtgattgataaatctctttttaaattctcataatatttgcagatacttagaaatgtttacaaaacggctatttctgttagaataacacaaaattcttctaagtaaaaagccttctttacaagcgcatttgaaataatgcacctcactttacctgctatgctggaacaggccaactttggcaatcctaaaacctttaaccaggaacaactctgtgaaatgagaactgacagtgtggccttgacctggaccgagcgaaagtccagtgactggcaaagaaagccattcttttggatcacaggtccttctcccctgttggcatgtgtagaaacactttgaaaggatctcaaacacctagtcagttggacttaatttccaaggaagcatcgatatttctaaccattaccttaataaaccacttgggttataagaaattcagaaatcattatatgctcaagcccaaagaaataagtttcttaggtgaaagaaaaatatactttttctttatatctctcttctagtctgctcgttgtttcatttatgtgaaactgggtgaagaatgcactgcatgtatttaccctaaactgttggtagtggattactttccccagtgatgggagaacatgttgaaaatagagattgttatgagagaaaagaaagacagtcacacatatcacacatatgggtatggttgtcactgcaacatgtgtgaacagagtacattggcatgcggtgggttgaactttcagaacttttgttgttgttttttttttgagatggagtctcactctgtcgcccaggccggagtgcagtggcgcgatctcggctcactgcaagctccacctcctgggttcacgccattctcctgcctcagcctcctgagtagctgggactacaggcgcacaccaccacgcctggctaatttttttttggtatttttagtagagatggggtttcaccgtgttagccaggatggtcttgatctcctgacctcgtgatccgcccgccttgtcctcccaaagtgctgggattacaggcgtgagccactgcgcccggcctcagaacattttatgttgaacatgaagtttccagttgaatgtggactcctttaaggagtgacataaagaaggtaacttaaaaaaaaaaaaaggagaagaaggtagcttaaatccaaaaggccctttaaaggctcagcctccaagtgggtttggtataagtaaatccaggccaaatggggtctccttgcagcgcagcagatagcagtcaaccacttatggaggctgttcttctgcagatgaacttgcctgaatttgggaagtttggtaaactcagactttagatgatataaaaacaaaaaagtcaggctgggtactgtggctcacgcctgtaatcctagcactttgggagcccaagacagaaggattactttttgagcccaggaattcatgatcagcctatgcaacatagtgagacccctgtctctacaaaaaaatgaaaagtaagctgggagtggtggcacacgcctgtagtcccagcttcttgagaggctgagctaagagcattgctttagcccaggagattgagcctgcagtgagctatgatggcaccactgcactccagcctggactgccgagtgagaccctgtctctttaaaaaaaaaaaaaaaaaaaaaaaaaaaaaaaattctggccaacgtgatggttcacacctgtggtcccagctactcagggatgctgatacagtaggattgcttgggcccaggaggcagaggttgtgagccaagatctcaccactgcattccagcctggactgcactccagcctgaacaacagagcaaagcctcatttcaaaaaaaaaaaaatcaaaataggttccacattaaacccttttccttatagccacacacctcaaatgggaccagagccagatcccgggacaacaactggcctatcatgaaacctgctggaaaaaatatacatatatgtatatatactgttttgtcctccaaaatgagtgatcggtgaagtgtgaaaagagaaaatgaggacaggcagccccctcccctgaagtatggctgatagtgtgtttgcaaggggtggggcagggcagagagacaaaatgaattacataggaaataatttcagttaacactcataatgctagctagcacatattatatatttgcttaattttgaagagccacttctctggaataattcacaaaccttgccaaatttgttcttgaacaaaattgttgagtattttgtagttaagttttaggtgcagaactggtaaaggtggtagaattcatattttgctcagtaggctaactcaggtctcattgactcacataaaactccatttattgtagtaagcagaaatacagtgtctaatgtgtctgattcaatcactactgcaaagcataaccttgctgtacctctccacccaacaccaccgccaaatactgaataaaggatgaaactgagcaaaatctacacattggccctcagctggaggctttcctttttctaaagtcatgtgtatcagtggtcactatccacagacaagctagaatcgtgactttgcctgctagaggtctgaagggatttttgttttttctgtgtgtttttctctcttctgtttgcaaaacaaaacaaaaaaccagctgggtgtggtggctcacgcctgtaatcccagcactttgggaggccaaggtgggcagatggcctgaggtcaggagttccagaccagtctggccaacatggtgaaaccctgtctgtactaaaaataccaaaaaaattagctgggcgtggtggcatgtgcctgcaatcccagctatttgggaggctgaagcaggggaattgcttgaaccagggaggtagacgttgcagtgagccaagatcgcgctgctgcactccagcctgggcgacagagtaggactctgtctcaaaaaaaaaaaaacaaaaagtgtattcccaccttccaagaaagctattctaatattcatgtaaaaagtgtgtaactatattgtgattattagtttattttcaagtaggggcaataaatgcaaatttgttttaaaataaaatttaaatacaatattaaagtgtggtgacccagggactgcagtgctaggaaagtgttcctcccttatctcctgcttgttgtgctgttgcactgaccagatctttatttttatttatttatcttttttatttttttttgagacggagtttcactgtcacccaggctggagtgcagtggcccaatctcaactcactgcaacctctgcctaccgggttcaagcgattctcctgcctcagcctccctagtagctgggactacaggcgcatgccaccaaacctggctaatttttgtatttttagtagagacaggatttcgccatgttggccaggctggtctcgaactccggacctcaggtgatccacccgcctcggcctcccaaagtgctgggattacaggcatgagccaccgcgcctggcctgcactgaccaggtcttaaacaacacagtgatctggttgagattccaattgaaagccacaaagtgggagacagcgctttgactttctcctttgcaaggatgggacagagagatgctcatgtcccagaggccatgtggcaagtcacctaagaataaactgttgtttccatgtaaaagacatgctgaagatccaaacatgagaataaaccccgcacagtgagttgctccttgttctgtaatagttagtatgaccttacctttcataaccatttatctttcttgactgagtctttgggaagtactccatgaattaaaaattagctttttgaattgtataattcctaccttccataggatgttgatgtaattggtaatatccctaaggactagcagtcgtgaattgaagtttgtgtccacttttgtaagggaagagtatgattcctgccctgctttcctcccaggattcttccaagggtcaatagaaccactttatctctaaaaagatataaaatttccttgtgttatccacacagcatttctgcagactaggtagggacaagtacttttacctttatattgtcatatagattgagaccccagaaatcataatgaaatcttaggattttagaatgtatccacctagggactaggacaatttaatactctctcacctgagtttaacatttggaaaaaatatataaatgttctgtgaatgttgtagccacttgtatcatttaagtttaactatatggaaagcatacctgtagaaaaagcaggagctgaaagaattgggaaaacaaaagggtggatggcagtgcaggaatagaatcctttttccactttggctgacacttcacttgcgggaggttcaggacagttccccttccagggaaagtgagtccagactcagaactctcaggcctaaaatcggaaaagctggcttgtttgggttcggggcaaacattgggagcaaagacagccacagagtgaagtgcgcttagaagtaccttgctgaaatttggaaagaggaagatcgattataagaatattcccatcagcaggggtgttaaatagaaattaactatattgatttcattgttattaatttgaagtaggtattgaagtctactcatttaatgtgttgttattttattttaggaaatggtgaaaaatttcttgccttcattggttcacttattcttaatctgtcttctaaactagttatcccacaggtcccttaacacatggtagcccctgccacagggcttgtgaggactacagctgtgttggctagcaatggtggagatttgagtggtatgcctggtaactaagtacccagaatttttctaaagcccagatctggtgctgttttcattgtttacctgatcatcttaatgaactgcttgaaggcagatagtgccttgacttacctttgtgagctgaatgtctgtttacattatgaaaggacaattgttgtccttaagtgaatgttatcagcaaagacctggaggaaagtgtgatttattgacaaactgcagcaaatgacctgcttccttgtttatatggatttttaaaaagctgtcattactcttctacctgtacttctgttgtatattaatttctcttatgtaaccacagaacgtttttactcacttgtgtatgggttatttttctaaaacacagatctgtttgtgtcttttctgctttgcatttagattttttttaaatcatcttgattaaaaatttcatctcaatttggtttggtgccatctagcataaccctgggcctcgacaccacatcctccatcagtacattgcccggtaatgcagaagctttccattactgcctgaagaagaaaccgctagaaaagcccatcagctgccaaaagttatgccagtatatgatcatttcatcagtccaaaatattttaaattttgaattatttacccttactaagattatacataatttacatagatgattttaaaaattgactacatttaaaaagcaaatggtttcgtttaataaatgatagactaaagaaaacagtggaagttattaaccaaaaagtaaaaaaccttcaataatggtgtacaaagcagtaattatggtcacactatctgagattcctatgctgtgagatttttcagatccttacgagaagacaatttagagataagggtgcttctgggaatggagtgatagatatttatttttacatttatttctaaatgaaaccttcatttagcactttaaagtagaaaacagatttttattgctttcatgagcataaataggaactccaaacacaactatttcataaaatgtagatttttgtctaaaacctatatactatagattttgctattatatctagtcatgtttaaaaatattacttctatatctgtaaataccatttttcactaaaaggaatcaggagcgcttggagaaattactggttttaggtctgaggcaagaaatatacaagttggccttggaacatctcgtcatattggaaaagaagaaggttatcaaagaccactaagactgtgtcaaaagaacttagaggctagcttgaataagctcttgcaagcttttatcaataaaggtataatttcaatggattgaaacatatcaaatatgtttaagtccgtggattcataattatacttcaaaatataagaacaaaaacttcattggtcatgtttggagaatattagggaactactcatcactttgaaaactggcaaatagagaaaaagagttaggcacctctcctgcctttcctcgatgacctgtatctcagggtacctcagggggaaacttctctttgtagaattattccagctaataaatcaagaatgaataatagaatatttgaagttttagtgaattattggatctaggcaaatatcagagctaacaatatcatggaagcaggcagtcagaggtaatagttatctgccttctgatggaagttcaaacacggcgtgaaatagtctgtttgatgcaattgtcatatactggcataacctttggcagctgatgggctgttctattggtttcttcttcaggcagtaatggaaagcttttgcattaccaggcagtgtattgatggaggattaggtgtcaaagcccagagttgtgctagatggcatcaaatccccgtcccattagaacttgaataagatcaaggctctagatggaattatcagtctgtagggatgcagaggacagcggaacatgttaaaccacagcagtgtgatacaatgagaaaaatccagaatgtggaaactatcagacaacctagttccttcaacaacaactttttttttaattgcaaggaaagattagaaatagagaagaaactttataaagaaatttaaagaatgtatcaaagaatcataatgtatgaaccttatatgaatccagattcaagcaatctgaagttaaatttgtattataatatattgaaatgcatatttgatataagtaattattttcatttttaggtgtgataatattctgtttttttaaaaaaattatttttcagagacacactgaaacacttataggtgaaattatgtgattattggcacttactccaaaataatctggcttggtaggctaggatgggattgacacaaggggagttgataggagtataaatcaaacaagttggtcaagtattgataattcttgaatccaaggggtaaacctaactggtttgttattctcttctctctccttttgcatgtatttgaaagtttccaaaatagaagttaatacatagctacaatatatacatatacatacatatacaatatatcaatatatatatattccacaaactaggtaaaattgcaaagtttcatccaggtttaaatattaaaaaaagaatcctttatcactgcacacctactagaatggccaaaccccaaaacactaacgtttccaagtctttgtagtgagtactgaaataatgtatgaaactaacagattactctggtgtatactgctacaaacctggtaactttttaatatcacacgtagacttacagtcaaaagggagactctaaattgtgttataaattaggaatctcagaacctgaggaacatttggatttagttggagagatataaaatggtactgcatgaaaaatatgtgaaatttaataattttaatgcaaatatgtaaaatagaaaaagatgctaaagggcttagccagagcaggacttttacatgccctggagtcctgccaggatcttgacctcgaataggtatcttttgtgtttctgagttaatttccttgttgttaaataaactttgttttttttctagttggggaatggcggtcaatgtgtattctacctcgataacccaagagactatgagcagacatgacatcattgcatgggttaatgacatagtatctttaaactacacaaaagtggaacagctttgttcaggtaagacatattcttttaagtgtttacctaaatatttacagtctgtcatgtggaatgtgattttatgaaccacagctgctatattttgggtaggaaaaagtatatattgctattggcatgtaattaaagggggaaaaactcagatataactaaaggacgtattgggaaaagtgtttatgagcatccaggagcacaagcagagccacacggacacgtattggaaaggtctcttgcttgagcttcgtaatgcctttcactggctcctagcctcttctctgtcatcccatctgccatcacacttgcctcctgaaaacaccaattggttcttacaacactcctcctttaaaacctctagggctccacgttgtcctcactacaggataaacttcaaactcttttcatagactaatgaggtccttattagtctcaattccaccctccacatctctctcccttatacctcagacccacaatataatctttgttccctaaagactctttcccttttgtatcccatagcttttttcatggttcctttgctgagatctttccccttcttttcatttgtgggaaaatcttgctcatactttaaaatctggttcacctgccacctgctctgggaagcattccccagcctcgcaggctccgtggtgttcctgaaacactgtgctcatcctccaaaatgacacttgccacgtcgtgttaggatgtctaactccttctagccctgaaggtgctgagagtccttgaggacaggactgcgttttgttctttgttgaatgcctgtagttgcctctacttggtatgaggtaggtctgcaaggaatatatattgagttaaacttctttaaaaaataaaaatatttgacttcaatgacaaaataggaggatgttttaaaaaacgtgctgctaggccaggtgtggtgacttacgcctgtaatcctagcactttgggaggccaaaatgggaggatcgcttgagcccaggagtttgaggctgtggtgagctatgattgtaccactgcccaacagcctaggtgacacagtgagaccctgtctctaaaacaaaacaaaacaaaaaatatgctgctagtaaattaattcattcttaggtctgagtatttatgaaagaaataagcagtcctcctttggaaacagggaatgtttccttccagtaaacaaatagataagagatttcttctttccctttggcttcaacatgaaaatggtattagaaaataccactgaaatgtatttgtgtgaaatttcatgagtcagaataggtaggaagaagtcaacattgctctttttcccagagggtcaagtataaagattttatacagtgcagttagaatttcaaaagcccccagtagtcactttcagatgttgtctgagtccaacacccaccagtgtaaatattctcccttcaccaggtctggacttgatcagaatactcctagagcactaactttgagtatgattgacatccttttccctgtgatcatttttcccacgaggaagacagtaaggttggccagaacttaggcgttgcctcactcacaaatctatgcctaggtctcagacatgaagtcttgtgatttatgaggtcagtagtgggtgctagctaaccactcctttgcccttcaatacaagatagagaaaagctgacttagactacgatgatgatgtaccaggcatgtatattgttgatctactgaaatgtctctaaaagttactttcagaaacaacttgtattgcagcttatgcaacttcagatctctacatacccaaatattactgtgctgttcttgctgtgcattcttgagctaatattttatttttaacttgctgccaaaaaagaaaccaaaaacagtttctgttattagcaatcactttgttgataacacatacccctttgtattgtaattgtgaaattgtctatttcttcacaatgcctaatgcatggttttccttcagaaatactcattttggagatgaatgaactgcaatttgcaactgctaaggggcaaagacaaaaatgtgtatcttacccacaaagtgggtatatgtgcatttggataagggaaacaaggttggttatcaagaaaaagagacataggaaggaaggggataaggaaaaggctcacagagaaaatccccaggcatgagtcttaaatgttaaaggaaaccatgaggaacttcctatgctgaaatacacttggagagtttttggtagcaaatgaaataagaacaaattgtaatttttagatactgtagtaaatgtatttataagcaatatacataatctttgcagatctttgaaatttctcataaagcaaattcaacaaaattttaagggacatttgtaaaggattcatatatggtgatcttaaagcattggtgtacatttatggcctttgtagctacactgccatcaagcgtggcttgatttaaaaacacaaaaaaacctgtagaagcaattttgatcactatcaaacagatacacataattaccattaggataacttactggctgcctaaaattacaggattgatggttcagaagaatgaagtggatttaaagtttcctttctgctctgaaatatgtttctcgctagaaaaaaaaaaggaagttaatctccatagtagagaaacaggtcttttattttaggtagcagttttctcaaggtataaactatagactctattcttttataatttcctggggagctgctgaaaaaaagcagatgaccttctaaatcggtacctctgagtatagcctagaaatctgagtttaacaagtacaagtttaagtacttttgtgctgcagcctagagcttgcagtacattttaccccagaccaacaaaaatgaggttaaattatccaaacgtccttggaagtttccttgttcataatttaatctgtgacttttgtctttagcatttagcaggaagaagctatctttctatttatttatttatgaaattatttatttatacccttcattgttctagaaaatatttaaggcagctaggacagtgctattaggataggaacaaagccaagtattgttgacttaagtgacttatattcctcatacttatgagtagtcagatttcttatgtaatattttcttcaatgtttatttcaatttttttagtttactgtgtgggattttattttagcagtatgcccaggaaaaacatacaggaaatactttctcatatttaaaatgatttaaaatgtcaacatcatttcttactctctttcctgaagacttacgctccaatcctggtggttcccattttgaatttttttcctattgcattatttcctatttctgtttttaaaattttccagctaagagatctccctccagctcagtattaaaactaacaccagcttttctttaatttgtgaagagctaaaagattgcctcacattggtgttgtgttttactcagtattttctgcctttatgtaacatctaatttgtttccaggtaggcatttttaaaagctctttaaaggaaagatggcgtgagaaagtagaacacttggaaatatgtttgtagtaagttgcaaaacagtgaaaatgactcactgttatctcctgttattttatcccaagaatataacctcatgaaaattttctttgaacattaaatctgggtcatgtaattatatgggtatctggttttcatttatttcttgtgacaaacaacctttaagtttcaagtaaaaggtgagctatataaatggagagtgggctatcaatgaatgtgaatactacctataataattcagcaatctattgctcacctagatctattttgaaatgaataattgtagattttccatggtggagtgagaaggttgaaccacatgtagtatcagattggttcagcttatagatattttatattttaattcaaaagttatacagcttgggcaggggggtgatagggaatttttttttcattttttgctttagtactagctcaaactaatttactaaatcttttataaggtagcaatgagggtgaatggacagcatggtgctaaaaatctctaaaagctttagcaactttagataccttagtggaggtgatagagaagataggggacttagaggggaagaaaaggaaatggggagggaggagtagggtggagtgggagaaagtacatcttttccttgaaagtacatattttccttcttttcctctccctcactcctcacctcaagcctcctttgagacttctttgtgacattaattttctgtgtcttgatcctctgccctaggctggagctaagcagcaaaatcactgggtccaatgctgggtcattcttgctgcttggcagactgagtgcctgccttgactcccatcctcacaaggctagtgcagcctgcccttttctctttgtgcaccttgcctccctcctccccacccctccactagccgagcagacacctgacttggggcaaatgttaaatacagtctgcatgtagggctggcactgcctggactgtcactatatcctggactgtcactgtctgtcactgaaagctgttattttcctgagcattttagtattttaataaaatgtcatttgaattaaaccatttttagatggaaaattgagatattttcttgacttgctttaaaaaaaagaaagagaaaatgatcaggatttgattcagtttcaatttgtgcttccccaaattggtgcgagctttgtcttggatcaagtcactggtattttgttcttccaggagagcttctgaatttggctaatgatattgtagtcacatttgcaattctggttacgtgatggctatgtggaaggagcaagtatttagagtacactctggcattcacacaggtgtagccatcagatggccctgggacccgtggtgcaggtgctccgggccccaccctgatggccatcattcctgagcccagcagagtgttctttgtgaccatttttggccgcagatttgtgcctgttagataggttgatcccagcctcgtgtgttgtccctgtgcctcctctcttccatccacagagacctctgtcaggacaggttaccgatgaaatctgctcagagtctaaatttagtagggcttctcttattggctctctggtattgaaaccaagtaaggatattctttcagtgtctgtaagcataagagtttacttagctttataaaatcattgactgttatttgctgtaagaaagttaggtcatcttagattatattactattgttagggaggtaattgtaatggaatattattcatacttgtgatatattacatagagtctttttggtttttttgctgacagtttttttctctaattatttgactcatgctaattttaaaagtttacatggtctcagcatatcaactaattggagaagaaggggacaaaaaaaaaagagttggataatggtggggaggggtctagcctcatgttcaattgcttcaggcagtaatatatggtaatatactctagtgtctctactaatgcactggttgaaagggagtttatttttggagcaggatagataatacagtaggttttttttccctccaaatttgttcatttacatcttgacactttgctcccgaagatgaacgtaaattgctgtttctgtttttcttgggactttttgtttgtttactgtcttttgtaatgctgaataccatggtggtgaaaagtgtgtatgcattcactttcatttaccaaactgctctataattttttttacacatatggatgatatatctttgaaagcaaccagccacatcttcgtttatgtccttaactacattcaattctataatcaatttagttttatttaataggcatattttgagcctttctttgggctaggccctggggacccagcgataaataaaacatagtcattgccctcaaatagctcagtacagcagagtactgtcctacaaaagaccagagaccacactgtggtaagtgctggtttgcaagtgctttgagcatacaaagaaggaagtaaatgaagggaggtagggacatagggagtcagtagagagatttactcagattctttgggagtggctgggtgcttctggatgaaagaatggccatcgtttgggaaacacctcagaaatgtccccctccctcttaagtcagatggagtgacaagtgtgtatgtaggataatgtgtggggtacttagtttcatttaccctgacagactccccaggctaggggggcctttgtcttatgacacagggactctagtcagtaaaatgcatgtgctttagtgggtacagcccttaagtacatgaagcatattgtcatctctaaagaaatataaaggattttcttgatgatctcatcacatgagtatgtgagaattgttattactctacttgtttgaaggaactaggcatgcgtgtgggatattctcaggaaaccatagaattggccacttctttgggaggaatgcaccagatacttttaaatactaaagccaaacctcagtgataactgcttgggtctctaactgggtagatgtcatgtgactgcattagtatttatcacaggaacagacctacagatatatccctacatcctattacccatttctgctggagtctctcctggttagtgacgaacaccataaataaggggaaattagaaaaacaggcttagggaaaaatagatcacctggaatgccattgttttattgaagactaacaatatatatactgaacaaaaaatcaaggaacatgtgatcacagttaactttatatagtgccttaacaggaataagtgaatcagtgacatattagaaacaggattaataattgcctttgagaagtctcaataagttctctctctctctctcacagatacgcgcgcgtgcgcgcgcacacacacacacacacacacacatacacacacacacacacaattggtacaaagcagtaccattagtgggaatctcatatttttttccccatatgtgagaaattcccagatgtcatagttgagtgcagtctttgaggttcttattgagtatatcactaattcacaaatgctattgtatctaccctactatagtaagaccctgctgagatttacctgcccccaagccatgaataggtgggtggttgtgagcctagagatgaaaactgttgtaccaagggatgggtcatcaaaagaaatctaagttggatacagttaatgagagtgatactgaacatagtactaaggagtctctaaagcctcatcattgatttcattaacttcagtgactggagccctaactccatagccccagggatcttgacaaaggttgtgagaaaacttgctggagtccaaggacatgacaggttttaagactcatttataattcataattctaattacagaaacctttagagccatttctcttctgattttgtctctgttatatgataagttgctttcttttaaagtacataatgatatgcttattttgaaatcattcaccaagatcaataaaaaccagtatcttaacaagaaaaagatttatctttcaacatattgaaagttattttgaatttttaaaaacatgtcaatcactttatatgatggatatgttccttataaaacactattttgtatttaccatgatactttttctttttcttttctccctttcagtttagattatctaaagactttaacaggaagagtgtaaatttggggaaaaatagtcatttccttttataaatgaatttatgattacttaagcacctcatatgtttatctgaggaaagacttaagaattacagaaaccctcaaatgtttttccacagatgaactggaggatcttagaaatgtgttcataccctttcttgtctggtaggaagccaaggacctcattttattctttggttccttgtcctttgaatctaaaacatgcattttggagattcatgttttgcatctgaaacagtccaattcaagcccattcatttttatagctctgattatcttaaccggttacatactatatagttttatacattaggggtataatgatgtcataatgcctcagcttttatttctctctctctgccattttcagtgtgtttttatatgtattatttcttttaattcatataacaaccccatgaggaagaataggaatattttattcctattttatgaggctaaaagctccaagaagccatgttcacagctgataatgagaattgaggtgtccttggatcatagcccagtactctcattgctgtatgtgtggcagctgtggatgcaacgaagggttcactgtgtgtttgcccatgtggatgtgtttctgattctttccatatccatttagcagaagtcctttaagcatctcctctaagaaaagaaagaaagtctttatctccatcctttacattctacttgaagaaatgagacatatctggtaattctactaatgacaagggtgtgtcccaatggtatcatcatcaagaactttcttaccaaaagtaacgagacagagacatttgctcctagtcttatgaagttcttccttctccacctgctgcaagtagagtggggaaagagccgcctgttctctctgattgttctccttgttccttttcttcctctaacttctttccctccaagcaagatgaggtggctctgaaattttgccacctgccatggaggaactttgcagctctctcaggataattcttggccagtgaaacaacaaccaggatgatgcctccttagacatttgcatgtgcatgtctctgcactgtctacatttgaatcccaagaatatggtccttttcttatttttatcccaggctagcttttgaacaagcttgtacctgagagaactacacatccttatttcctcctttctatgctattgaggaaattacaacatctcctaggataattttcttacaagcttggttcccacaaaggatttacttatcaagttatcactgttttccatgtatttaatccagttcaataaacctgtattgcagtagccatgctaagaggctccatcagtacttctccaaccccttctttaatatgaaaagttgatggtttcttagtcttacgtaaaaggacttactaatgcaacatttaagagtagacaccgatttcccatccagctctatcccttcattcccatgtctggtttcccaactccagccagattgcagctcctgaactttttccatatagccattctagatctgccagtgggtatggtagcagacactgtgctagtgaagtagaaagatgaattgaacatcatccccagtcttaaagatttactcaccagtcagccaggagagagaactaattaaaatgtaagtcaaatccctgttagatttctgtatccagtatagtgaaacaattttgtgttggaaacaggaaagcttcgtagaggaggtgatgttttgactaagcttttaagaatgagaagttattcaagtataaaagaggacgaaaggacattttagacaaaaagtttgatcaaggcaaaaagaagttgcagtgttttgtgcatgtacattgcatgtgtaagacatctgtaacattaaaattcaaggcagcgaaagagggacagtaatacttcaagtaataagtgctgtattcaaagaaaggaaagattatttccatctagaaaagctttttgtcttacccttgtttgggtctttggccaaacagtcattcaaatttagtggatggtcaataaatatttatgaagttgaattgaattgaaatgctattcaaactaggattttaatatggataggattcagacggagaagaagatggtgattttgaggaaagttaccatttagatatcattttgatattctacacattgctttatttattcctgcagtcagcagatatttattgagtacctgcaatgtgtcaggtggtggattaggattggaggatacaccactatacaaaacacaacacagatcatatccagttaggacctatccctttactaccaaagttctccctgacaggtctattcagagagagcaaattcctttttctcagcttacctgagtatgaagcaaaggcagagaaaggcccctggagaaaggtacacgtccagcctgtcttgccatcattcagtgtagggcactaatgggcagtctgtacatggaaacatctgaaatattagcaggcatctggtttctacacagttaagataatcaagccaaacatctccaaattcttctgctcttcaaaagaaaacatttttcctaaccaatttttttctgaattgtgtttttaaatttctagtttatcagacatgtagacactattaaaaaggagtgtcagaaatcactgtcaaatgtttgggcatgttagaattgcatacctggaaacagaataatgaaattgcttggcaactcgtaaagacaccatcatttttcagattgcgtttttttttttcccaccctgaaaccattacgtaattctgacaaatagcaaattacctgtgtttgtcccctccctcccaagggtgtgttcttacccaaatattaatactcataagctttttatgaccaaattatttgacatgagaagcatataaatgtgaaactaatgcgagtcctgtttcctgcagtttctcttcgcattctgcatgaggaggatcgttctccattttcatttcttctagattacatttgtatgacagctcatggaagaactttacaaaagtgtagaaggagccaaattttaatgaaaagatgtacatcaactttaaaattgcgcagaattgtgttaaaatctactatttaaaaacctcacagaaatcttttcctgcttctttttttttccaaaaattattccattcttttatttctactgtggtcatatgattgaatccctgaagtaaatactgtgcattcttcaaactgatttgggatccttctgatactagagtgtacctagaaagcaaagtatattttgggattaacctgggaaatataaagaaagcaactcataaagaacaatattctgttagtatcacagtctgcacgaatgttatgtggtgcctgaatgtgagttcctctctgtctgtaattgctggaggcttcctttggtgccacacctggccttctgggctttctctggacgggactcttttcagggagctgccggggaaggagcatcctcctctggaaagtggtaataggggatgttattggtgtagatgaaagctagaggactggactggggagagtggccataagtatggagttctcacctgcaagtcttggggagagggtgaaatggctgaaatctggggaagaatcctggagcttctagtctctagtgccagggatagtgacctcagcctcaaaatgagcaacttgagaaaggggcgcattgtgtagacgtggaccgtgggtttgcgctggtccactcataccagtatattttaccttatactaaaagcctctctgtgggctgccatacatagagttcatgtagtggcctggcctgtataactgttgatagtatgatgtgggtaatggttcagtagaaattctctgagaaaatggggaaagggatcagctttaggtttcttacttgcaatttaatttgacctaaaaatacatacgttctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaatacatacgttctgaaaattagaacttaaaaatggcattctctaaagacgtttgtgcccagaaatcagcattggtttgcctaccaaattagttaagcttcttcttttcctggcatttaaagccttgagcaatctagctgcattccacctttccaacatttatccccacagcctccctacccataacctgtatttcctcaaacgcacgtttcacttatatgccctgattccttgtctttgcttggagtatctcctttgaaattcatatcaaatgccactttgccctattcttcctgatcacattcaacaaaatgtgagctctctctctcttttcaatgatcagacctttacaaagccttacgctcattgagtacttgttttaagtcttcagcattcggagttaagctccttggggactgaaatgatcatgcaagtttggcttgattttatgtgtttgataatactgattactctttgttgtttttttattgggcagactttgaactaactgtatggaactaatatttatgtatctatatttataaatattactaatatttatgtatctaggccatacagtttagcacttatagttgttttgtatttttgctgtttttccatgtgtatttctccagactctcaagactaagttacttggttcttattaagactaaggtcatattcctcaataagtatttgctggtttgtttaacattgctaaataaacaaagtgacatctctccatgccacctacagatgggcatttctttagaggtgacctatgactacaaaaattagataagatctcatatcttttcagattcttaccttctactcaagctcttcttaagtcttaccttaaatttaagtcttaccttaaatttgaccttacatatttaatcaatcctttaaaaaataaagcacctttttgtccattaaagtagaagggtaatacaagtgtgtgagaatacgtgagtgcacatgtggagaagctatatcccatgatattagagctttatgaaactttctattttcatgaccctaatgagaaaactgacttcttcagaatgggtttcatatgtaactttcgaacttgtttttcatttgtagtaaaagctttttatgtcccctttgctcctctatctggaatgtcaaattctaactttagctccactctcagactctagcctgtgagacatcgcactgccagtttcagtatcagcctccctggaagccagtgacattttgtcctgcacaccattcctgccctgtgctcccagtgcctctcctacttcttccttcttggctcctctggagaagccaaatcatattttaccaagtcagacaccttattttggtaaaatttgatgagcacattatcctacaagaaatcactggtgttagaatctaggcatgaaactgagcgctggccactgcaccattaatcagcagacgaaaagaaatctgaaaccaatgagatattttacttgccagtaaaatctctattttctaaaatttactttttaataaaaatgttgatacctaaatcttaatcaagggctatttgttatataggtttttactccattgaaatttccttttgaaagatagtagaaaatactctttattcttccatgatgtttctatgaagaagcacttttaaaatcaatttgttacagtaatattaatatctgatcaattttctctacagcaggcctaacatttaatgtagttctgcaggcttcttaataaattcagatttaaacattacattactttttggtgaaaccctgtctctactaaaaatacaaaaattagtccggtgtggtggcacacacctgtaatcccagctacttgggaggctgaggcaggagaatcacttgaatctgggaggtggaggttgcagtgaggcaagattgtgccactgcactccagcctgggtgacagagtgagactccatctcaaaaaaaaataataaataaaataacattactttttaaaaaagtattcttggttcttgttgaaagcaggttataaacagaggatactggcacctttaactgcagtttggtgcaggcctataagattcttaaaaaggttttaagatcatatgaattaatgaaaaactgagggcatttatcagataaaagaccaatcacatgatttgacaaggccttttaattaatctgctgatgctcttaaaaatctgcctctctgcctgaatgattattactagcttatttcttttcctgtacaagaaaagagatgaaaatgtccttcaacagtttattctgtgtgttcaagggaaaagatggggtgcttttcagcactctcttcagttcacataagccgcctctgtgtctgtaggagttgaaatcttcctgctggctattactccttttcctctacatgggatcagtttgaaagctacttgtctttggacttatttacaataggaataaaaagcttctgacaatgtcaggtagtggagagaagcaggaagctcagctgaggaccatgggaattcaagggagcaatctcagttgaaaccggatttctgaactcttgatctttattttggcatttgtggctcggggcaggtaaggtaaacagtgtccaaagttccccttaacagactgaaataatactgtggtaactgaagctttcaagctgctcctccatgccaggaatgtgaaggatgcctatgaaaacaacaaaaagctactactaatttaatcagatttttgttagattagaatgatacagttgaactttgggattttaaattcctttaaaatgttaatatttcaaagcattatttcacaattgccattaaactccttacagcatgtatttctgtaggtagagagatttctgctgatgtgctggaaatatgtaaccttgtattttgcagcctcactttcctctttagtaaagccctgatttcccaaaggggaatgcttccttcaacacgaggtttgggcttaggtaatagttgcagttctgcaggaacatcagttcaaggaatgatgagctaaatgccaaaataaagctgggatgactttatgattattgcgtatgaacaatctaatatgaaggagatttttcattgctaatattcaactactggatagaaaatatggctaagttactgagtttgttaatgtcaagatctcaaagagaagtacatggaagatagggtcaccagaactgaatctggaaagggtgtgtgtgcccccaggaatattccaccagaggcagcagtgttattagtaagtctcctcttatattaactatgacaaaagccagtgatggctagaagcaagagcactggcaaacatcttggtcatatgaagatgagcatcattgtctcctaattagcagaaatatcaagtatcccttaaaagagaacttggtgacagactgagaattagaaaatcatctaattttagagaccagagatcagtccaacactgacgttttgcagataagaatactgttggcttagcagagtgtgacgacatgtcactgttcattcaagatgagaaggctcagatccaaaggccaacatagttttctgtttcctgccttcccattctttgttgatactagcttgagataataagcttttttacaaatcatttacctgtaatgattcacatcatgaagagtatgatcacatggatgtgtccaattaattgaggttgttgtgcttttcttctaacctttcatcagtaccaaataagattatggaaagtgaaaagttgtaactaaatccctcagtgatataggcatctctgtataatagttccttggcctgtgaggaaatcagatgggcaatttgagtagctgtttgtggcagaacccaatctggcttgatgtgtttttccacagattgtgttgcatttctggaaaagtgctgtgagactttttttgacaccaataagatatatatatacatgtatatatgagatacatatatagatatgtatctcatatatatgggcgatcaataagattatatatagagatgatgtttatttttatatacacattgtatatatgtaaaatgaaattcttatgagtgtatatatactgaaatggaaagtcatgacattggagcagattaatgatctatcaagcccaagattctactataaatagaaaaggtatagctgatacttctaacaccagtccaaacgatttatatgttctcttgcattttcctttatatttccttttagaattatctataaaaatctataaaaatttctaaaacttaatctataaaaatttccaaacactctttgaacctttcaatttttacatataatttcctaaaagcagcatagaaaaaaggaatgtttttcttaaaaaaaaaaaattgaagttcagatcagagtttaaattccactctgcaatttcttagctgggtgactttctgagccttgttcccatacctgtaaaatatgggaatgataataaaaatacttacctcttaaggatactatgggattcagaatgtttaaaatacatatgaaaacgctaacagattttacccaaatgtgggtgtttttatgtcttatgtttcttgcgtaatatattccataaatttgttattagagtaatatttccttttatctgaaaatttccactttaaaaatgtccatttattctgatattactctatggttgaaatcctgggatctggtgaaaatgaaattgtcttaggcttttcatgattttatagacttaaatcatacactcctgaatcctttgagtatgaatgttcatttttgagctctgccatcttcatacagcctcccagctgttcattttttattcctgtcctcacacttgtcagcttcattatgtcaattttgatgtataacaactgaaaccaatcttagggctgcaggggtacagacagtgtagaaagaatagttttttcccccctacttatttccagatcatttcagaatcttgtagaccttcacaattgcagcagcaccttgagcttatgggctcagagtatatcccatcataattaacctcttagtaggcacagcatcctacaatttgggttgtgttacttgaatgtgttaccctatgcttagcttttaaagcttatcttttacttttctgcagacttggtctctagggtcattcttatatttgagtggctttaaaaaattttatttatacctcgtcaattcttaaaagaatttttagcaactcttctcataatatctctttggggagtttggcaacataagaattttactgtttaccagcccttgttgtggttcaactgctatgcagatcttcattcattagccagatatttattgaaacccacttatgccaggtactgtattaaatgtttagatacataggggaccaagacaaataaggcacaagtattcttgaaacttatattgcagcgagggaaaaaataagccacaaactctcttagtctgttttatgctgctataacagaatacttcaaactgggtaatttataatgaacagttatttattgtcttcctcttctggaggctaagaagtccaagatcagggaaccagcatctggcaaaggtcttcatgctgcgtcattccatggcagaaatgcaagagacaataggggagagaacaagagccaaatttgcccttttataacgaattgctttcccaagaatggcattcatccatttcaggagggctgaaccctcatggactgcttacctcttagtggtcctacctcttaattaccatcacaatggcaaataaatttcaacatgcattttggaggggatatccaaaccatagcaccaacataagagttaatacaatgccaacataagagttaataaaacaggatgaggtgaaaaagagtgcttagaaggctacttcatgtggcatagtaagggaggacctctctgaggagatgacatataagctttcatctgaatgtcaagaaggtcaccatgtgaagttctagatgaaactgtgtaaaggtcctaattcaggagcaaatctgaagtgttctaggaacagcaaggaagccagcatgaagggagcttcctaaaaggaagttagacaagggagaaatagacagaggcctgataacagggtattttaagccagggaaggaatttggattttatgatagtttcatagaaaaccactgtgatattcttagcaggagagggatgtgatctgaataagggtaaccgtggcataatgagataaaattgtgtttattcaaaatgtacctcacattattgcaagggtagttaaatggcacaaaagtctgtgtatctgttgatgaggaacattctgatttgtggctgggtaagacttccaggacactggcaatgattcctgaatatttcagtttgttgacatctatttttatctgattaaagaagaaaatatagaatttcaagagcaaaagaggtggtcaataaggccaaatactattaagaggttgagtaggatgcagaaagaaaaacaactgtttgatttgatagcagagaagcttttgatgaccttgaccagaacatggtgaggttggaagacaattgaatttgtattaaattgaattggatgtcagatgaaacaatgaaaacagagaccatttgaagttttactgtgaagaggaggagatagtacatagctcaaggatgatgtgggatcaagaaactttggttttattttgtcaaagttgaatgatactggagcatatttgcaggatttaggaataacatatgcaggaagaattttgcattgcaggagagaatgaggatagcagcaggaatgactcagtgagtaagaggagacgtgacccagagcacaagtagagagttgaactttgataggaactatgcagtttctcaaagaacgtgaggtataaatcgtcatgaccttggattatgcagtggtttttggttataacaacaaaagcacaagtgacaaaagaatgaatagctaaattggattttattgaaatataaaacatttttgcttcaaatgataccatcaagaaagtgaaaaaacagtccacagaatgggagaaaatatttacaaatcatatatctgataaggaaattatatctagaatatagaaaggattcttacaattcaacaataaaaaagcaacccatttaagaaacaagcaaagaatgtgcatagacattcctccaaagaagacatacaaatggcctaaaaagcacaaggaaaagatgctctaagtcattagtcatagggaaatcaaagcaaaaccacagtgacataccacttcacatccattaggatggttagaatcaaaacgacagacaagtggtgatgaagatgtggagccctcatctgttgctggtagaaatataaaatagtacacctgctttggaaaacagtgtgatagtttttcaaattgttaaacagagttaccacatgacccagcaattccaatcctaggtatactgccaagagaattgaaaacatgtccatgaaaaaacttgtacacaactgtttgtagcatcattactcaaaatagtccaaacataaaagcaatctagatgttcattaatgaatggatcagtaaaatgtggtaattcataaaatggaatattatttgctgtaaagaaaaaaaatgaagttctgatacatggaacaacatggataaaccttgagaagagtttgctgagtgaaagaaaccagacacaaaggccacatgttatatgattccatttatatgaattgtccagaatagtcagatccatagagacagaaaatagattagtggttgccagggcctggagggaggagagatcatagagagcgactgctaatgagtaagaagggtttttttttggcagtaataaatatatgctggaattaaatagtggcaatggatgaacaattctgtgagtatgttaaaaaccactgaattttacatttcaaaaggttgaactttagggtatatgaattatatcctagctttactaggataagatctggaacaagacaaggatgtccattttaaccacttctattcaacattgttctggaagtcctagccagagtaattagacaggagaaaggaatgaaaggcatccaaattagaaaggaggaactcagggccgggcatggtggctcacgcgtgtaatcccagcactttgggagtccaaggcaggaagatcacctgaggtcaggagtttgagaccagcctggccaacatggtgaaaccctgtctccactaaaaatacaaaaatgagccagttgtggtggtgggtgcctgtagtcccagctactcaggaggctgaggcagaagaatcgcttcagcttgggaggcagaggttgcagtgagccaagattgcgccactgcactccagcctgggagacagagcaagattcggtctcaaaaaaaaaaaaaagaaaaagaaaaagaaaaaaaataggaggaagtcaaattgtttgcagacagcatgattatgtatttatatccctaaaaactcaattttaaaaaactgttagaactaataaacaaattttgttgcaggatacaaaatcagcgtaacaaaagtcagcagcgtttctgtatgctgataccaaactatctgaaaaattaaggaagcaatcccacttataatcactaccaaaaaaatgagacacctaagaataaacttagcgaaggagctgaaagatttctacaatggaaacatataaaacattgatgaaagaaattgaagaggacataaataaatggaaagccatgccatgtttatggattggaaaaatcaatattgttaaaaagtccatacaggttaagtatctctaatccaaaaatcataatgcttcaagatctgaaattgttttagttctgacataccacaagtgaaaaatccacacctaatctcatgtgacagttcacaggcaaaacacattcaaacttgttttatgcacaaaattattaaaaatactgtataaaattaccttcagggtatgtgtataaggtgtatatgaagcataaacgattttcatgtgtagacttgggtcctgtctcctagatatctcattatatgtatgcagatattcccaaatcttaaagtatctgaaatctgaaaacacttctagtccaaagcattttggataaggtgtacttaacctatactacccaaagccatctatagatccagtgcaattcctgcaaaaaataccaatggcattcttcacagaaagagaaaaagataattttaaagttcacatggaaccacaaaagaccctgaatagccaaagcgatactgaacaaaaagaacaatgctggaggggactgcagcagatgggtgggctcctttgactccactttgcctccttggcaatgagtgggctatcccactctcccacggcatctgtatttaaaaaaaaaaaaaatactgaggcatcacatcgcctgacttcaaaatacactacagagctgtagtagccaaaataacatcatactggcatgatgtattagcctattcttgcattgctatacagaaatatctgagactgtgtaatgtattaatattaagaaaagaggcttaattggctcacagttctgcaggctgtacatattggcttctgcttctggggaggcctcagcaagcttccagtcatggcagaaggccaagggaaagcaggcacatcttacgtggctggagcaggagcaagagagagatgtgggagttgcttcacacttgctacacacttttaaacaaccagatttcacaagaactcactgcttactcactatcataagaacagcactgaggggatagtgatcacccattcatgagaaactggccccatgacccagtcacctcccaccaggccccacctccaaaattggggattacaattgaacatgagatgtgggtggggacgcagatccaaaccatatcacctgaaaatagatacatagaacaatccaacagaatagagcacacagaagtaaatccacacgtttgtagccaactgatttttgaccacagtgccaggaacatagggaaaggacagtctcttcataaatgatgctaagaaatctggctatccatgtgcagaagaattaaactagatccctatctcttaccacatacaaaaatcaactcaaaatgggctaaagacttaagtgaaagacctaaaatgataaaactactagaagaaaacataggggaaatacttcatgacattgatctgggcaaagattttttgggtaagaccttaaaagcacagctaacaaaagcaaaaatagacaaataggattatatcgaacaaaaaaactccttcacagcaaaggaaacagtcagcagaatgaaaagacaacctacagaatggaagaaaatatgtgcaaactattcatctggcaaggggctaatataaggaactcaactcagtagaaaaaagaactaaataaaaaatgggcaaaagacttggttagacatttctcaaaagaaaacatacaaatggccacaggtataggagaaaatgttcaacgtcactaatcatcaaggaaatacaatgggaaccacagtgagacatcacctcaccccgattagaatggctattatcaaaaagaggccaggcgcagtggctcatgcctgtaatcccagcactttgggaggctgaggtgggcagatcacttgaggtcggtagttcaagaccagcctggctaacatggtaaaaccccatctcttctacaaatacaaaaattacctgggcatgctggcgggtgcctgtagtcccagttactggggagattgaggcatgagaatcacttgaacctgggaggtggacgttgcagtgagccgagatcatgacactgcactccaggttaggagacagagcaagaccctgtctcaaaaaaaaaaaaaaaaaaaaaaaaaaggaatggctattatcaaaaaggcaaaaaaaattgttggcatggatttggagaaaggagaactctcatacactgttggtagaaatgtgaattagtacagccattataaaaaacaatatggaggcgcctcaaaacactaaaaatagaactaccgtatgatccagcaatcccacgactggatatatagccaaaggaaattaaatcagtatgcccaagagatatctgcactcatgtttattgtagcactgttgacaataaccaagaaatggaatcaaccttagtgtccatcagtgtgattaatagatgtttaaaaagtggtataaatacacaacgaaatactgtttagtcatataaaaaaatgaaatcttgtcatttgtggccacatggatgaacgtggaggacgttatgttcggtgaaataagccaggcacagaaagacaaatactgcatgatcttcctcatgtggaatctgacagagttgatctcatagaaatagagagtagaataatgatttccagagactggaaaggggaaagcagagggaggaatggagagagattggtcagtgggtacaaagttacagttaggtaggaggaataagctctggcattctgttatacagtatggtgactatggttaacaatattgtgttgtatatttcatattccccttgctctcaaatcccaggagtgtaccctatttagagctaacatctccctgacttatattgacctttctcaagacaagagtttttcaaatcatagcattatttataattgagaaaaattggaaaacaagcacaaggttaaataagcaatggtgaaataccaagtaaatattttgcagccacttgggaaaaaaatagcgactttgaatgttctcaccacaaagaaatgataaatgtgtgaggtgatggatatgccaaataccctgatttgatcattacacaatgtatatatgtattaaaagatcacacttgtaccccataatgtatataattatttatcaaaaacaaaatacaaattaataagttacctgtttttgaaagctattatttttatatgccatgaataacaaattcaaaaatataatggaaagaataaatggcatgataaaatttaggaaaattttgagaataagaggaggggaaattattctatagatagtaatacatgttatagagttttaaataagaatgtggaactgccatggagacaaaaaaggcaatttaaaatctagaaagagatctaagtacatgtattaggaaggcaatagatagtaaaaatagtgcttctcattggtggggaacgaatagattattaagttgtgatgttcaacacctagctaactttatcagttagtggtttaggttgaaaatagtagaagttaatcctggcaggcttaagtagaagaacaatctataggaaaaatgttgggtagctcagagtcaatggaaagccgagctcagaagatggacaggaaccaaaggatgctaaggagctgggaacacagcctcccttgtgtcacaagaataggatggcactgtgctgcttttgctgctcaggactctagaccccaccactctgccaccacaactaaactctaatggtccctgtgtgtttatatcatttcctcaactcagatactgaggcaggattcaaacacagagcctaggtcatgggccttcatccttattgttgtgagggaaagggatgcctggccactttcagcttctgtggtgggaggcagggcactatagcatctccccaggtagtaggtgtccaaatcctggagccaaaaatgacagatttccaccaacatttggaatgactaaaattagaaccatactttatatcatagacaaaaataaattccacatggattcagaatttaaatgtaaaacttgagaccataaaagtacttgacagaaatatgcatatttatgtattcttggttcgagaaagttgataagcaagatataaaaataagaaagccattaaaaatattgatagagcatattaagtgactcagaaagagaattatgatctgttgagtttcagaaagtttacattaaaaatgggtataatgtgattacatttttaaaacaggatcacatttttaagaaaatacacacacacacacacacacacacacacacacacacacacacgcacacacacactcctttccaaagaggattagaatggcatataccagaatatttcgagtggttctctggatgatgacactagagatgatttttccttccttccctcactatatggaagagggttttttttttttttcaaaagctgttatttctttttaaatctgaaacatgaggaatttggttggttggtttgtaagagtatatagtatctgggtctccatagataaattttatgctaaactctacaaaagcgaaaataacttctaagaccaggtaatgaggcagttgtgtttcaacaatcccatccatataaaaataatgttaaagtggcaattggaatttgctccatctggcggtccttcaaaagaaagaactggatagtgggtgatgactcaaagaataccctccagatcatgatgtttctctttcctcccccagtgtctttttttttcctttgatttgttttattttgtcttctctttaagagaacccatctgcttgactaggaacttactagttagtattcagggtatgtcatctaaaggacaccagatgcagagactctagagatattcgttatggcctatgttttatcactttacgctcttacctacaaaataggagttgccccagcatttcatgttttaacaacccttagattcctgatgtcttgttctctcttatctcagattgctgtctcagtaaaggatgcctaacctttatttcacatgagagacagagcagttcttgcttcctaaagtgagtcacccaagtagaaggactggctcttcacagaagtcttggtagtgtaaaggatgaggggaggcacttcatgttccagaaagactgatcatgagcacatcatagagagagaccaagagatctggagatagcaaagaaagaatgaacctaaaaatggtgacttgttcctattcttgccacttggttttctttcttgtaaaagaaaaggaatcattctggcttccagcttattttcctaaatgccattagcctatactagtaagaagatatgaatcagtaaacacagcttgccagaatttcccagttgtagtggtcatgttctaagagctcttcatatattttttcaaaagtcccctttttctatgatcatttccccagggggctcattggacatttctgtcatgtttcttagtcataaagaacatgactctgaacttctatagctttcagtatccatgtcttcatacttcatgttaatatggaaaccccattgctctggactggaattaaattagtattaacttggcttataacaaaatttaacaattaaatttaccaatttaatacttaataattaataagtataagtaataggtaataagtataagtaataatagttaataagtataagtaatacttaatacttaataagtaatacttaataagtaatacttagtaatacttaatacttaaattggtattaattgacttgtagttttcacctgtgtgggggttctgtagttttcacctgtgtggtattttgtaaataccacagctatagatagaaaacagcttgagcatatgtgtattttttgagctacacatttcatgagaacttttgtagttctctcatgttttcctctctttttcctcttaagtttattttgatgacttggagcaggtggtagccaggtggaagaaaatgtatatttcttttctctggtagaagctagaaggagctccttttatcctggtttccttggctttatagtgtgaggttctgttggttggttgtggaacctggtgatattctgatgcatggagtacaatacacggagtttagggttgggaagtggcaggtgctgtattgttgaggtacagtcccttccctctagctcccagatcctgtggacaaggagatataagcgcattggtaagaaggacacactctgctctgagtgatgatggtgcctgtaaggacaatccccttccagcctagcagtcctctaccacatctgggtacagtgagactcactccagtactgttcttgtttctttccaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaggagacttgtacctccataaaatgtgttgttttttcttaaaattgtttttgtgcataaatgcaaaagtccaggagcataccaatgggatatatcttgatatcccaacagtaggctggggtctgtacctagcataaagcatcaccctaagttcttgtatttttatgaggttttcatttcagattttctaaacttgtagccagtagactaaaaactaacagggctcacaaatgttaaagtgttattagttaaatttagcattgcagatgagaaacttttaatgtttgccagatgccactgtggttctttgtattttgttcttttggagaaacatcatgtcatggcagaaacagcatggttttgaatcccagcttcatgacttgagcaagttatttaaattctgagtctcagtttacccatctgtacaatgggactaaaaaccccttattcatggttatgaagttgacatgagaagcagtgtccggtatagtgtgtgcgctcagattctcaatgtccataatttgccctttttttctcccatgaattatacttttgtcctggagtggtgcaaatggcctggagtactttttctctcaataagggattattgctaaaacagtctctttctgcatgtttactgctatttaaatacatacttaatctatattccttatttaggatatatctcttagcatgaatgagcttggaaagaaatgaattttgaataagggaaaagagataaaccagcaggggagaaatggaaaactgttctttgcataaacagaggtaataaataggctatggaaatgaaaaataaaatatcaggttataaaagacagagattaaaggaaagtttgataaactatgtattttgtaagctaaggcaattaatatcttcttgacattcttatcaatatattaagaaaatcctgacttctcattgtcttggaatttttatttcaaaacatacattctctttaacatcttagccctttggattatttccaactttatgtcctttgtcatggttaatttccaattagctctttccatatgtatttaaaactagggatatataggttctccttacttttataatacctcttgtgtctttttcattcatttctctatacatgcttctagattagaaagaaaagaaacaccttttcatatgtttattgatggaacttgtcatacatcaaattagtgggctccatatctctctagaagtatatacacacagaatggatgagcagttgttaagaatgttgaagaaaaaaattattgcagtggaaggagactggccatgatggcctttgttagcctttctagctttagtatgcagtgatgtgatccaaaagtacggtgagagacagcattaagtaccctcattcatgtgtgtcatagcctgatggcacaatggaaagttctatgcttttgcttgccacctaggattttgaacttttgccctgaagctttcatgttgatagagaatgcagaattaagtccacagaagtaaatgccttcttttaacagctaatgtaccaccagtgtctaaaactatttataaatgttcatgtctggcaatagacaaaatatagtagtttgttagttaaaagctttttatgctctaaaaagcctctaaaaagttgatttctaacaatcaatatcagcataaacaaaaattttaaactcagaagacataaaagtgattaaataatacaattaaaagtcaattgaggctgagcacagtggctcacacctgtaatcccaacactttgggaggccaaggcgggagggtcacttgaggccaggagttccagaccagcctggtcaacattgtgagaccccatctctacaaaatttttttttaattgccaggtgcagtggcacatacgtgtaggctcagctactcaggaggctgaggcaggaggatctcttaagcctaggagttagaggctgcagtgaggtatggttgtaccactgcactccagcctgggcaacagagtgagactctgtctctgaaataaaaaataaaaattttaaagcaattgagttcacatgtggcaggaattcttccttgtaagcagacaattcactgaagtttgggggaagtgagagaagagcaacatatcaccaccaaagtctattacccaaagaatcttcatgaaaaatatggtatcttccaaaagattcccttctctttattttgctttgtacttggtttagtttctattttagctgcataaaaaacatttgtgcaaaatttattgctaattatttagtttaatgcgtgcttcagttgcttttttcttccaaattttcattgatatgtaaggtctttctacattttctaaagtggtcctattgatacattttaggatatcaatgatgtgtagctcccacagtggcaaagccttgttcaaagtttaatttctatagcttccattcatattgtcacatagcaaagctgtgagctgtgtgcttgtctgaatcacatgcttacacactcacacacattcacacactcacacacacaatctgactcacactctagctttgtaactatcttgtgattcacattcagctagtattcccacccaaagatgtaaaaggtaagaatccagtgataatataattcacatagctagatacctttccattttctttaaaaaaacagcaaattacaccagtgagaatggctattactaaaaagtcaaaaaataacagttgctggtgaggttgtagagaaaagggaatgcttatacactgttggtaggagtataaattagttcattgtggaaagcaatgtggcgattcctcaaagagctaaaaacaactaccattcaacccagcaatcccattattgggtatatacccaaaagagtagaaatcgttctaccttaaagacatatgcatgtgaatgttcattgcagcactattcacaatagcaaagacatggaatcaacctaaatgcccatcaatgacaaattggataaagaaaatgtgacacatatacaccatggaatactaggaagccataaaaagtatctattttattgatttaaatcttattcatctccactctctagtaactataatctttatatgagtgtatctcaacacaactgggctacatattacaaagaaatttaaaaagtttatcagccaggcacagtggctcacacctgtaatcccagcactttgggaggccgaggcgggtggatcacctgaggtcaggagttcaagtccagtctggccaacatgtgaaaccccgtctctactaataaacaaaaattagccagacatggtggtgcatgcctgtaatcccagctactcgggaggctgaagcaggagaattgcttgaacccaggaggcggaggttgcagtcagccgagatcgtgccattgcactccatcctgggcgacaagagtgaaactccgtctcaaaataaataaaataaaaataaaaagcttatcagtcttgaaatagcacaacattccaggcgtctgtttttccagagagacgttttgaggataaatgtactatgagtgggaccagcccctcttgacaactaaggatattccttttgtctggcttgttcagaagtactaaatattccaagaaaatcaataatgatgttttggtttagttcttttttttctatttttaatttttgtatgtacatagtaggtgtgtatatttatggggtacctgaggcattttgatacaggcatgcaatatgaaagaagcacatcgtggagaatcagttatccattccctcaagcatttaccctttgagttacaaacaatccaagtacactctttaagttattttaaaatgtacaattaagttactattgactataatcaccctgttgtgctatcaaatagtaggttttattcattctttctaacttttttgtacccaatcaccatccccaactccccctttccagccactagtaactgtccttctactctccatgcctatgaattcgcttgttttgatttttagatcccacaaataagtgaaaatgtgtgatgtttgtatttccatgcctggcttatttcacttagcataatgatctccagtttcatccatgttgttgcaaatgactgcgactcattctttttatgactgaatagtactccattgtgtatatgtaccacattttctttatccattcatctgttgatggacacttaggttgcttccaaatcttagctattataaacagtgctgccacaaacttacaagtgcagatatctttttgagatactgatttcctttcttttgggtatatacccaaacgtgaggtttgtaactcacatagtgattttttattgcaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtattgtcacaatgagattgcgggagttgctttcatctttgataatggctcagacccttctgttatttactgtgtgtttctgactgattcttctcaacagtcaatattttaatgccttcggatgatttctactgttgtctgtttcaccacatttatcttcctgtgacccatttgtcattagtctaaccatcttcatttaaactattaaaaaggcagagctatttgcattgtatcactgaagctggtagtgaaaataatgctcccaggatagatttctttttccttttagtttttcgagaaatttcaagtagcctgtttagattttgactgaagtatttttactgcttaattgctggcagtacagaccagcatatgaactgaactctgttgttaaatatggatcatcgtctctaacccttcaaaggaaattcgtgaactgtacatcctacctcctctgtaggcagtggcaatttttatgcagtaacattcagcaataccctatttatccagctttgtccaaaagtgaagtcgttgaggaaaaatatctggaacattaaaacttttaaaacttctgtggataaaaaaagaaaaaaccactttctaaaatatattataaacatccttgccataaacagcagaccttaccaagcagaatgtgttcttataaaattgggtcattattagaaacacagttgggtactgcacaattaagcatgaaatcatccaaaatcatgtttccatctcaattgtggaacccagtgttcaaacttgttaaatcagtaacctgaattttgtaaataaaacaaatttcttatttgtgcccaaactacaatctgaatgaagtagaaatggttaacaggaccacataggtggtaagagctttgaaatcacagttttgcttactgttaaacagcatttttatcatcttatttctggatttatggctgtattccaggcagactgaaaccattggaaaactggcattactttttgaaatttttttaatatttaaaaataaatatttttaaggataacatgaatactcatactcactagtatgaattagatgaattcttcatctgccttaaaatagtactcatgtagatgaagaggaatgaacaactctgggagagttgttaggaggcaaaatagactggatgttggtaatggctgaatgctgggataaaagagaaggagatgttaaacatgacttcttgtacaactggaaggatttggggttttgttcaagaagtgctgaaagagaaccagatttgggaagaaatcttgagtttgttttgaacatactaagtttgagattcttttgtgacatttaagagaagatctacataggcaatttttgtgttgggggtggtgcacatgtgtgtctggagctcaaaggagttataggctaaagataaacatttgtgattcttccacatattgatgtaatggaagctggaagcaaatactgaatgataaagggtagagtgtcttgagaaacttggacatttactggttgagtagaagaggaagggcttgcataggaagcagagaaggtgccagaaagaatgaaggaaactaggaagtgatgtgtcagggaagcagaaggtagggagcataatggtcaacaatgtctacatctgctgagaagtcaagttaaatgaggcctgaaagagttcattagatttctcaacttgaatgatttctccgttcagtagaatggtagagccaggaatggcttgaggaaaaagttggagaaaggaaattgagacagtggaaagatccaactttggagccataatgggtgagcctatatagaataaagaaaactaagcacagatctttggaaatacatacatttaagggggaggaggaagaagaggaagctgcaaaaaagatgaacatcaggaagaaaaccagaagagctcagcatcagagaacaaaaaccgtaggaaatttgtagaaagaggggtcaccaacagtgccaaatattaattgtggcgatatcaaataggatgaagcctgaaaaataggccaaagtctgactcctaggaggtgattaatagtccctcagagaattggtccattaaaatactgagggcataggcctagattgcagcaatttaacaagggcttgtggaagtggaggcagtaagagtagattcaacctttaacaaatgtgtcagaaaaaaatggaggaaaataaaaacatttggtttgtgtagggaaaagagtgatagtagcttcaggaaataagattggaaggaagatgttattttttttcaactgttcttgtttgcttttaggataaggcaatgtaagcaggtttgtaagatgggagacatgtctgtggagaaggaatcattgaaaatagaaaaagaggggaaattggagtatgacgctaaagctgaaaggaaaaggtgagatgtcaagggcatagataaagtgttagaaaggaaaagagaggatatttattttcttggagccaaagcgataggagaggctgggtaaaaattaagccacaaagagtttgggaaacaaacattgatggcagtttagataggccttcaacttttgtcagcagttttcatcagtctaggagctggggtggagaaaagggggatgttgtgccctctccaaagtctgggattcaggaggtatgtcgggtgggaggacaaaaagctaagaaaatcaagggtgtctgatatttctcatcttaatgtcattttctaaagctgtgaatgatggatagcttggactcgaaactcaactgccatttttttcaagttttctgtagtgagattggacagacctcagaatattttcttccacgatcataacctgtccttaatttttttctcattggtaccaatattcctccacacccaaatagcactgttactatgctaccttggcctcgttttctaggaattccctcatctgtctttcacaaaagctgcagataaacgtgtgccattttgatagaatgtccatgaacctgaaagagaaatatatattttctagagcttaacctcttgggtgacaatgctcaggaaacacattaaagtcaacagataataaattttatttttaatgttctggaaggcagtaatttcctgagaccatgttcctgataccttgaccatgtttacgttattggtcttaatcagggagaaatgatattttcagaagtcaaactgccattccctttctaataaaatatgctctgatttttgggcattgtagggtagtaaaactatactgggggtatatcacatatagagtgttattattaaaagccatgataggagaaaggctcctataaatgcattaagacctcattttttctagaagtcatatccagttattgggaatacagccaagataatataagccaaaatgtcttccaagagtcagaataggtgctataaaatgtatgcaccttagtcttcattcatgagtttctgaggtacttacccagagtgtgtttgctctttcttaatttagacataattgtaataaagatggggatgtggtttcttagcacatagctcattagggcaaggaatatacaggtatcaatagaaagtacaaacctcagttaaaaaaaaaaacttaaaaccttactaaagagcctcatagtatcctgggatctttattacaaaatcaaatcgttccattgcctctcagtagtctttagtatatgtatgacaccagcaggcagtcatcaatactctcataggtcccttacaattcttagaattgtcataattctctgtaatattgaccctgatttatttccctcatgagctctatttttacattatctaaactggcacccctgcttgtgggagtcactcaaagccgttctctttatacacagtctgcttttgttcatctgaaatttagagcaaatgaaaggtgatggtcagcggtctggaaaattcacatatctgtatcacatttatatcacagtgttgccaggtcactaacatgtagcagtaattttgttcccacctctaagccttggtcatttcttaattatctgcattagtggacgtaagcagtggctggtatcatcaaaaacaggtgatagtccttaatttttttttattttgagtttggaatacttgatttatttttttagtggatttatctctcccccaaaatttccttaggccaatattaaaattagcttatgtcctaactattatacagtaagagcagtaagtggcagctcccaaacattttgtatgacagagggaccagattagagtggaaaaagtgatcctggagtagattgtcaccatgaaaggactcagtctacattagcaagaaaaaaaattgtgcttttacattgtacagactacttatataagcatgcaccagagattgcttatgtataaaatagatacattctaaatacttggtgcatcctgtttttttaagaacatgctagatttttcaaccattttgatacagataaaagcttttctttatgattcagagaagccttagaatagtttggctgtggcttctctgtgtgtcgttggggactttactgtaacaagcttactgcataagcagaggctgtcacctaagggtaaatggctgcttggtaagttttattgtctacattctgaggagttgcatcttgaattggttttaatctaccaaccaggggcatgtattaaaatacacattttcacaatgatagatatataagtacatgcatcattgtgaatcatgatgtttgtaaatttattgctatgagccatatctgcaactcaagatagctgttggtggggattggtttttatgtgtgaacacttactaaacataaaaggaaattcaaagttatgtagttactatagcaacgacagctaagacacattgcagattcacatacattcatgtatttaaatcaaacgcccatatataaatatagtgtgatagatttagagttgctatggaaattgagtttgagctttctgctttccttagggacttcagtgttttagccttaaaatcagattaataggaatgccacaaaagtggtttcaaaaggaagcaacctaagtagaatagaataaagtatttgagcaatcataattaaatccctaaatgtagatttgaataaatcctaaggtgtttttcaagaacattgttgaatatttgaatattctcactcaacaattacccttaatgttgggttttctaaggctgtttgtatgactgtaaaatgtaatcatgtttattcatttatttgtttagcaatgtatgagcatttgttgagcacctgtcatctaagtactcatcacctctcaccttcttttgggaaataagaattgctttactttgttgggttttttgtttgtttgctttgctttttaagagaagcagtaaaaaatagcagtaaggagtggttttcatccttgttctgatcttggctttatggcccaggatgtagtcttttttggtcagcggaccacatgcacttgaaaagaatgtgtattctgcagtagttggttgtatagtgttttagaaatatcagttagatcaaggtgtttgatggtattattcagatcttctatgtgcgtttttttacttacctaataccagtgtcagagtaaacagatctgtattttatggatttttttgttgtccagttctaacatttgctgcagagtctgttgaattttcctgcattgatcatggaattgtccatttttccctttaattctctccatttttgtttcttgtattttagtgctctattactagatgtatatgtatttatgtatttacgagtgttaagtcatcctgttgaattgaccttttttgtcttcttctaaaaaaaaaaagggatacatgtgcagaacgtacaggtttgttacataggtatatgtgtgccatgatggtttgctgcacctattgaccagtcctctaagttccctcccctcacccacaacacccaaacaggccccagtgtatgatgttcccctccctgtgtccatgtgttctcactgttcacttcccactttgagtgagaacatgcagtgtttggttttctgttcctgtgttagttcgctgaggaagatggcttccagctttatccacatccctgcaaaggacatgatctcattcctttttatggctgcatagtgttccatggtatatatgtaccacattttctttatccagtctgtcattgatgggcatttgggttggttccatgtctttgctattgtaaacagtgctgcagtaaacatatgtgtgcatgtgtctttatagcagaatgatttatattcctttgggtatatactcagtaatgggattgctgggtcaaatggtttttctgattctagatccttcagaaatcatcatactgtcctccacaatggttgaagtaatttacattcccaccaacagtgtaaaaacattcctatttctccacagcctcgccagcatctattgtttcctgactttttaataatcactattctgactgtgtgagatggcatctcattgtggttttgatttgcatttctctaatgatcagtgatgttgagctttttttttttttcatatgtttgttggctgtgtaaatgtcttcttttgagaagtatctgttcatattctttgcccactttctaatggggttttttctttcttgtaaatatatttaagttccgtgtaaattctgaatattagaccgttgtcagatgggtagattgcaaaaatgttctcccattctgtaggttgcctgttcactctgatgatagtttcttttactctgcagaagctgtttagtttaattagatcccttttgtcaattttggcttttgttgaaattgcttttggcgtttttgtcatgtagtctttgcccatgcctatgtcctgaatggtattgcttaggttttcttctagggtttgggttttacatttaagtctttaatccatcttgagttaatttttgtataaggtgtaaggaaggggttcagtttcagttttctgcatatggcttgccagttttcccagtaccatttactgaataggagatcctttccccattgcttgtttttgtcaggtttgtcaaagatcagatggttgtagatgtgtggtgttatttctgaggtctgctccattggtctatatatctgttttggtaccagtaccatgttgttttggttactgtagccttgtagtatagtttgaagtcaggtagtgtgatgcctccagcattgttctttttgcctagaactgtcttggctatacagggtcttctttgattccatatgaaatttaaaatagttttttactaattctgtgaagaatgtcaatggtagtttgatggaaatagctttgaatctataaattattttgggaagtatggcctttttattgtatgaagtgttcctctttatctttgataatattctttgtcttgaaatctattttatctgacattaatctagctactccagcttttatatgcttactgttgcatggcatcatctttctccatgataagttaaatttctgcctgtctttgtctttataaagtgtgacagcatgtaatcaggtcttgcttttttattcattctgataatctttactgtttaattggagtgtccagcccatttacatttcatataattatgtaattattgatttggttggatttagagctaccgcattatcatttgttttctgtttgtcccctctgtttcttgttttgttgtttctcccttcctgccatcttctggatttttaaagtattttttagaattctattttaatttacttaccgccttttaaactacacctctttgcactaattttttaggggttgctctaaggattacaatatatattcttgttttttcacactatcctttaaattaatactgtacacctttatgtaaaatgtggaaaccctgcagccacccctatagttgtcatatgtattacatttacatacattatgaacctcacaagataatgttataacttttgctttaaacctacactgtctaatacacgttggcttttgaacacttgaaatgtgcttattcatcattaaaatgtgctgtgtgtataaaatgcgtgctgaatttagaaaacttagtatgagaaacagaatgtaaaacatctaataatttttgtattgactacatgtagaaattatatttcatatatgttgtatatgttttgcgtatgttaaagtcagtggagtttttttacctttttgatgtggctactagaaaacttatgtggttcacatatttctattagatggttatgctttaaacagtcatatctattgtagagaaattacaggaaaagttgtttatttcatatttttactattttcaacgttcttcatttctgaacacccaagttccctagcggtttcatttctcttcagcctgaaggacttttgttaggatttcttatcctgcaggtccagtggcaaaaattattttagattttctttttctgtaaatgtctttattttaccttcattcttaaagaatattttcacttgataaaggattcaagctgggttttgtttttccttttgttttattttttgcctgtaagcactttaaagatgttattccactgcatgtggcctccaaagataagaagtgcatactcattctaccctggaatggaatacatagtttttctctgagtgcagtcaaaattttctccttatctttggttttgagtagtgcgactatgatgtgcctaattatggttctgtttgaatttatcttgtttcagagttcattatgcttcctgagtctgtgaatttatgtctttggaaagattccaagcattattttttcaaatatttttttcagctccattctttctcctgtccttctgggacttcatttatccatatgttagagcttctgaaattataacacaagtccctgaggcacagttgattttcttcccagtacttattttctctcttctttagattagatggtttctgttgatgtaaattcaagtttaccctctctttcctctgtcatcttcattctactgttgtagaagtcttcatttttaaatttcagctattgtatttttctgtttacttttttttctttctctgctgagtttgcctaccttttcattcattatgagcatatttcctttacttcactaaacacgcttatggtagctgctttgaaagtttttgtctgctaattccatcattctggccatctcacaattgacatctgttgattttatttttctttgagaatatgtcacattttcctggctctttatatgtcaaataattttgggttatgtcttagttattgtgaattttagtgctctgaagactggattttgttatattgctgtaaagagggttgatgcttgtgagttaacaggcacttaactcaattagagtccaagggaaaaatactcaggaagttaactcccattcaaggggatcttcaaggggatctaaccttagcctcaggcctgtctgtgcctttatgcaagacttcgttttccttattattgcaaagtggcactaaatcttcatttaccttttgagaaactccttaatttaaccacaaatgttggtctttccctaaagccattatttgctctaagaaattcactttaggtcagtctatgatggcatttgacttaccggagccctgtagggtgggcacaggtactcttcttgtcccttgatggtcttgctatcaagatgagtcatgcctgtttattcttacaattttccagtagatgcctacttgatactgctattttacagtccccagtcacttatccacataccatcctacccaagtaccttacgtatgtctttaaggatcaaatattaattttagaaatcatgtaataatacaaggaaaagatgcatttttcttactagccccataattagcaagacttctcttcaaatagatgttagtacttctcattattatgcagaacactgtttctttctttctttccttccttcctttttttttttttttatggacggagtttcactgttattgcccaggctggagtgcaatggtgcaacctccgcctcctgggttcaatcaagcaattctgctgtctcagcctcccgagtagctgggattacaggcatgcgccaccatgcttggctaattttgtatttttagtagagatagggtttctccatgttggtcaggctggttttgaactctcaacctcaggtgatccacatgcctcagcctcccaaagtgctgggattacaggcgtgagctaccacacccggcagaacattgtttcttttacccaacccctaccccatattagcatggcatccttttgacctgttcatattaagaaactatcccgttgctaagctgcataccatttaatgcctactcccttagctacatcaagacttggagcaaatagaaagaaatattctaatggcccaactaattaaattattgtagaagatcccctactccctggaagaagagaggtagcagtggtttttttcttctgattacatgtgtaagatgtataaaagacactgctagacttttctcctcaaagaataactgaaactgcatttccctacattttagtctgttcaggcttctataacaaaatgccataaactaggtagctttgtataaacaacagaaatgtatttctcacagttctggggactgggaagtccaagaccaaggcaccagcagattcagtgtctggtgagagcctggtccacatacatggtgccttctcattgtttcctcagatggcagaagaggcaagcccccttaggcctgttttataagggcattgatctcattcatgagggatctgccctcacaacctagttacctcccaaaggccccacctcttaatactactgtgttggggattaggtttcaacgtatagatctgggggggaacacaaacattcagactatagcacctacctcttatgatgataaaaaccccagcataaaatatgagcagtgccctgccttgccaggacactgaatatttctgaatttaaactattgagcagagagaagagcagaaaattatgaagaattctggagtttcaaataggaatctcctggcagcgtctgtagaaaagcccaagggcttcttcctaggaagagccgtacatttttcattgccatcctaatttctttgcttactgaggtagcatttttgacagatgatttactaattcaatttgcaatttttaattattttggctttctgggtcaaagtatgtacattgttttttaaaaaaaaactagagtgttttaaagcttagagatcaaaaactacagaatgttgtgatactattactttgcaactcagaatctgaatcttaatatgaatagaatttttcatgaaagttaagggaaatgaaaacatttaaaatgtggaaggaaggccaggcacatgcctgtagtcccagctctttgggaggccaaggtgggaggattgcttcagctcaggaatttgagaacagcctgggcaacatggcaaaaccccgtcttttcaaaaaatacaaaaattagccaagcatggtggcacacacctgtagtcccagctactcaggaggctgaggtgggaggatcacttgagcctggggttcaaggctgcaatgagccatgttcatgccactacactccaacctgggcaacaaagtggaaccctgtcccaaaaaaataaaatatagaaggagtcatcagtaatattagcaaatatttattgagcacatattaagtgtcagctattatcctaagaacttaatatgtattcagcaattctaaaagacagatcatattattaccctccactttaaagttgaggaaactgaggcacggagaggtttagtaacttgccagggtcacacactagaaggagaggacttaagatttaaggcctgactctgtgattccagaatccatgctctttcatcattatattatattgcgtctctcatatgtcatggatgtggtcttgttttctcctcttacctcctccccacactatgctgaaccacggtaaatttcacaaccaaattcaaattacatggtgtatggaggatatacaaagctctgcaatgttgcttaggcttgagacagcagaacatatgctgttgtattgcgatgacatttttttttatcgtgatttttcaaaagttcaaaaacatttcctttcatccttacagtaggttctagggtgagagagagttactatactgtagagttactgtctacatttatagatgcaggaaatgttaaaaccatttgttccaggcctcttattagctcaaaagcagaagtgtatacaaagccaagaatattgagccctagattagtagaattactaatctctgatttcttaatccttcaagtcaattagctctccgtgtgaatggtctgggtgatttgaaagtgaaggatagatgcaattggcatgtatttgggcactcagagtctgttccttcacacagagctctgcagaggagggcgagggtctccactgttgtcctccctgcactggaaggcagaccatcctagccctttttaaaacagcattgggtcattaatcttatatagctgttcctgatatgtgttgaaatattaattctataactaaaccccatgtgctcatctgatggatcattccttttctctccataggaataatatcagattttacttctcagcctagctgtaaacctcgccaggccacacaagacagtgacttaggattcattcttagtttccacagcagaatatcatagattgtctgtgaacctatttttctttattattgatacttttttttgttgcttagtatattgggcaggaatcgaaaacagctttgacttgtagaattttctagaatccctttgaattgggtgaactacactataactcaactttgtcttgctcaatcattgttcccccattgcctggcctgtagaaggtcctcatataattattgagttgatgagtttaagttgaatcattgcagcattcatcttgatcaaggaagatgtagtactcagtcaacacatggctgtttttgaagtgctctccagtcatttccatcacctgagaagccccttacactgtaacttagaaagtatgctagtacactacacagtagctcagaaaatgtttccttttgaaattttgtttcaatagtttttggggtacagatggtttttggctatatggataagtcgttttatggagatttctgagattttagtgcacccatcacctgagcagtatacactgtacccaatatgtactcttttatcccacactcagcccccaaccttccccacccccgaatccccaaagtctgtcatatcactcttatgcctttgcatcctcatagcttagctcccacttagaaatgagaacacgcactatttgatttttcattcctgagttatttcacttagaataatggtctccagctccatccaagttgctgcaaaatatattatttcattcctttttatggctgagtagtattccatgatgtatatataccacattctctttatccactcattggttgatgggcacttaggttggttccatatctttgctattgtgaattgtgctgctataaacatgtgtgtgcatgtgtctttttcatataattacttctagaaaatgtttcttaccagttcctactttttggattccttgctctttttgtgaaagctttacctgaattctcagtcattcttttttactaattgatttagtttgtcaacaaatgtttgttgaagcactgtaagagattctggagatacatagtgattctgacaagacctgttttcaaggaaattaaatcctagtgggaaaatctgacaataaataggcaatagtaatagaggcgagttccttcagcatatataggaagaacacctgagctagtcttaaacatcttctataaaggtttctgaaaaaagtaaagttcaagcaaaacttaatgtataagtagatgttagccaaacggaggtgtattgaagagcattccaggcagaaagacaaggatgctgaagtcgaaagaatgtgctccattcagtaaagtgcatgttgttcagtgtggatgttgagatatgagactgcagagggaagcggggctcttcttattgctacaaaaataaaatcacaaacttagcagcttaaaacaacacttatgcattatttcacagattgtaaagtccaggcacaacttagctgggttatctgttttaggatctcaccagactataatccaggtatccactggggtggtggtctcatgaaaggctcaactggggaaagatttgtttccaagccccctcaagttgttgacttgaggctgcaggaccaaggcttcagtttcttgctgaaggccaccctcagttcctagaggccacttgcacctccatgccttatgggcttttccaacaaagatgcttacttcgtggcaactgcttcttcagggcagtaggggaagtctctctggtgtgtttgtcagcaagacagtcatgtagtaacataatggtaagagtgactcccattacctttgccatgttctgtgggttagagtcaggtcacgggtcttacatacactcaaggggaggctatcatacaaaagcatgaacaccaggaggtggagatcattagggtaaggggattactgtaggatttgtttgtcacaccgaggttacactttatagtagggagtcatggaaaagtttaagcagaagcatgctttgtattatagaaaacacattagagagggcacagttagaatctcgtaaaccagctgagaggctttgcagcaaaccacatgggagaagacagtggccttaatgaaggtagtagccatgcgggtgatggagaccgtaagatgatacagtcagcaaaattggatgattaatgggttatgggaagtaaagcagaggaggaaattggggataaatgttacacacatttctgacttactagtcggttgatagaagcagagatccctggaccaggagcctggtgagcatggggctcaccgcggagttctcccttccctgagctccagcctgccctgtggcctcagaccgtgtctctcttagccggagagtctggataagatggtgttaatggagcacaacaggctggccaccatcggaaaaacaaccgcaaacactggtcttgctagttattggtcaacaggggttctgactggagtctaaaggacaagacattatacacttagtacttacgttcccccaaaatgaccatcctagtgtataagctttttggttaaatgactgctgcgtaccaggagtgcagtagcacccttgatgtagttgttgtggtgacacctgtgtgtcgtctgcccagtgggctggctcagtgtgctgggctctgtcaccatcttcccctgttactgcagtaaacaggcgaaggggtactctaaattattgttgggatgtggtgtgtgtggttttcactggggtgagtgagcctcaccatttctgttgctctgagaatgatcaaaaaataatattttaaatgaagatagtgattggatgtgatacttaatgtgttttaaaggacacttaatattttaccaagatgcgaggggtgaaaagtcagtagtttattgaaagaaatagcatgttgaaataactatttaaaagagaatttttaatacttgagccattttaagatgcagaacgctttcctgcatttttccccctgtgaaaaattctctgaaaccagagtgactcaagcagagcctggaaaatactggagaatcacatgatggctaaaaataagcacatcatctctagcagggacagtaagcagcagggcagaagtaactcagtatgtgaaggctcacactcactggacatgctcaggagagtcaggccctctgtccttggcaggggcaggctttgagaccacaagtcagcgaagagaggtcctcaggtgctgaccactctgtgccacagcagccatgccctcggcaggcccctgacctgcagcgcgcctcactcgtatgctctcccaggggcagagccatttattttacactgtaatgacccctaaacagtggattgggagggaaaccggctgactcagctcttgttactgcccgttttctcttaagccctccccttggaatcaatagcacatgccattgatcacagaatgtctttttgttgctgttaacattgcaaaacataggttttgtgaaattgctggacatttggcgactgttctgtagggtacagaatagggtttcctaaactatagcattgcaagtactttaccaaaaacacaacaaatcttgtcttgggcactcactgctcatacccaggaaaattactgcagtagccacctagctggcctttctgcagctcccctcagcctccctggtctgttctcaacacagcaggcagagtgagccttttgaaagcaaagctagatcatgtcactctgttcaggatcctgcagtggcttcccttttcccttgcgaggtcctttgcgacctgcccttccagtacatctctgaccttctgtctacctacagtatcccattcttaccctgcctcacccacctgacctggctgctgagtggagaaggcagggcctttgcacccccattcagcatttcctctgcctggcctgctctgctcctggctgtccagacggccaccttcctctcctgcctcaggtcttggctcaggtctcacacttactgtgagagaccttgaagaaggaagggttactcctgcaactggcatgttccctgcagggaacctggaagttgtgactatggagtttgttacaagagctgttggcttctgtgaagaatgagacttttgagccccggtgaccccacacaggaggttctcgcctcccgtgtctgtgccagactgctgcaggactcccagcaagaggggcacctggcgctgccctgctggtgcttggtgttctgacctccgttcttctgggtggccttggtgtgagtgtggcccatgaaagtaccatgggtctgagttgaaaaactgaaactggaggaagacccatagtggatgcttaggccttccatgaaattcctatttaaaattgctacttacccacccgcagcccagctctgtctacccaaccctgctctgcttttctcttgttcatagcacttattttctagtttattctatcacttcctaatttatgttattatttattgtctagttcccctgttagaatgttaattccacaaggacaagcatcttgtgcgtttcattcattgtttgatctcaactgcctgttagcttcccaggtacataatagggttatggctcaataaaaatttgcacaaatgaatgaattaggataatttagaagaagcacagacggagatagatagggagtgcatggaatggaaggaacctatgccttggagcccattggtgggttatgggttaatcacattttttggttctaaaaacaaatttattgaagctgagcatatttacatgatgcagttgtgcatctttatacagtagttgttcactgtgtaaaaactgggttaatcaatttttataaaaatgttctttaaataaaaatgagccttattttcttagtatttcagctgtttttagtagtatctagaaatgggaaacaagtgcacttttgcatcatttgttgaatcaggtcttatttgctgagtaataatagtaatgtaagctaccatttattgagcacatgctgtgtgccagacccttgtgtaagcattttccatgtattaagtcatgtacccctcccaactctgagaagttggtgctgctcctcctttcttaaatgtaaagcaaggtggccacaaagccacaccagtcaggaagtagtggagctgggacccctaagaaggctctctggctgcagagcccccactcttgaccactgcactcactccctccctagaggcaggtgaaggatgtccaattccctaccaggtcttcattcccacgagattggtgtggctagtgcctgctgtgtggagctgcccctagctgctcaaggaggactgcccactcttaagagcctccactgaaaaggaagagctgcagacctcaccactggctgcactggtcagaacagaagtcctaagggctgtaaactgccaatttcagaattaaaaaaccagcctcctagtgatctcatgaatcagagcatcccagaaccctgttaaagtttcatttggatggaaatctgtccactgaggtgcttttttgccctcagctcagagcagattacagaatctacaaagtgacagtacggaggcagttttgaaggaaagactaggtcaatataacttgaatttgcagtaatcagaattctgtagggactggcaaccctattgcagtatgagggctgtggtgtcagttcagttactgaggaagtcctcttcctatggaattcactctcctcatcagtctagcccataccctttctccagcaatgacattacttttttttttaaccaagctcatcatctgttaaaaaatataatctctttgccaaggtgcaggggataagaaagtaatatcaaatccatccacaatgaatcaatacagatgcagtgtatcttctgccatagttgttcagctctgggttttcttcaattgagtgagaacggctagggggatggtttgggaagggaaggggctctcaaagtagagaaaaattgggattgaccatgaccagaagagtggtggccgcctgcatgtgtgtgtgcacacgctcatgtttttaatgtctcttgtcaacagtattaatgtcatatttttatctcctctgtttatgactttggcaaaaggaataatatggcagattatgtgaaaagaatttctaaattccagcagagtcttggccatgaaggataaagccaagtccagtgctttgatttgcttcatccttctgaatccattgggcctcatatgcccaacttgttgcagcgttttccataaacattaagcaagctactagttattgacattagacacggtaatgccctggcttcactaaggcagtgaatctgaccactccgaatttttttacaactatggttaaaatgtcagaatcatatttatacccccaaatcctaaaggcattaattaagacacaactgctcaaagactagcattgtaaatcatgtccagtgagcaaattcagagaattacagggacttagacagaatttatgcttttttcctctgcttctgagattcctttttattttgaaaggtaaaattagggaggtagaaaagcttgagggcaaaatggttacttgtaaacagggccactactaattatgttctcaggacatcctcaaatgcagcttgaaaaaaaatttgaaatgtttgaatcagctgcaagaaaaaaaaatctatatctgtattacagccaaagtaggtgcactctctgtaaaagctgttatgtaaatgttttccacataagcatcattgagccaagaggcctggtaaaggtacagaagtcaaatcactgatggagtggggcattctgggaagcaagaagatagctattgaggacttcagtatctaaaaccaggattggatgctgtcagagacatgtttggagcagtttacgagattggaatacagatggtagctcacataaaagtattctatcaatgttaagtttatgacattgataactgtgcagttttgtgagaacattcttgttctagtgcccaggtaagggggaaagagtatctggcagccccagaaattttagagtgtggttgttagaaggcagcgagacctagaaagcaaataaacaaaaacaagttcttaactctaaagagttatgctgtatgttaggatattgtcttttatttattctgaaaaagaaaacatgaaatcattgaatataatgaggacaaaaggtttcatttttatttttatacatttagtatttcttaatcatgtgacagctgtgaggggtaaattacttccgtttcaaattgcagcttgggatgatttaatgagcccactttacatttatttgaaaacaagcttttagtttaactgttaattatggggtttttttgttgtagttgttgttttacccaaacctcggaagatactaagatctttcccatgcctttcctgttctttaatttcttcacatttattcatttgaaggtaaaaatgtagttaagtaggcctgatctcacatatcctcatgcatcatttattttcctgttatcagtttttctccgaacaatagaatttcaagatccctctcattttaaatatcaaatactagttacctaagtgattgattattaaatgtttagaattttttttccatttcttccttcactcagcctgcactgtgtccccgttagtgaggcttaacggtggggcagaagcggtgcttccatcccacatgtgtgtaggtggtggagcagcagaggttgccgagcctgattttcatcgcctgcacctctctcatctcaaagggatccaggaggtgcacgtgtgtgtgccagtgggaaagccctggggccctaggccaccacctgacctttgcctgattcgtgagcacagatgccattttagggccgagactctgctgaaccacagcttggtgagtccaagccacacaggcaggttgaagttgggctctgttaacagaaagggatatttcctcaggggaagaaaacaaaacaaaacctgtttccccaagtggctgtgtgtggctagaagggggagagcatcagtaactgcagcagctgtgccctccctccctgccgtgagccatgctgagcgcctccagcggccggggattctccctgcgtgtctcactgctctcctggccagtgtcctctgcttcttcatagttgctcttccccgataacgtggctttgcccaggggtttggcttgccatgaccccttctacatcttatcaaacatttcagtttttttttcaagctctgtttgataataccctgagaatataattagtggtagccctttattgtaagcaatcagcttctgtttcttccatgattttttctttttaaattgacatcagactggataaggccagataccagaacatgagtgtgtctgatgatcctagctcagttattgcaacgacttttttgttgctgacctgcctatgaaagactgccagggtgggtgggtcatcacatgctatctagggaagccccctctgcaaggctgtgtccctcaggaggggccagtgagcatggcacaggcttggacagcccagcatagaccactcagagttaagcatatactgactgagtttactccacctctcctaattgtgtaggtaaggagcctaagtaatttacagaaggtaatcttaagaggaaaccaaggaggagctctctttctgggaggctgatggtttttatttggtttccttcttgtcttgctggttctttgtgtctgtgactttgacattggcatcagctcctcaagcttcccctggtgtccttaccctggagagatgcctctgctaggtcttatataatgaattataaaaactattattgaatttctctgggttaggcactgtgattggtggtgagagcataaggtgactaaaacagatgaaacacctatgtcctagggtttatgttcatgggagaagtagacattaaagaaatagctgtaccacaacagtggaaagtgttcagggcactgtggcctcccagacaaagtgacatctgagctgagactggcagggtggtagacctacttgctcagaggaggtaggggacaggaaggaggcagagagaatacagcctgacttgcatggtgtattagttcttacagtgccataaagaactgcccaagacaggataatttataaagaaaagaggtttaattgactcacagtttctcagggctagggaggcctcagaaaacttaaaattatggctgaaggggaagcaaacatgtccctcttcacacggcagcaggaaggaggaagtgccaagcaaagagggaaaaagccccttaaaaaaccgtcagatctcatgagaactcactcaatatcacaagaacaacatggaggtaaccgccccccatgcttcaattacctgccacggggtccctcccacaacatgtggggattatgggaactacaattcaagatgagatttgggtggggacacagccaaaccacgtcacatgggatggtcatggagtcatagaaccctggcttgttcctgagaacattgaaggtgccataccagaaattcttagatagctgttgctctgtgtgagactgagctagagaacaaagactgcatcttaggcatttttaggggcctccagtgcatggcccatggcaggcacttaacaaatatgtgtgtaaggggtgttgatcataggtagtcttcgcactgctttctgttagacttcctttatattaaaatatgaggtattgcttataaaaagatctgaaagaacttgatatttccgagctgtctccccagctgttaggctggtggctgcctcagagaagattctttgccagatcaggtgtcctcaccctgcctcccctgcctgcttgtctacttgttttctttacccagttggtttgcctttgggttaaagaacttggtcagcgggacatggaagtagtgttccaggagtgttttatatgggcttcaacagagctgaagcccatataccagtcacaaagcaaaacgtcagctctctggaaccctggggaagctcttctgcacagatttaccctgagaatattcaaactattttaagtctttcccaatttaaccattctcattttaaagtatattaggcacctccctgtgtttttaaagaagtttattttttaaaaatttttaacagaaaggcttatatttaaaggctgtaatgctgtcagtgcttctagggggtgtgacttgcatccggagctaatgaccccaggcacctgaagacacaaatataaattttatggtctttctgtttgctactttgtaattaggatgttggttgaaacttgtaactgctgtcacatacctgtctttataacccttcggctcttgctaatctcttggtactaataaactgtgaagttggaaataaactgtaaaattggaaaccgcatcactaaaagttttatttacttgtttatatagttagttaaacttttgctctttaagcaaatacatgttcagctgagcattgtgctacgcactggggttacaaagatgagtaagatgtgtttcttgctctaaataagagcaggggttggggaattaggccagtgggagcacagagaaggaacacctgcaccacactgaaggggtagtggaagacagagatgccacttcacagggactgtgttcagaggaaaagggaatggacgggcccccagtagtggcttggaatttcataatccatgaagtacactgcgtatacattgggacatctattttggccgcagaggccattcttgtgtctgcgcgttgttctaggtagtgagagtctattgtgacctgagctccagataggcgaggtcttacctgaaaccaatggtttttcttttttccacttcacaacattattagtgatgctaagtggatcacttccttaaggtgctgactctcagatctccccattgtaagggtgtgttttcccctttagagtaacacatgtaaatatcttgttccccaaaaccctctcacctaaagtttacgtgtccaatgacgagccctttgtgaatcgcttattagttacggatgttgcaaaattgtgatttattttctagttccagcatttcttgcatatttagtggctgccagtgttccttaaaaaggattgaaaagatctttatattcttttctcttccctctccctctccctgtcttccagcccatctctttttcagtcattatagattaatagatttttatttatccagtgcattacaataaatgaagctattgttcttcctgatattcagctgtcccaagtgtgactagttgagagccccttcaagctcttgatataaatcctggagcacctccttgctttttgacacaagatatcctaagcttaccctgaacattccctgcaccatccctagaatcagccatttctcaagaagcccttttattgcagaataacatttagaaaccaaagtttgggcatcaggagtgccactgctatggagatgtcattgctcttaggtactttagtggctaaagctaggaaatgttttaaaagagaaaaaaatacatttggattgatatttctgctgaagtattaattggttataagatcttttctcttgtttgttagaaattcaattagggtgatacttttaagtttatctaaaaacctttcctcttaaaaatcttaaaatccctttgttctcttactcttatatctccagagggagaagggacaatggcattaacctcatgttacttgaggaaaaaaaaaacagcactcacaaaggtgagataagttgcccaaaacaaccgtactttaactgtgtacactcctgctgaaatatttatactccttctatatgggaagggatcactggaggtatctcttatatgttgttgtaagctcttttcatatcattcattttctatgtatctaaaacacacttttaatattgccagtatttatcatttattctgattgctttcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagacaaaatcagtagcccatgatgaataaaaagtgttagtcacaaatctcaaagctgtacattaagatggggcagatggctcagccttgctgcagacttcaggctaccttcccctcccctgctcctcagggccgtcaagagctccaggctagaccgttgcccatcctgcccacttctggccattctagatagtgctgcattagggtgagtctgcctccctctctttttaaaggctgggtcagggttagtctgtctccctcccactctcttcttttttcccttcttcctttctttcttcagctattagtagttgagcttattctatatgaaagatattacgcttaatgctggtaatataaaggtagtaaaatagatacctttccttccttcatagaacttggagatagcagttgcacacagtaagttattacacaagcaaaacaaaaaacctgatacttcccacaatggcagaagttgggtgctgcaggagcaccgaacccaatatttgggggatctgaaaggccacaattgtgttttaagtagaagagctttccttttaatttaatatgcctcacagttatggtaaaatctaactagctccactagtctttgaaattttcattataaaatcttaggtactgctcatctttcctaagattatatgtagcttaaaagtaataaaagcaacgggtagtggagggcccatcgaggagagccttttatcctggctaccctgccgctatgagaggagcctttacttcagggccccaggctgttcccagccgctcactgggcccgtcgtggtgattaatcttattcttgatgagccagcaagagtttaaaaacagcttttgtgataattgtatatttgtaatcaagaatctagtttaatggaggcagtttcttagctagggtgtttctttacaattctgatcactttatggaaaaaggtataaaaacaagccatccagcaggtaggacttggatttggaaactagaatgttctaattacctgctgattctcagtttgagccctgtttccaataatgacttcttctcaattaaaaggcagtaaggacagtcataatgaaccttggtccacatgcctcaggctccaagaaaatcagagtagacctaaaggctgtaatgccttggacctaaagttagtcctcccatatccatgggttaccacatctgcacattcaagcaaccaagtattgcaaatattcaaaataaaaaatagcaatacaaacataaaagctaatgcaaattaaaaacagtacaacataactttacattgtattaggtattataagtaatgtagagataatttaaagtatacaggagtatgtgcgtaggttgtatgcaaatacgatgccatcttgtatcgtcttatatcagggacttcagcatccatgggttttcatatctgagggacatcctggaatcagttcctctcagataccaaggcacaactgtagaactctttttccttaaggaacccaaattcttttggtatctttcttatcttgtgtttcttcatgactcctccctctcttccccgtctgccacacccagtgtcccacctctccagcccaaagtataaccacgtggaaaccttgaggttctctcccgcttatagcctgaaccgcccagccccacttcccctccttggggctggctgtaggctcccgctagctctccagatcacacacagagccccatccccagggaactcagacctctaaaatgcctccactaaaccatgctaccatccacaatgccactcagagaaccgagtgagaagagagaggaataggccagtgccgccttcctgttataatcctttcattacttcccaaaggcctgcctccccatttctgcccccaacaccttcacaccgaggaatgtgcctgcccctgtctgtccctcagaaggaagacacaccctgaattctgagtccttcaatcagtattactgagcacttactccaaatttatatccgtggttcactgttgacgttccctcctttttctgtcttggagccaacaggatgccccctgagcctggtagggggccccacaggcatcatggtgttggaacaaagaacactcgggcgaggagaggctgaggggagaccctgatgctgaagggtgaagcacagtcatcactgagaaagagacaagtgccataaacttagaggagtctcatttgcttggcctcctgcattttctcaggcaatttcccatgatgcactacagaagtaccactatgctagaccattcccatgatagaaatgaatcaaaagatttaggaaaagtcataaagaaagtaattagggactcgttctgtatagtgggttagccacccagaagtgggttggagtcagtggattagccaactggaagtaggttggtcttcgctcggagcgcgggtggggccacggatgggtgtcgattagcccaggcagagactatagccatcactgaaacagcaaggcctgcaggaacctgcagtctatggccacactgggaggagttggaagaatggtaagaagagtgctgcttctcattttctaagatcatctacagcatctccttcattgcttaagcatctgccataacccaagagggatgaggctggcattggtctttgtgagggggactatgacagtggaattttgcttgccaattgatctttcatcatgtaagttagctagtgttggtttttactagggaatgttggtagtggcagctgttacctaatgcatgtggaatatcactgaagcctgatttgcactaaagggttgtctggaaaagcctcagctatgtgttcattgtgcagaacaaagccctagggagccagacagacctattttcgtgggttggatgtgtccttgcctggtacagggggctgggggggggtggcacatctaagctgccacagatccatctgctggcactagcacagggttgagatggattttatgtccaaacctggggagaggttggtttgttttaaagcaggaaaggatttctagaataagagttttcttttttctggaatttaagctggtcaccttcagtttttttgtacatcttacaaatgtgcaagctatagtattaatagaaatgagttaaaagcaaactggttctccactgctttgcaagcagccacatgggggtgtcagtgagggtaaccctgaatctacaggatggatatggtttgccaggtgcacaggaagaggatggacactgcatgggctcagtgtgtgtttgaatgaatcagtaattccagatggataaagcatacacaaaggcccagaattattagaaggagagaggaggaaatttgcattccaaatgtaattttttgaaattctattaggggtgatttttaaggtaatgacagagagattttacctaaggagggccatgaaagacttaatttaccacctgaagcatataccctacataaaaataaacgaagggtttaaacaaatggggatcctcagagaccaggaacggggtaatagtttgggcctgagtgtagctgctgcgcctgtgggactatggtagactgagatttgaaaccagatctagtcacaaccccgtgagggtttctttagctctgggtgtccgagttcttggaccctcttttgaccactgcctcctcccttcacttggactgttctgtagccaccctgagaagctgcacaaccctggaaactctgaaccaggatcgaggggaagaaagaggaatgagggctactgtggtgagggaataggccttccttgccctcctgccttcccagtgacgtacccaaagcccgaactagagaaattgagacagatccactcagccaggctttgggtcttacccagttttcctcgtgtcacgaaccctcagtttctccctggagagcgtttgtctaatgtggctcagtatcatttgtgaaagggtctagctaagcgtggcttccatgtaagtgatctaagggacggagagtcctcaacataaaactaaatagccatgcttacagcctctctgttctgcttctctttcctcctcccattctccatttcctgcagaagatgaacaagtatttcagtctgttcaggctgctagagcagagtactgtagacagggtgacttataaacaacagaaatttacttctcacagttctggagactgggatgtccaagatcaaggcgccagtagattcagcgtctgcttgaggccccattcttcatagatggcaccttctcactgtcttcacatgctgaaaggatgaataagctcgattgggcctcttatcagggcactcatcctattcataagggctctaaccccatgacagccacctcccaaaggccccacctcctaacaccatcaccttgggtgttaggatttcaacatacacattttgaggagatacaaactttcagaccatagtaagaagttagaggaaagatgtgttccagcctatgttagcaggagacgaaagctcacttccagcctgcggggaaccgcacaagcagaaagaccactctgtccctggttaataaacgctcagttgcctgaagggaatgaccagagtgctgtggagaattggacgttttggcccagggtcaagctccagacaacagccctgttgtttctccctcagacttacacattggttatttctgcttctctctctctctctcttttgggttttattcacaggaattgctggtcatgtcttatactatattttgggtggttttttttcttcactctcactcccttgcaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgtaagtgtgaggagcatgtgactcctgtgttctaaaatgactctcttggtcaaaacacagtagatcagcactccttagaatacttccccaggacctcaatgagaattactgctcagccaagtgcacctgatagtcccaaaggaataaacatcgttatcatcatgatctattgacccatgcctgtgggacaggcagtcataaattaatctgggaagagacaggtggggtggggaaggctttgacagaaaaatatgcttatgcagccaaactgcaagtggtctgcagctctctgagcaaatgagcattaagaatttgtatacggattcctccttcttcatgcaagtacagagtgtagttaaaggagaaaataatctagatgcttttcccatccccagaagccccataattgactgtttttatttcgtagctggttgtcttggttactcattgccaggacagactagagctgtgggacagccacatgcccatctcctttatggggaggagctgccaccagagttgctattcacaagtgctgctattcacaagtgctgctattcacaagtgctgatggagacccaggatgtggctgtgtcagggtgatgaaaagcagatgtgagaaatggaggaggaataagaatctaggaagcaaggagagaaagcggggcaggatgcatggcagagactgaggcaaggcaccccgggtctgccagtgccaggagagagaggcccagcagccagaggtggaggtgggagcctgatgtggcttcaccttccacagagccaagttgaggggttggggtgtccagcttctcttatgccaggctgatgctagtggaagtgtcccggtctctgggtgttctgagcctgtgatgttctgagggcctccagtggagttgtatgtgttgatatttctataggacatagcaagccatcagcaagtttactctcttattccagctgaatcccaggcaaatgtttactccatttatgcctcaaaatactagcagtgaaattctcctaaactgtaaggcactgtatctgtggtttggaagctctttatcacttttttttttcacttcttccaaatattttgatttaaattatttattggttatcaatagctcagaatttgaagccctgataatccacctggtttccatgatggcttcataaaatacggttctcagtattttcagatctgatggaataaaccagagactgatttgtagtatgtctgcagctgccacagtgtcacatatatgacgtcctgtgtgtacagagtgcttgccctctgtaagcactagatggactatggttattctcttcacaagcttatttgaggctaaatcagctgagatctccacagcgccatgagactgagtgaatggcgctgctgtctgcgataacgcctgctagtgggaataaggccggcgtgcaggatcaaatcttcttcccagccctgcacttcaaacggggaaaccctgagtctaacctcatgccagattttgtcccaagagggagtccatgtgcaggagcactgtctgacagtgaactccaaatgaagtgttggagaggtccactgaattcccggctaagataggtggacagcctcaggcaagagcccttgcctcctgggtgtgatttccagggggtctacctagatgaccgcactcagtttctgttctgccatacccatcaccacccgaccccacacacacatacatcccagcaccaccttgccaccatctggattcagagagccattcctgcaatgtacatgcaactaaaatgcaagcaccccaagaagaaataacactttaaggcctcatcattcattaagactaaataataagtttagcagacacctcttctgagacacctggttggggtttgaggtagaagggtctaggacttgacgtatattagcttattagctcctataattctctagagaatcctattaggtagctattgtcatcccattgtacagatgagggaaactaaggcagcagagaggttgaataactttcccaagtctaggagcagaataatttccatttgaaccctgaaatctgaatcctgagtttatgttctcccttctccaagtctgaggcaccttttaagtgctattatgacagtagtaatggctaatactgattgagcatttagcatgtgctagggattgtattcatttactacgtagattactgaccttaaccacatccctgtgaggtgagtaattacttatctacattttacagatgaaattactaacccaatggctcatagttaataagctccagcactaggatttgaacccaggtttatctaactcagaggctaaaatcataaggactgagttacctccctcgccgagtggtgggtaccatggagcagggaggaaacgaacatagtactagttggggaaagcctcaagattaactgtctacttgacagtcttcagttgaacacgccctgtgtgtgaagaagaaagtttccaaatttttacgtgggttttctctaaataactccccttacctcgttttgttgattttcaccttcgaaagcctagttgtggcctctttttcggggcattcatctgattttaaatgagcatccacaaagaacttcagttttcttctagccagtttgtaacttttttaaacccactttgttgttgtatctctggcactgcgctgacatcatcaaatagctttaagggaaggaagagagagggaaagagacagaggcattgccctgtaagtatatgctggggagtacccaaaattcaagaagagaattactcagagtaaccaggcagttgaatctggcagagaaaacagccttaacataaattgcatgtgtgggttaccagagcaagatgttcaaatgcagttactggcttaatttttctagttccaggatatttttattgcaactttgtgtctgcaaaactccaaaagagacacatcaggctatactgagttttctacagagagtaagccgtttgatctggaatatgccaggtgtccttatttggaatgtgacaagacccatttgtttaaaccttggtttttatgcagaaagaaaaggaaggctgcagtgggcctggatgccgtgctgggtgctttccatatcctgtgcatgcatgactctgccgagaggctcaggagcagctagatactctcctttctgccccctagcactccacctcccagaggtccaagaaatcatcctagatatcttaaagcctccaagcattttcatttcttcctgagaatatggaatctggtttctctggaaccacccagaagcacatagccagtcctacactgggggagtgagccttcctaaagctgtacccttgcctgccttcccctatgtctatggtctggaaaagcaacggttttgaaaaacaatgtgcttagtggttacgatgccatcatacaccactgcccccatctctgggaatcctgcctttgccccactgtgctttcccctgacattgtgtcctgttttctggccagccccacacttgtgtgatgggtagatttgcacccatgtgcagggatgatgtacatggcgtctgggaggaagtgccagcactttgttcatgatgctgttggtacagctgtgtgtacagagctgagatggcacagatgcctggtggtctgcctttcccagagccctcctggagctagaaggccaggttgcagcacatgctgttcagctaaacatagatggacatgctttgctttgacatttgaggtaggagtatttgctggggagatctcttcccctgagtgattacttaacactcttattttgtgatgattggcctctgattgttatatttaagccatcccagaatatggtgtttggaagatgtgaaaatccaggtgggagttttgagcagaaaatcaacagaggtggttcaattcccagttgtagagacctaatggaagtttccagagcagatacttattctcattatgttttcccctgatacgtaacttggagccacaggagtctgggctgaagcattggttacctgctccctgtggattctgtcagctgaagggcaccagcttatgaacagttacttgtttcctgcagggacaggctgtgcttctgtcactggagggcctcttgtcactggactaagtgctggctatagaaaaagacccaaccctacctcagaggagctcccagtcccagtaagggagacagacagggacatgactaactggaatatgtgtcagatgatgacaaatgtgataatggagacataaataaacttgtgtggggagcagataaaagccgcctggaggaccatgcagagacttcacagcgaagatggcatttgtgttggatgttacagggtgactgggaacatcaacagctctagagctaaggtagggagaaactgcatgagcaaagcagagaagaaagaccagcagccacagctggcaaggtggcaggagacaaggctgcagggtggtgccttccacagctaggaagccaggagctgttggagcttcctgatgggccttcctctctcctttgcccccattttcctcccacagtggcctagagccttcttcaataccatcttccagtttgcctctctatctaatgattataaggaaactaaagaatgatagttttcttacaatcactcacagctcaacggaaagatgtgaatagattgatacgcacatattagaattattaggtgatgctctggtgcattagtctcatatttggtataggttttgcctggcctcctacttagacatgggtttaagttcttcattctcgtataaggcatagaaaaagattgttttttcctgtgagcctgcaatagcattgtgtgggctgtgagctctcagttgtgatttgtaacaccccagaattacagatgtgttctgccagactctcagactgccttaacttgcaggccaagcatgagcaatccattgataaattgggagctttgctggtatttcccagtgagagttgtctggggtccacagttcctgcagatgcatgacatcacagaggggtcctgtgactgagatttaagctggatgtgcatgagaagcagctgccctgggcatctggaagcctcagagccatagaaaaggccagcaaacctgctgccttgttggatgtgtttggaaaggaggcctagcctagtggcttcctggccctctagtttattacaggctcaatgattacttgaatctaggtctttcaactttagctccattagcccacaataaactcccagttgtgacgtgagcaaatgagaatttctgcaaaatgtaaaacagttcctcatttctgaaatcttcttttcagaagtctaacatgcacagaaacaattatataaagaaaagcatactttagaccagctgaagtttgagcaatacaatatggaagacaccacactcacgttcaagagttaggatgctgaataaaacaatataactcaccgtggagggctcagagcccggctggagagacagatgtgtagccacccagcaagaacacacgcgggactgtggtgcgccctcccaccgaagcagaaactgaggataggaagcttggagagggaagccattatctcggggctgcaggcagtgagagaggcttcagggaggagtgactttctcataatttagaggagcatgtggcgggacagacagctgggagttcccagcccaccattcttgttaaactcccatgaatgttagtttcattcttctcccttggatgagaggagagcactggcttaggaaggccagtaactgtttcttgtcctgcgctggcccaagaagaagttctctcctgctcccctgagcatgtatggccacactgttggtgaggcactgactctgagctgagaggaccagcctcacatgtgccagacagaaggcaaagcagtgtgcagaggaagtgccaagagcacagctgctgtgatgcccaggggtctggggtcgatccggcagaaggggagtaaagaggggatcagggctctgagatctccctgaggtcaaagagcacctgcaattaaggaatttgggagtgcaagggtcaggaagacacatgatgtgatcagagagagcaagagattgggcctaacgttccagaagtggagctagttctaggtggtgaacacagggtggtcatggggtagggagagctcacatttgctgaataaggggcctgtcggcacggtaagagacaatgccagatttttccccaagttttcaacacaatgtcactgtctactgttggttgacacagaaagggttacttttttaaaaaaattacttgcacttctagaatatattccagagttctcccactaagaaataataatcacagctcacatttctatttaccatgtgccaaatactcttctaggcacttttcctattttaactcattaactcctctgttggattcgaggagtcctttgattcattgactaatgaaaatgcattgaaaatgctcctacatggataccttatccccaactttacaggtgaggaaactggggcccagagcagttaagttctagacccaaacccacacggcctgtaaataacagagctgggatgtgaactcgagtccatgttgtaaccttgacattctacttactgcctctcagaaaataagtggctcgtgaccttggctgatagtctgatagtctcagtcattcatccttgaatccactgcaatttgttcctctcaacacgacatggattgagtcttacataagaaagatgtggcaccgagaatccgatccctgacctcagtaacctcagcatccagtgggtggggccaaaagggtcaagacaagattccaaatcagtgtcatagcagaggaagaaaacaaatgctgcaggagaagagagaaggaattctggctcagtgatcatgccatatttgaattggctaaagatgggtttgtcctaagctccaaggaagaggggcccgacagacagggaagggcttgggcagttcagtgctcgggagccagcgtgccaggtgtgcgaggcatgggcacttccatatgtcccagcacatgctccagactgcatcacagaagctgtgtgcccttactgagggaacagggaactcctttgattagccatgctccctcagcttgggtaaaaaacagcaaatattttgtgtgagttcagaaaatgaatgaatgtacagatacggctgactgaggctagtgctccctggagttggtgttcatgccatgcttcactgggttagataaaggaataaatagggctgtttatttctaaatagtgggaagaacaattcacctatctgattctcagttgataaacataacgtaagccaaaagggccccaagcagtctaagtagatgtcccaaagtccttgagctaaagctcctgagctccctcattgggaggggcctctttgcctgggacaacccatgaaatgtggctgctgtcctttccttagcctgggaacctctaacactgctgctctggtatctaagcctacatcaggttagtaacataacaaagggtctccttcagggcgacactgccgagcaagaagaatgacagcaagggagggactaggaaatggagcaaaagcccacatccctatccattagtgaggagtgacaccccgcaccaaaataccatggaggccaggggtgctgcttttatattacagcagctttactcatggttgtcatgatgctcttggatcactgtgtttggtttactcttttacaaaggttaggaaagtatgccatgtattctaagaagatttccttccaaaacaaaatagttgggtgcctaaagcctgacgactgtgctttctagaatgatctgttctttgatcacatggggaagctaaggcgcccctgcatatgtatcagacaccggaagctgggagacgtttgcatggcgagttgtgcctaactaagcctggtgccctccacagccttgagacgccatgctggcagtggcaatgggctgggatgctgcagggccccattcccagtcaattatctcagctgaaacttctcccctgcccacaggagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacactttccttagcggcccctggtcacatgtcatcgggctgggcaggaagcgtccctgggtgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaatctgcctggagttacagattcttaaatttttatgctgaagcttcccttttcagtcagcatgtgaataggaatagatttgtgtggatttacacatctacccacattttattatgatttccccggggcgggggttgtctttgtttttattgatggccaatgttgttaacaagagttacagactcgtatttgatatcaaatgtagcagctataataccttttaaaaactttaccaaaaaaaaaaaaaaaaagacataaagagaaaacattcccttgggaaacattccacctgcaagcaaacagaatcctagctcctgcaggtccagcatactccatctggacaagacagtgctgggcaaataggaaactgtgggagaagcaggca

SEQ ID NO: 13815 - DNA, 11378 bp, Human
tgtcttttagggtaaaatcctgaaatattttcaaatgaaatgatatgatgtctgggatttacttcaaaataataatgagggatttgaagagtgtgtgcgttggtgggggagggggtatacagaataaatgaaactgacagtgagttgaagctgggtaaggagtatatgggagactcccaatattactttttctcttttggtatattatcttgcatgtggaatttccacagtaaaaagtaaaaagaagagagagaaaaaaggacctagggtcgctacacacacattcctttacgcgtttaagagctcagcagggactctcatcccagcccccagcgctagggccctggaaggctcagcagccccgcgcagtgcatgctgttctgatacttctgccctttccagccatctttggcccatctgtacggtgagctgcctgcaccaggtgaggggagagagcctcacagagtgaaatgcctacagcctaggcaggtcctttcccccttttgtgacctctcctccccatgcacacttcccatcacctgcacctgtccagacatcagacctgaagttagacagaccagtgtaaggatgagtgctgaacagagtccttcagggagggggatagtgcccaagtgacctatctcaagagaagttagcccctcatcccaagggagacatccctgagccacaaggagttggcaggactgctggaatgagttgggacctagacatcaggagacccagattgtagctggctctgcggtggactggctctgtgatgtggccatcactcatttattccataaatacctattgggcacatggtatgtgccagactctgctaagcatggggaacacagacttgaagattcagcctgggccatggtggcactcacagcctggtgggaagcaaacaagacagccaggtacagagggcagtcttcacggggactgtgcaacctagggcagaggttgccttccagagcctcagtgaagcctcaaggacaggtgggagttaggaagacggaaacttggggaccagagaaccacgtgtaaaagggggcagctgcaagtaactccacgggtgggtggggtgttgggttgagggagatgggaggatgaaacagggcaggaacgagaccaggccaccctggaatcccggttcccttatgtatcacccttagcctccctctccatgcttaaggtgagggggctggactgcgtgggctctcagctttctccagttctaaggggtttgaaggttcatgggcaaagaagccagagcagagggcctgagtgcccaggtccagcctgctggccccaggactcccctccgcatatcctccccctctctttgggagggaggttccctgaggacagggagcagggcaagctgcacagctctcaagggtctcctaggtgacctgtgcccactcctgtgcggattgggctgggttggtagcgtggggggctggctgatttgctagtcccttgtaatttgtctgaaaaactcccacagtagggcaggacaacgggggaggaacccgggcatctgccagccggttctcctcggtctcagagctgcttctgcggccttgcagtccccgcgccctgccctctccatgactgcccgtcctgggcccctcgctttccagatcccgcacccagctgtcccttgcgctctctggaactccctctgctctccctgcgaggcttgtccaagggctgaccccgggcccgccgcccttccctcggctgggccagggctgtccgcagtccgctctcccgatcgggcttccgaagaagggaggaggccggttccggccccgcggccctcacgtgctttcccggccgcccctcccgccccgcatcgaggcagacaagcctgttcctcttccctgggctgcgattgcgacaggccggcctggctcccagcgctccctgtccccgccccgcggccagctcgctccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgaggaaggggcctggtaggagtgggcgagggtgggcaagagggatctgggcagccgtcgctccattccctctgccctcccaagctgacccctgactaattcttctctcctcttctccatctccctttgaaggtgcctccatatgcgtcggagaaccagacctgcagggaccaggaaaaggaatactatgagccccagcaccgcatctgctgctcccgctgcccgccaggtgagaggcaatggcaggacgaacctgggcctcggaagtgggtcacgggggctccagccccctcgcggcctcagagggaaggtgggcactgtcccccaggaaaactggctgctggagacgagcgtgggaaaccctggacatcacgtggaggagatgggactggccctccccactgggcctcctctttccttacctcactgagagggagccggagggccactggcaggatgatggggggccagagagaccgagggaaaggccagggtcacactacaggcagcggaggtgagggtggagcctcgtctcctgaggctctactgctccactcacgttctaggcacctatgtctcagctaaatgtagccgcatccgggacacagtttgtgccacatgtgccgagaattcctacaacgagcactggaactacctgaccatctgccagctgtgccgcccctgtgacccaggtgagtggggatgtgcctgcgggggggctggatcccctggagcttggcccctccctgagccctcccgtctccccgccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtcagaggtccctgaggggctggatgtgaaaaggaggctgggtgccagggatctcaagtgggagcagggaatatggtactgtgtccacggcgaccccccagatccttggcttaaaattcctcttctcattccatgcagaggctcacagaagggttctggagggacatggaactgggacaggtgcaggggacacaggaggtggttcttctcagtactgggaagcttgggcaaaatggtaggcagtaggccgggtgtggtggcccacgcctgtaatcccagcactttgggaggccgaggtgggcggatcacgaggtcaggagatcgagaccatcctggctaacacagtgaaaccccgtctctactaaaaatacaaaaaattagccgggcgtggtggtgggcgcctgtagtcccagctactcgggaggctgaggcaggagaatggcgtgaacttgggaggcggagcttgcagtgagccgagatcgcgccactgcactccagcctgggcgacagagcaagactccgtctcaaaaaaaaaaaaaaaaaaaaggcagcaaagcagagcttgggaaaggtgagagctacgcaatggggtggatgggcatcctgaggcttaaaggaaactcacaggccggcaaagggcccctcccttttgcccattcaccctggctggcctgcctttctcttgccagatgaagttgggaagggtaacaaccactgcgtcccctgcaaggcagggcacttccagaatacctcctcccccagcgcccgctgccagccccacaccaggtgagtgcagccccacccaagctccttccaccctctgagaagcctcagctgctaacaacccccagcgcctatccttgacaccacggactcgactcaccactttcagcctccccgcctgcccagtggagtcgggacactggtgggccagggcgtgaaaaggtcatcatctttttttcctctgcaggtgtgagaaccaaggtctggtggaggcagctccaggcactgcccagtccgacacaacctgcaaaaatccattagagccactgcccccagagatgtcaggtgagggaccagggctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactagaccaaacacctctttattagactatatacttttattattagacagaagattcccatttgactctttcttgactgtttcctgtggactgattggcttgctagcctagtagatgactattgtttctaatgactgtaacatcactaattggcagaaggttcactgtgtgtgttgggcactctgtaaccactttacatttactaactcatttaatcttcttaatgatgctatgaagtagattctattatcatcctcatggactgaaggaagaaaccgaggctcaaagaggttaagtgatatactcaagatcacccacacaggtggtcactggtgttattagaacctgtactcaggttttcttactccagagcccatgtcataatgcatgcactatagaaaattagagacttcagataagcaaaactaaaaactcacccacagagccactacctagaatatccactcgttacattgtggtatatatcctcccggacattttctatgcatgtttatacatactgggttttgttgttgtttactaaaagtgaagtaattttaatatttcgtaacctgattttttcattccacaatctaagtatttttctgtgccctgttaatttttaactatgtatcaaatacaactggcattttagagctggaattttagagagtatgtaagctaacctcatcctatatatgaaaaactgatgcccaaagaagtgaaatgacttaaaagtcacacagccgggcaggaaaccgtggcccagactcccagtccagtttctccccaggcctcccatcccatattcccttaggctacagatttacatgaatgagaagaggcaaaatgcccagcatagaaatgcgggagtcctcccgcccttccccaggcgtagctgacggacactggaggctccatgctattgctggcagcactggtacccagagaaagagaaattacccactgctacagatcacagctggagaagccgaactccagcctctctttctcttcccctcctagaacctgccctgagcaagggggtggagaacttgcaagccctgctctaccaggcggccacaggcagttccgaagcaagtttccctactctctcacccctgtaaacacccccacaggtacaggtacagcagggcaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaagctcccatcctgcacacgcaagcctgcccaatcctggtctctgagcaggagggcacccacaccacccccaaacatgcccatccatgatacagtctctcctggctgccaagaggtcctcaagtccaacttagttccccttctctataacccaagggaagtttctctcattctgcctttaggagctgcattgtgtctagaaggaaaaaagctgctcccttttctctgtctgggttgcccagggatctggaaagctcttccttctcctcctcccctctgcccttcttggggctgtgatcaccctcctgtctgctgtcctggcaggaaccatgctgatgctggccgttctgctgccactggccttctttctgctccttgccaccgtcttctcctgcatctggaagagccacccttctctctgcaggaaactgggtaggaaagggttggatgcagtggatggttggcaatgggagccggagggaggaatattcaacttccccggtgcaaccctccacaccctcaagactcccaatgcctacccccaacatagacatccttatcttcatccagctgcttattctgaggctggagatgagagtgacagtggcttgttcctctgggcccccgggtggtcaagttgctacacattgtgctgggatgtggaggctgaaaggctaggtctgaggcctgccggggagcctacacccatttcattctccattgcaggatcgctgctcaagaggcgtccgcaggtaatggcgggggctgagaaggcagcaagaaggggaagaggtgatgagggtacaaggtggagcagacaggaagagagtatgcaggctgactccacactcattcattcattcaactgatgatttactgaacatgccacgtaccaggcactgtcctaggcactgggcgtacagcagtgagcaaaacacagtacctcatttcctggagttcacatgcccatggagcaagaataagttaaactatatatcaggtggtataattgctaaacaaagcagggaaggggtcaatgagtgacagtggcaaaggatgggggtattttagacagagtggagagtgaaggcctctctgagaacctgatatttgagcggagagctgaagaagcaaggagccagccatggggttatctggggagaaagtgctccaggaagagggagcaaccagtgcaaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgagcaggagggcacccgcaccacccccaaacatgccgatccatgatacatgtaatcccagtactttgggaggccgaggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactctgtctcaaaaaaaaaaaaaaaaaaagttagccagacagtcccagctactcaggaggctgaggctagaggatcacttgagtccaagagttcatgagcctgcagtgagctatgattgcaccactgcactgtagcctgggtgacagaccctgaccctgtctggaaagaaagaaagagagagagagaaagagagagagagagagaaaggaaggaaggaaagaaagaaagagaaagagagaaagaagagggagggagggagagagaaaaaagggtctggggccctcatcattgtttgggtctccatctctttcctgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtgagcctggggcagggagaagagaggaaggatggggagggagggatggctggcagggagagactgtgggccagatgaaataaaaagaccaaaacagaggcagacagagactccgctgccagtcagtgtcacaactagagaagagggaagagactggaaaacccagaagcagagaaatgaacacagaagctcaataaaccagcagcaagcaggagaggggcggggccaggggaaaggcgagaagaaggcaagaattcaagaagcagcgggcctgaactgggggccttccttcctcaacactctgcctcccttcctacaggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctagataatttattttcttgggatttatacagaaacactattccatggagacaatctcaaagacaaagtcaagacactaaaatataatcccataaagatatttcagtgaggaactggtgagtatagtccaggtaataacagtctcgtcagtgatggctgacaacgtgccaggcagtgttctcaatgctttacagtactaacttacttaatcttcacaataactccctaaggtagatatgattcccatttaacaaatgaggaaactgaggcacagagcggtaactttcccaattcagctgcaaatgacaaagctgggatttgcacctagttcgtctggcttttagaggcctcttggggaaaaaaaagccttcatataccacgcccttccagaatttctttgaacgggtagaatggtctggccttctcaaataatcagatctcttgcatgttccgcaggtgttacttttcagtcaactctcaaacatctagccacacgcgaagtgaaaaatgttctccaaggttgattgaagggaaatgtgtgcaattttttttttttttttgagacaggatctaattctgtcactcaggctgttgtgcagtggcactattatggctcatggcaaccttgaactcctggctcaagggatccgcccacctcagcctcccaagtagctggggctataggtgtgtgccacgacgcccagctaattttttgtatttttagtagagatcaggtctccctgtgttgcccaggctggtctcgaactcctgggctcaagcaatcctcctgccttggcctctgaacatgcagtgattacaggcgtgagagccaccgtgcctgacctgaggtgtgcactttagacataaaatgagagaggccaagttcacattttgttggtgaacagaaatctaggctggcctccttttggttcagaaagagtatttatgatttttacttttttggtttctttttgtcttcttttatttttacccccaaaaaggactttaaatcttctcaagccctcttattagtaaatgtttgcccctccctgcccctgaattctctcctgtgctcggtcgagaggatcttagcttgcaggattgttagggagctgctgccagccggctgctccttccataaaaggccactctcatgggtctgatatgaggaactctgtcgctggagctcatcagggtggggcggctgcaaaacacacacctcagaaggcgtctgatccaatggagtggatgggtcatttaaggttgactgtgaaaatatcacatccaacttccttttttgaaaagtaaataatggtgagctgtatctttaaataaagttaaatcctcctgcccctgcaatatgctggggccagacctcatgaattcttaataattgttctaatgtgtttagataaaaaacaaattttatacatttttttcaacaaaataaaaggaggaaaatattttgaaagaaatgatgctgaagcacagccctttgtgacaccattcaaatttataattatacctgcctgtatttttttagagacagggtcttactgtgtcgccctggcttgagtgcagtggtataatcgtggctcatatagcctcagctcctagactcaaatgatcctcctacctcagcctcccacgtagctagagctacagatgcgtgccaccacacctggctaatttttttttaatttcttttttaagaagtggggtcttgctatgttgtccaggctggtctcaaactcctgggatcaagtgatcctcccacctcagcctcccaaagagctgagattgcaggcatgagccactgcacctgggctgcctaaattaattttctagggccgccataacaaagtactgcagactcgatagcttaagctgcagagatttatcttctcacagctctggaggctggaagtcagaggtcaacgtgttggcaaggttggtgtcctctgaggcctctgtccttggcctgctaatggtggccttcctgc

SEQ ID NO: 13816 - DNA, 10718 bp, Human; identical to SEQ ID NO: 11918

SEQ ID NO: 13817 - DNA, 17318 bp, Human
agatgagcagaccgaggttcttctcgctgcttcatactggaaacttgcacttgattctgaggctcctgcttcttcaagaacactgctttgggttcgcttctcctgtccctggggtctccctttgtgatggtggtgagctgcttcctttctgaatccagcttcaaccctacagttctccagaagctggacgatggggtggagtaaagtcagctccccccgcagtgagggacactgaagctccattctcatctgcggatcacagaggggaagccaggaagagccaggggacggtggacttggggctgggaggtcatctcagagggataaggggtgaggagctctggtttcaagttccaaagccctaggacctccctcttctctgtctgcctgcatttctagcagcctcagcagctagaaattctagctgcctgcatttctagcagcccagcaggcccttgggcggggctggatgtagggaaggtcattgtaccaagaagatagttgggtaaatgtggtacctttgttgtaggattctcttgggagatgtctgcatcaatgaggatggcataaagtaaccagagtcaggatgtggggtctgactcagtgacagaaaaagtggcagtgtgtctctcatagccaaaggggcccttggaccggcagtcgggagtctggggttctctgttggctctgcctcctggcacattgggtttctggacctcagttttctcctctataaaaccgggcagttgggtgggcacggtggctcacacctgtaatcctagcactttaggaggctgaggtgggcagatcatttgggcccaggagttcaagacctgcctgtgtaacatggtgagaccctgtctctacaaaaaatacaaaaattacccaggcgtggtggtatgcacctatagtcccagctgcttgggaggctgaggtgggaggattacttgaacctgggaggtcgaggctgcagtgagctgcgatggtaccactgcactccagcctgggaaacggagcggaccctcaaaacaaaaacaaaaatgaaaaacaagcaaacgaagaaataaaaaaacctagggggttgtagtcgatgatctgtaaggtgagttataattgatgtattggaatatttaggaaaagggcactgggaatatgctaggaacacctgatggaggtatctttatttccacggcagcttcgtggatacgtctcattgattctcatggcatcactttccccatgtaggtgggcagacattgttacccctgtttaataaacaaggaaccaacagaggcttaggagaggagttgcctgatgtcgcatgattggtggcagagccaggatcaacagtggggcagggtggggggacctggccaggcagagactggatgagacctggggtgaggaatggcaggcacccagtcagggcagaaaacgagggttgggacttactttgagttttggattggatcagtaaattcccaagaaagagggagactaggaggctagtgaagaactctggagtaaaggggaggattactaagggacatggagtacctatcatgtgtcggacgcttatctatatctctcccatctgaacaaatccttacaggaaccccaggagacaggttatctccactctgcaaattggaaaacagatccagacagtttcagttatgtgtctgagaagttcatttatgtgtccaagacacattcttagctaaaaagctaagcattctgaattggaacccagagaatttgactcccagactctggatcttttcactgctgtgatccatctgggaaaggctagtgatgtgggcaaggggcttattgccccttggtgtttggttgggagtggtcggattggtgggttgggggcacaaggcagccagatctgggactcctgtgcttgtgactggactacaaagagttaaagaacgttgggcctcctcctcccgcctcctgtggcctcctcctccagctcttcctgtcccgctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccgctggtgagaccagggacaaagggaagagtgggctggtgggcgaggcaccttccggctggcgtgggccctctccgggagggggccgagcctctcctgcccgggcctggtcctggcgccagcctcaggcctgcaggtcctaacctcagccactgccagtgtggggttccccattcatccgccttttggagtaggggctgcgctgaggcaggggaatgggagaagtttgaaagggagagagtaaaaggaagccctggcccctgacagcggtggaagtttgtgggcggccaagggaatgtgggcaggagataggcccagggtggggcagatttggcggggaaaagaagggagtgggagtaggaagattagtgctcggggagtccagacggttctgaattctgtccctccggtcagctggctggcctggagggtgttgggccgtggggaggcgaggctgcctgtggaacttggtggagcacaccctgtagggcaggattttggcggctggtgaagtgggggagtgagttgaggagtggggatgggctggtgtggtgggtttgggatgctcatggtgggaggtatttgagaatgggctgggacactggatggggcagggcaacccagtggacagtgtccccagtgccctggccaagccccggcctctcacctggggacattctttacccttttgcctgctgctaggcaggtagccgctgtgggactgagccttcccagggagctagtcctacccccacctggtcagtgtccctgggcctgtcctccagcttcccctccccgctgcttctcacagacctaaacaacaatcccttggtttcttattctacagttcagtttggggaagttggtagaaagttgttttcgtcactggaaaatgtccctttctctggcctcagccttgtttcaatgtatccttgatcgtcctccacgtcttggtccgggaatcatcctgttcagatgtcctgggcccatctagtcaggcagattttccctgccctgcccggcctctgaaggctgcgcctacctcccctctctttagtgccttatactcttcctctcctaccattcctttcttccagcaatctccccagactctcctcagacttctcagagcctctttttttgaaatcttttctcgctaatcctccttcccctcctctctgctccgctctggtcccggccccaggtccccaggcagcacgtctctggtcagggtctcactcttcttcttctgcctcctcctgcctccttagtcccacccgctcttcccttcttcccactgtccttcccccacggtctccccaccagccagctgccctgacatcctgcttctgttttctgtttgggggcggcccctggctccctcacatacctcctgcatgaacaagagcagcttatataacctaaccttccatgccttcgtttctttatctccaaaatgggtgtcacagtcttgacctcatactgttgttttgaagattgaatagactgatacatgttaagtgttcatttgatttattaagtgtgcgctctgggctagacactgtgataggtgctgggattacagcagagaacaaaatccctgcccacagctttgacagtccatcaggggaataggttgtagcaaatagaaagcactcaataaagtttttatattgctgtgactagtagtaattactgggtggctacctgtgttgggaaaacagagggtaaaggtagcctgaacaggtaaagggaagtgcctgcgtcctggggtgcttcagcccaggtgggattatgtctcctaagggacagaagcctggcctggagctggaggaaagggaaaacaaagggaatgcaacatccttctgaatttctcaccattcagtgggcaatgcagagctcacagtgtgtgtgtgtgtgtgtgtgtgtgtgtgtgtgtgagagagagagagagagagagagaagtggggtaggggagtagggaagaatgatacaggagagactgtggcaaagcaaacaggattttgctgctctcaaagagcttacagcctagtaaccaagatggcttacagtgaaaaatgatttcagagcaatcccgaggaaaatatccacaaatgcattgtgatgtggtgtcctggagcaccagttgggaggaggaggaactggggaaggaggtgagccttagtccactgcctttccttgcttagcaggtctcagctcctgcgctcagctccagaaaattcaggagcttccccacgctgcttcagtgtccttcactgtgcaactgcagcactccctgtatagatctcagtgcctacaactgactgtctttgactcaagtgagagctcttgagagcacgagctgtgtattatccacctcagcatccctagcacccatacgggacctgtcacattaactgtgccccttaactatttgctgaaggaattaaggaacaagagatgtgtcagatgggatggcggagggaaagcctcatagaaaagtggatgtggagctgacatctgaagtcactgcctgtcagggtagctataaaggagggaagcagagttggatactgatgtgaggaagaggagaggaatggagagatgggattttgtgttgatgggcagggtggcaggaagccagacaccttggttcgggagtggaaaaaccatgttgagaaacactaagaaatgtgaatgggagaattagagggagtgggggagaggatggaggaagagtgttgaatatggttccaggtggaggaattcattcattcgtttattcagaagctgttctcctagggcacattctgtgcccagactgtgattagaagtgaggtgaggcatctcagatgggtgctgtggttcatgcctgtaattccagcacttcaggaggccgaggtgtgtggattgcttgagtccaggagttcgagaccagcctgggcaacacagcaaaaccctgtctctacaaaaaatacaaagattagcggggcatggtggggcgtgcttgtcatcccagctattcgggagactgagctcgggaggacggcttgggcccaggaggtggaggttgtagtgagccctgaccacaccactacattccgtcctggtggtgaaggttgcagtgagctatgattgtgccactgcacttcaccctgggtgacagagtgagaccctgtttcaaaaaaaaaaaaaaaaaagtagtgaggcatctgtggaagtcttcagatcatttccatgaccatggaaatgctgtttggagccaggccctggagatggagaggaaggttcacacacttgtgcgtgcaagttaaagcctgaatgaagatttaaaaagtgtgtaggacggatgggagcaggagagaggctagaagacacttgcaataacccaggtgtgaggcaacccaggaatgcggagaggactgagagatcacagggggaggcctcgcaagatgaactgacacatgggatggcggcagggatagggatggggccctggggagagagcgtggcaagttctcagcattcgtccgggaagtcgatggtgtgtcatttgtctaggtgaggagatggatgaattccgtctggggcatgttaagggtcagggaaatggtcatgtggaagggtgcgcctaccaagctggaggagaggtgctgcaacttctttctgcctttgtatcattcagacacactgtgttcactcatcagtggttctcaaaaggagaggagcacaccagactcttaagtaagggtgtgtgtgcttgtgtgtggggaggtggggggatggtctgaaaactctcccccggagataaatatattcctaccaggggtgctgtctcctcacctccctctttgggaatcactggcttctactagagtggaagacagatgtatcattagatcgatcagttgatccatatttatctgctcccagtctggaggtctggttctgggagctgagaggacaccaggggaggataagacactttctgaccaagacattttttgatctctcatcttataaggttcgtggtcactttggggagatcatatctgtcacccaacataaccatattatgataagagccaaaagtagatagggtcagttcacgtgcttcgagttcacagggactatgggtctaaggagccggggtggaggaaacagacatcgtcaatggtggcttcacgggagggagatgggatctcaactgggcccttggaggagaagctgccacgacctcccccaacaccttgacattaaatgaacagacacatgaatgagggggaaaggaagactaattgggtccctgcaaggtggctggatcggggtcagaccacaaggccgatctcagcgtcgcctccccactctgcagccccagcacaggaagtcacactttaaagcctcctctggcggaaattgtgggggagttggaggggtgttgggccaccccctcaactgtctctccacaggcaccccagcttcctgcccttctgctccaggctggagtctgggcctaaagagctcacctcctgtttctcctgttttgcttcatttacgcaactgctgaggactgggcttactggggccagctggtgccagcagtggtgcccagtggtggggagtctgagggccctggctcctagggatcagagagggctgacctggagcattctgggggccaggggaagcctaggaagcagggctggttcttccatccggcatcccttcttgcctgctccctcgttcctggaagtgggtgttcagggctctggaggctttcctgtattgccagtgggcttggggagggtctgtggagactcagaactggccttgtttcctaaggattgtctggggaccccagggaggcccccaaacccagcacaactggtcagaaccagccaggctgtgggaatgcggtgaacccagggtgggagggcagccttggcttgcttcctgctgggacgggggagtgttgggggatggagtgagagctcacggaatgggtttagctgttggagacttgttgaactgggaggaggagctggggcggggcctcagctaaaggccgctgaggggctaggaggagccaagtggccctcagggaagggagggcacagacctgatgggcggaagccagggtcgagggagacttcccttcgggatggaatggggagagggaggcatttcccggaacatgtgggccaagtgggacaagggtctgtggcctggctctttgcatggggaggggatggatgggggttgagtggggatgggaaggagggacttggccataggaagaagggattagatggagtcccacttgcatgcaggctggtgccttctgcctttctgctgactcatgacccttgaggagctggggaagctgctagttccctctcccctccctaggtctccctccctctggcctgagtcactggggcggagttgctgggaaaagatttccctttcccggatctgacttaacccccagagtgctggaaagagaagggaacacgtggcctgagaaagcctctctccctccctccctccagggaggctcatcccccactggccagaggtccctgaaaagctccctttaaggctgtctggggctggcgtcccccagttcttcatcatgactctgcctcaagccccctggatgggattcaaagtaccagtgaccttaggtgctccagtggcttcttcggggaaaggaaccacactttcaggactgggaagttcttcccatcaccaccccaaacccttcctgttgccctggaagccccagtcctgttctcagcagaggtggcacggtgttggctggtgcgggcaggggaaggttgttgtcctctgagcaggggcacacgcctccacctgcgggggctgctgttgtgtttctgtgtgtggcttcccctgtttgcggctgaggcttgaacttccgggcctgcacagcttacagctgcagcgtctccccgtggctgactcagggtgactggcctcctgctccgaaatgtggagttggtgaggctgggtggctgtgggctgcctgaccctccttccctgccctagggtttctgtgatctggtgagtcagttgctccccagtgtttaacagacattgaggacaccctcttatctttacacaaagtgtctcttatagtagaaaaaaaaaatgaagcccagggaaaaccagaaatgaagctggcagagatcaaagtccaagttagagctaaatattcactcctggctttgctttcctggcactgatgccggaacaggacaagccatttagctgctgtggggttggcctgagactgcaaagcacaccttccagaatgccatggtgtgcagggggctccaggactccccagcacgccctcagctctgacctgacagtcatccaagctgggtcgctagccttggccagctctatttgcctatgtcctgcacacctttgcccactcctgcccccgtctcaactttgtcccccgtctacccatgcaggatccccaacctttcccttttactctcctccccatttgtccttgccaaccccgggtgtttgtaaattttgaggtggaggggatgggccagggaatgtgagggcggaggcagattgaggtttgatacaaacatgtaaataaacttccttcttctgtccactccccaggagtggtgctcacgggaacatcactcgcccccaccgccagctgactttttcagaaagcttttcatggtgtaacatattcctgggatgtgcatagatcctcattgtttacctctgtgaatgttcgcaaagcgatcacacggtgaacccagcacccagatggagaaacaccgccccaatctttagggctgcttgttggaagaaggggccatcactgaagtaacctgccaattcccaatcaaaaacacatcctttcaacatctgccctgtgtccagcactgttagctgctgtgggggatttcacagtaaggataaaatacagggctgggctcacgcctgtaatcctagcactttgggaagccaaggtgggaggatcacttgagcccaggattttgagaccagtctgagcaacgtaacaagaccctgcctctactaaaaataaaaaaaaattagctgggcatggtggttcacggccgtagtcccagctattcaggaggctaaggtgggaggactgcttgagcgtgggtggtggagggtgcagtgattgcatcactgcactccagcctggacaacagagcaagatcctgcctaaaaaaaaaaaaatacagcttagatctggggcctactagctttgagttgagggaacaaaaatgaacacacaggacaactagagaacaattaagcatcagattgtatggccccaactgtctaagtttcaaggaagaactctaaacttagtgagtggcgtggcctgggcggaatgtttcactgaggaaggacttgagccagggaagttttagatctgctacccctaagcttcccatccctccctctcttgatggtgtctcctctatctgattcttccccaggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggtaggggcaagtggaaacggtgaatgccctcaggtctggggtgctgcttctttctctgcttcttccagttgttcttccctaactttgctgtctctcctgggctgggattttctccctccctcctctcctagagacttcagggaatcggccctggctgttgtccctagcatggggctccttccttgtgttctcacccgcagcctaactctgcggccccattcacaggaacctacttgtacaatgactgtccaggcccggggcaggatacggactgcagggagtgtgagagcggctccttcaccgcttcagaaaaccacctcagacactgcctcagctgctccaaatgccgaaagggtgagtgtgcacaggcaggagagtcaggcgggtcttgagtggtgtgtgggtgcctgtctatgtgcaggctggtgggtgtgggcaggaaggtgtgtgttttggtgggacactgcatggatgtgagtgtgtattacagagacacacacttaggggtatgtcaggaaggggatgcagggacaggaggatgcaggactcataccccatcttctcccctcaccagaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgtgagcgcagctctcctgaggccaagccctctccccaccccaggggttggccccttccccatgcggtggcacttcctttccttccccctcctgtattctgtgggtctgacaaccaactcctctctggccgcccccaccctgtccctcgtcacttcctctgtcctgtggggtgggggtgcaggcgcttctcctttagctgtgccgcacttctccctacaggccaggagaaacagaacaccgtgtgcacctgccatgcaggtttctttctaagagaaaacgagtgtgtctcctgtagtaagtgagtatctctgagagctgctgggcactggatggtggcatgggttgggacgggtgactggtgggaaccattagctgggcaacagatgccaggatgccccagagtgctcagggtcctactggctgagtaggagacacttcgttaagacaccaggcagtccttccccttgctcttcaaatctgaagaagtctttgaggatggaagatcatgccccaagggctggcagcccttccaactcagatatgtagattcttggatctacgatagctcattggttctaggacatacactcttatagctctgaaatcaaacctcctataactggtgactcatcatggttgaattggcagctctgtttgcgtctgggtagtaatgtaaagaaaagtgccttttattcttgatggcgtcttaggtttgatgcaatatggtatttcctcattagtcactgtccaggcctccttactcctggctccacagaggctgttcttgtcactcacttgcaaagaataaactctgagggctctcagagtttgaaccccagcatagccacttactggctatgtgacgttgggcaagtttcttaacatctctgagcctgacttttcttttggtgttttttttttttttttttttttgagacagggtttcactctgtcacccaggctggagtgcagtggtgcaaccgtggctcagcctccacctccagggctcaagccatcctcttgccttagcctcctgagtagctgggattagaggcacacaccactacacccagctaatgttttactttttgtagagacagggtcctactatattgcccaggctggcctcggactcctgggctcaagcgatcttccgcctcagcctcccaaagtgctaggattacgggcatgagccaccacgcctggcctgggccttagatttcttatatttaaagtaagcataatgacattcatttggtgaatttgtgagaaccaaaaacaaagaaacaaacaaaacctacaacacgtctgacacaaaactatttattttccattaatcttcttttttttttttttttttttttttgacacagagtcctgctctgtcgcccaggctggaatgcagtggcgcgatctcggctcactgcaacctctgcctcccagattcaagcaattctcctgcttcagcctcccaagtagctgggattacaggcacgtgccaccatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgaggaaaccgaggcttgggggttaatggcttgcctagattcacactgctagccaaggaatgaactggaatttacaccctgaccctgactgcttttcacattttctacacagccttttcaagatccctgccaattctaaaattaaatgattctatgattaactgtgtttcattcttctgcatcagttcccaaaacaaattatatcaagagacagcaaaaatatttgtaaagaaaggatgtccaacaatctgtgtggttgtttttctgtgttcctccaatggtagggcctctgttcaccagtgccgtctcttcttttagctgtaagaaaagcctggagtgcacgaagttgtgcctaccccagattgagaatgttaagggcactgaggactcaggtgaggagaagtgacctggtgcccatgctcacctgccctctccctcttcttgcccccacccgtccatccatcccacccatccatctatccctgcggcccccctctgcccgctcctctgaccaacacctgctttgtctgcaggcaccacagtgctgttgcccctggtcattttctttggtctttgccttttatccctcctcttcattggtttaatgtatcgctaccaacggtggaagtccaagctctactccattggtgagtgggggctttgggagggagagggagctggtgggggtgagggaggacatgggtgggtgcgatggacatgtgtggagggaggtgaggagtgtcccctcagttcataccgctggggactctgggcagaaggtggccctggatggctggggagatgtcgagctgcatcagtagctctctcgtccctggggccacataggccctgaggcatgtcaccacaagtccccactgccagctgagtccagggtgccagggctgagagaggaagtgaaatttatgatgctttctttctttttcctcagtttgtgggaaatcgacacctgaaaaagaggtgagatgaaatgagagagttactcccaaatgtccctgaccattccttataattgcctaatgctcagatcccctggaatcatccttcactttccgggggctcgcctcattccctctaagtcccaacccccacgtagaataaagagggccggggctggttttcgctgccgcactaatgctgcgccaccttctctctttcagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacagtgagtttctcccgcggctggagacgaggaggctgggggagggccgggggagcgcgggaggcgctcccagaggggaccacgagaggcggagggcgcgggatgcggggcggggcctggggttgccgcccgaggctcaccggcccgcgtccccgcagctgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttttgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctctgctcttggagacagtggtctgtcgggatgggaggtgggggcagaggcccagatcctgaggggtgagatgggaaaagccctgcactagggccaggtagcccatcaccatcacgccaagtgacagaggagtagcaggttcttgttctgaacaccgtcatctgttgcccaagctggagtgcgctcactgcagcctccaacccttgggctcatggggtcctcccgcctcagcctccggacacaggcacaccaccacacctgggtaatttttaaaatttttttttgtaaagacagggtttccctatattgcccaggctggtctggaactcctgggctcaagggatcctcccacctcagcctcccaaagtgctgggattacaggcagccatgcccagccagggcagtcatttttatgcacaactttctgtggggctcaggtgcacctatgatacataaatttacagttcttgatccccaaacagagcaggaggcagggtgcctgggccaggcttcctttgggaaatgtggtccttgaggtagagtcacagatgccggagggtgaccagcactactggggagagatctcctctgggagagatgcatgccaaaggtcctctgcattcctcatacctctctgaaaagacaggagggggtgttaggcgacattcagtggcaacgggtgagggtcaggtgaagagtgaggcggagagcccttcctgcctcagcccctgttcctgctttgccctctttctatactacaccccaccaccatacagacatccccgtctgccccctcccaggccagcttccctccagcacttacgatgcggacagaggggtgtccagctgaatgatgtggggcccccgcatcctctgcagctgggcccgagtcagcttccgtggcctgctgtcccggggctcctcggccccctcaatcctttggctggccagctcctcccggatctctctgagcatgtcctcagcccgcattgggcgcagggatgtgtggccagctttcaggaacagaggcccctcttcttcctcctcccctgaggactcccaggggctttccccggcagagtcagcatgggttggggaggagggaagctggccccgaagccgggccctgtggagtgtttccaccaccacattccctcgctcggaggccccatcttcttcctcagaccaggttggtgggtcttcctggggaagactgcctccttttaggattccttccggcagttcgggggcgcttcggcgttgaggagcttgggggtcgggagggtggggacgcagagggatgtcccggagttccagggtggagaaggtgaggcgagggtcccgccgaagggctctttggcgtagacggctcagtggggagcgggaccccgtgggggtgcctgggatcaaagtgccgtagccagagtctgaggtatcatctggcacaaggggagcatcttcatctgtgtcttctgtcaccaccaggtgggggataatggtcgagaactcaggagtcctacagttaatggcaaagagtcagatgcgtaggggtcaagttcaagtccagggagtttcccttgatcactacatccagaaatggcccctcctccaaacttattttggtatcatctttccatcgcactgtgattgtttttctcatctggctggctagattttaagctcctaagagagtacgggctgcctctatactgttttatccatagcatctggtccaggatcttgtatcgagtgggtagtcaggtttttgctgagtggttcctgaacttacctgatattatcctcaatgatcgattcttcttttctccttaagctgctgccaagcagtggtgctatcctagacgaacctcacactccccggggatttggcagctctaatattctgcagatccacacctaccttcactctcgagcttgctcctctcacagtgctcctgtgtgactctaggcaggctaactctgtaggctgtctgtgccct

SEQ ID NO: 13818 - DNA, 10585 bp, Human
taaagcattcttgggaatttccctgtctttccctctaaataatcagcatgtaaattgcaaaaaaaaaaaaaaaaaaaaaaaaaaagacacgggcccaaaagggagcgctcagtttcaggctctttgctttccttcctcccgaggctctctggcccttacccagcctgaagacagaaagtgtgagggggagggtaggaaggtaggtcaagcagggcaatgctgagcctgggaagaaaacaacagccttgtttagggcactgtggcttacgtaactaaattgtgcccagtttccacctggccaggggcctggagtgaatgctgaagatgcaaaggtagaggctgccagaaaagccaggaaattgctggcaagaaaggccagtggtggggtgcaggagtgggaggaaggctgggaaatgcggctgagtcacatctccggaagccccccatcatcaccctagtggctcttctgctggcaggtgcctcatgaagacctgacccaaagttttcaaaactctgcggtttctcaaccctcctctggtaatccatagtactcccccgcctccacttgccagcctcgtgattccttcattgacacatagctcagttcccataaaagggctggtttgccgcgtgggggagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggtatctgggctagccaaggttaatccatcagagttgtgggttttcaggcccagacagcccgcagagccatctgcctgctgggtgagggactaagggagtgggcagagggggaggagaagcagagccaggggagggactgaggctgcaaccaggaggtgggggtgggggaggtgggtctcagttgcttgggggagggagcagggcggaagggcaggatgcacttgcaggggtctcatcctggatttctcttcaggctttgtggtcctggtgctgctccagtgctgtgagtaatccctccacctccacttttaagtccagaggcgtggcgagggcacagggcaggtgtggaggaggtcttagctccaagggaacactttgccaggttcttctgtgcttccaatgacttcgaaatagtcacgtttgctaaactggagtgaggagtatatggatgtttattttgctatactctttggtatatgtgaaaattctcaaaataagaaactttaaaaggtcctggttcagtgaaggctttgactaacagcccctgggagccgctagtacagttgcccagtagctgcttggatgagtgatgcccacattgtttgcagcaggagaaacagaattagaggcgaggaaggatttcctggtccattgtgatattgtgccccagcttgggggacatgccgagggagcacaggactgccattccgggtgggttacaagttagaggcactctcaccaggaggcagagaaaggtgggccagagtccctcatggatgaaggacctcactgcaggtcactaaaggtgccagcctgaaagccagggccatctgtgacacaggctatcttgggccttcccctcccacaaagccactgcttccaggaagcctgctgtgctggcaccaagtcccatttcatccttattccccagctcctacccttcccccacacagtgcctgtagcgtattcatcccctgcattggatcttttctaagcattttcagaataggccttattttcaccagtcagggaactccccagaggcagggggacctgaaccagctcctttcatttaagaattctgactttgctcacaatctgcaccccactcctccctacccaaccccacaccccattggtgctcagctctgggctcagcctgaggtctcttgccgaatcctggcccgggccccatcccagacttctccttcaggctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggttgggccagggctggccaggagaggagggaccagctgggctggtcccagggcagggcaaccccacccaggaggaagggcgaggccccaccctgctcacctatgtttggagagttagaggggcttggcttaaatgggtggaggggatgactgtaggtgctgggcaatatttggggtgatgagagactgtagacggaagcgcagctgagcccctctgggagaggggaaccctctcctgcccctaacgtgctctccagggagcatggaaaatgagcaagactctactttgccatactctgtcttctccactggggaaaacaaaaatgggcagcagacctcagagtaactcccatgaagcctgtgacccctcagagatccaccactatgaatctctatgggattcccatgatgtcctatgggaggacatcagcggcctaacccagcctctcacccaaagcaggaaaccttctatggcctctcagacatggggccacccagtgtcatgacaatgtcattccactcctgccctccccacctccctgtgctccacaggaaccccaacctgaagactctcttgtctgtcggaggatggaactttgggtctcaaaggtaggagcctctccccaggggcaggacggcagaggatgatggcataggagtgaggagcttgggtctcccgcatccactgtatggatgttccaggggctccagactagataggtacaaggcctacctgtttgtcaagggcctgcctgatgtgtagcaaagaaagcagagcccagagagagagcaggacttgccaagagtcacacagcaagttaacagtggatctcccaattccctgccaatgctctatttactacctcacaggcccgaaaatatgggacttctggggctaccaccattagggctggaaagagagagatggaaaccaatggggacattgagaagtggggagaccctgggaggagtctttggattaggtggggttggagcagggcttgaaatgggggtggttatggccatcgttggcacccatgtgctgggtactctttctgtgtccagcaccctgtctccccatgatcccatgttgtcctcacaacagcaaggtgagctgttatatttgtccccattttacagatgatgaaactgagactcaggttataacctttcacagtggctggctagtaagtgatagagccagacttggaaacctggaatgcctggctctaaggcacatgcatgcctggaggcgacccctgtcccaatcatgccctcccagagctgtgtggcctcaggatcccagctctgcaggtcctggaaaccccaccagaggcccaaggcacctagcatatcagtgctgagcatgctacagggctgattttggtcctagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggtgctggtcaggtcagggacagggagggaggtgggcaggcatgagggaatggggtgggctagaagccggcgtcagctgctgtcctcctgaggacaggtaaagagggacttcagcctcagggcagtgtcctgggaccctgtgccctgaagatctcacatagcaaggaaggcttcttgtgaccatggtgggaggtgggaatggggttctaagaggtggaaggttgtgactgagcagagcacccacttataactacccacttagtgcattgcccattgcccacccttcaatcccatactgatgccacccatacccagcatgcactgtgtccagcagctctcagctctgcctgggggcagcctaagtatctccagttaccaggggcagaaggagagtctaaacaaattgttcacaataccagcagcaatcactttaactttgggatttcatgcaccagctagaacaaagcacagaccgaaaggcaaatgtctcccaaagtcatctgtgggccaataggggtcacccactgtccgatgctccctccaggacagggagtaattgagtgctgatgggtgtgcatgggtttggggagaagattagtcagttttttaggaaaaggatgggtgacttgaggatgggaccactgatgagccactttatcacttccactaggccccaggcaggttggggagtacagcaaatgggttgcgcagagacctagtccgccctcgatgagtctacctctcatgccacttgggaccctttctctcacctgcctgtctcccatctaggaaatgaaggccgaatttataaaggaagcccagccagggaaaaagcagctcctgctcagcgcagcactgtctgcggggaaggtcaccattgacagcagctatgacattgccaagatatcccagtgagtctcctgccccaggcagcctccccagaacctctgccaacactcctgtttccccgccacccccagccctagcactccatgtagactgaggacactgggcttccagtcccagttcttccaaagccttgatgtgtgaccttgagcaagtcacttccctgccctgtgcctcagtttccccatctgtcaaatgaggcataacaatccttgcctttcctttttcacctgggctgttggctgagcagttgagagagctgctatgaaagtattttggaaagggaagtggaaaaagctattcaaaccctccagctattgcagagtattttctccacaccaggcagagcagagtgctgggccctggagaggccacacagcagcctctttctagagtgctggggagtcctcaaggctctctcatacacacaggcctccccctttcctgttggccccacgcctcatcctcaccccacccctcatgcctgtgaggaacaaggaacagccaagcagcctcatctctcctgagagcagagccatgggtctcgggaaacccaggagtaaggaacaaagactcttcaaaatgacttcagagctttctttaggatcccagggaggtgtaaactcagtgcttaattaaatggattctttagagggtgggaaacaggtggatgtcaaccatttgccccacatacccgtattcatgcaatccacccccagtgggctcaccggtgcgggtgtgcaaaacctcctcccaccccagtcatcttaggttcaggtcatcctttggtcctgctctttccccgccaggctgtctgttgatgctacttttaatctgctttcactaagataagcctggcagaagtggtgggggtaaggtgggctgtaggccagctcccaaatgtgtgctgggcataacagaagacccattcttgactgaagtgcccttgtgggaccctgagcccgtgccctggagtggcacagggaggtgtgccagcaatggggaccgaggtcactggggactgctggggttcgggctagtggcctgtctggctgctgtctgcttccctcgttcacatcctgctggagccttaaataggagcccaaaagcttttctttcttacttttttttgagacaaaatctcactctgttgcccaggccggagtgcagtggcacaacctctgccgcctgggttcaagcgattctcctgcctcagcctcccgagtagctgggattacaggtgcctgccaccatgcctggctaattttcgtagttagagtagagacggggtttcaccatcttggccaggctggtcttgaactcctcacctcatgatccacctgcctcggcctcccaaagtgctgggattccaggtatgagccaccacgcccggcctaaagcttttctattaataatttcctgcctcaccctccatccccttcctcctcagacacctggatttcattagcatcatgacctacgattttcatggagcctggcgtgggaccacaggccatcacagtcccctgttccgaggtcaggaggatgcaagtcctgacagattcagcaacactgtgagttcccagaaggagggagggccaggagggggccgcaagacctgccatctgccagtgctcacacaccaatctctctagccctcagtacagtcctgcaagaggggggtcatgaggcccattccacagataaggaaactgaggcccaaagtctgggcatgctgcgttgctctgggaaggtgatctgcagggtaaatggagtgagggcagggggccgaatggggagaggctgggagccgaggaggtaggagtcattgtgccctcagagccaaccacctgatttctgcatctgtcaaatagtaatagccccttcctatgcctcaaaggatttttttcaagaatgaaactgtaaaattcactttaaagtgacatgatccgttcccggagggacaggggaatccccagtgcaccatacaccaataacccctgctaaggcagcagtattaattgctcaaccttccgcacctgtgcactaactgctcacgttgttcccaccctaccccacccaggactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgaggtaatggagttggggagaaggtaggattcccccacaccaccagcagccctggggaaggtgattccccaccacgttcttgctttttctcctttgggaataaagaaaatgtccggttgccccagcatgcctgaggaagtggaagggagaggttaggacatttgttgctgaaaatctccagcaggtacaggcacatgggcctgcaccactaggcacctgggatagccctctggctatggggctgaggtcttccttccagcccaggaaagagcagaggtcaagaggcagattttttgtttcactctagcctctgctactctgtgtggccttgggcctgtcctcagtgtcaaccagcaggcctcacatctctgtttaaatggaagaagctaagcagggccaaggcagccaccatctctgggtcatttgcctctggtttgtataaacttgtgtgatgcatgcagcctgcagaccctgcagagagtgaggctgcaggatggagcaggagctaaaagagatttggagagtggcgtctcctggtgacctgcaaggtctcggcacgactccccacactgccttttccctgttatctgctcagatctgtgacttcctccgcggagccacagtccatagaatcctcggccagcaggtcccctatgccaccaagggcaaccagtgggtaggatacgacgaccaggaaagcgtcaaaagcaaggtaggtttccccaaggccacacctcaggacaaagagaaagaaggaggccccgctcccagcagccagattcctgtcccttgcactgaggtctgggctgggctcacagagcacatgtgccctgtacacactctgggtcagggaacccagccctgctcctctgggcctcccctgccaggtgcagtacctgaaggacaggcagctggcgggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacagtgtgttggcgctttgctttggtctatctttgagcgcccactagacccactggactcacctcccccatctcttctgggttccttcctctgagccttgggacccctgagcttgcagagatgaggccgccatgtcctctgcctagccgcagagagccccagtgggaggccagcgtcctcagattcacctgccttggacttaacccaagcatggctgatggccttccaaatattaaagtcattgccatccagatttctaaattaaattccctgttgaaagaaacgttttctgtttcctgaaggctagcaggccctgggaaagaaggcttttcatcccaacactccctctcttctgatccacaggaaggtggtgggagctcatcacaggaccaggttagaaagccctgaaccctggaccctcagggccagcaggaaatgcagatgtcatctcatgcacccttcctgcctctcgggactggagtccctgcagagtgcttgagagatggccctccagcctcccagtgaggggcagccgattaccttggaagcaacccattccgtggctgggctgaaatctgtcaatagtcctagtgctgggcttagccctttgttctgttcacccctcccctaacactcatccctccacccattcagagatcaaagtacctctgctcaagctggcctgagataggaggtcgggaggatgtgatggggtgactcagaagaatagacagattttcagcctttatgaggtggagacgctctcatcaggcttctgttgaattcccagggccccaggaatgcctttatccaaaaaggctccagatactcaccccagaactaaagagaattgatttgtggattctctgatgtttggattatctgtgacttaggataatcacaaattggcctgatggtttgtgacgccggtttgaagtggagggaaggaggaaatatctgaaatctgaaccagctggagctgggcagatgctactgatcccaaggtcacagccctgctgaaggcgaagaaaacaaggactcggcaaggcgtggagtggggtgtggggagggggtacccggcatttcacctctggctggtggggccaagtattccctaatccctgccactgcccaccccaccacacaggcatctttgaaaccccagggctgcaagcccttgtgggcagccaactgccctcccctggggccacccttcccccagccggggacaggctctccagggctgactcagtgtcctgtggggttagtcacattcacttatagctgcagagtcagaggccaaggatggagatccagtctccaggacccactccctgcctggcaagacgtggagtcacctagcagagggcgagggcatccagggagggccagatccagaggctcccaggccctgcactgccactccccagcagagacagcagggttgagaggcagccacaccctggtgtccccagtcctcaggaaagggaagagcatgcatgctgctgagggccctgaataaatcacttttacttatttttaaattgtgagcacatcttacgtgctaaagagtgcataaatgtatttgtttaatttgaagaataactatgtagtaagaacctgtgtaaccaccacccaggtcaggaaaggaaacctcattagcacccctgcagccctcacgatcacagatatccctgttcctccacctagaggcaatcgccatcctaacttttgtactggcctcatcttcctttctggccttaccgcctacggatgtaccttgaagaagggagcctggtgttgactgcatttggatttaatgtagatgagacagatgagacgcaacatttctgtgtgccttgctcttctgctcatcactgggtctgtgagtagctgaagttgctcatttgaccccatattttgctttacagttgcataaacactccacagttatttatccatcccactgttgagggacagctgttttcccccacatttcaacaattacaaataacattgccatgaaccttcttctccatgtctcctggggcatgtgtgggtgttatatgagcggcacggctgggtcacggagtaggcacctcatccattttactaggcactagtaaaactctcac

SEQ ID NO: 13819 - DNA, 6798 bp, Human; identical to SEQ ID NO: 12102

SEQ ID NO: 13820 - DNA, 11499 bp, Human
aacattgctaagagatgggatggggtaaggagaggcataagctccccatcaaaccctttcagcacccatggctctaagaagaggctgaagtgggcagggtgcacagcccctagaaagctgagtctgaaggggaaggtggctcttgtctgccaaggtgcccagtctgaaagaaggagaaacggagacagaggctcactgtgccagccctccagacagccaccttggtcctgcaacagcccagggctgtgcatggaaaaatgctctgttggcagtgggccgctccattcgtcttctctcctggccagagccaggaaccagccagcttgcccaggcagtgggcagttgggtcagcttctccaaaacactgtggctctttgtctgaggcctgaggctgcctgtggatgagccagggtgcctgctcctctgcaacctaggaactgatgggatgaagtgggcccaaggaaactgttttgaggggacagagaggtctgggatggatggtggtcaggaggtaactctgttgagtgtcatagttggggtctttcccatcagttcactggatctgatgatgttggcttttatactcctttctttcttctgtttacagttgccaaccccagtaggcccaacagcaatgtgagggctgtatgtgactcttccaggccaagaaaggttctaaggtttctctgtccaagggtgacactcaggaagatgcccactgctcacaggagtatgtcatgcattggctataggtaaccagggtagggtacccaggccacccctagtctcttaccttccatacctttagtttccctctcagatgacatcagacccacatttcctcttcagtctgccctgttcctatctcattagcacaacaggttcaaaagcaacaggtttccagcaatgtggggacctagacacagagcctggtcatctaggtgtcatcgctgggagcaggtagcttgggaaaggagaggagaatgtcagggtcctacctcaagctgctttcccttgagcatacacaagagtttccaatctctagctattcttttggtgtccctcattcatttctcttggccccacatggctcttgcatgatgcccatggtggagcatgaggagtgctaacaccttactaggcaccatggaagagagaagcagattaactcagacttcacacactgagtacctgctttagaaggcaagtgccacacccagtgccagggtcctcagtctggaaaggatttgtaactgctgcatgaagaccctgtcccagccaagttgcatgtgtagccacaaactgctaaccagtgagtttcctcactcagcagactgttacagatgatggcactttggagggcaacctgagccttgtggtggctgcagagggaccacactcctccccaaacactcaagaccaaaaactcccagcctgcccaagagaccaaaagattttccagacgtagttcagctcttccccttcgatgcgtcaagcggcttctggaggtctcccatcctagggctttctccttggactcttagaaaaatactatttccccggaacatccaaactggatttgggttcagatctgaagagcatcccactaccatccttaccaccacaccacaaacacagggattgctgtgggcttttcagctttcccacaggactttcagagtgctagaggctcctaagaatctgcccctccaaaaaaaaaatgcagccgttcccattcaaagacattctgtctgtgactctatgaccaggggaaaatgcacttagctcaccccaaatagccatggtccggctggaccaagtgcagaaccagactgggaggaggcaccgaagaaatgagagcaaggctcctgctctcagatgtttgacatggaagtcagctctgcatagctcaaagcctaaggcttgcctactctgcctcactgcctctgtggagtctcactcatgctggcttgctctgttctctcccgcttcttgcagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatggtgagaccttggcaaagggaggcggggactggctgtctatttcacttgaaagacactattctgagtgctagtggcaaaacaaaagaaatagaaataggggaaccagacagcacaaatgaagcaacctgacaaccaagccatacccctgtacaaaagagaatacacttatactaaatagcagtgctaagacaattcagtggggagtgggttggtacagaagaagactttccaggagaggtaagtttcattccaggtcttgagagataagtgggcatgggttgggggtatgcaggatggagacattctgggacagaggcttgccacaaaggagccagtcattttcacaggtcacctgtcgatgtaggggacagctgggaaatgtcacgtgtctgagatgaaggggtcatgtgtcagggagcagtaagagatgagttcggagaagtttaggagggaatacttcaaagggagggagatttaagtttagcttctaaagtctgtttcaggagaatggtgggttgaagccctgtacttactcactgtcccagaagaggatgagctctctttttccacttgaactactcttgcgtctacagcctggtcttgtgttttggtgtttattctcagagctgaatgcggcacttgttctggtcagttcttcctggagtacaaggaccccctggtggcagggcagatatccttcctagggtaacatgagcctgactaccaccaagcctaggacactgggcttcctgtttcataagcacttccttgcaatgcccaaaggaaaaaaaaaaaaggctgcctccctgactctaagaaatattcatttcagatggaattatctagctgattttcagctccctttagtcttaggatctagtattcagaacatgcttacattaccccagggcttctgatgtcttaatcccagctggaaggtactgagccagcacttgacctcccttcctgtcagcaaagtcctcttccatctggagaagggaggactcattaacgaccactggcaaagggctttgaagtggagcctgctgagatagaaccgcaccatcaaagcgctgagaagaacagagtcgtcaccctctccctctcattcctttctcccctgtgctcagggaacagatcagtcattgagcaagatgttaacaagctgggcagccctctgagtgagagaggcaccagccccagagggcaatttgggagttgacagtcgggtgggcaaggcaaagaggcatctgtctggcacctttagtttgaagtgcctgacaccatcatgtacggcctaaactcttttttattaaaatctctctttctttggggtctttttattcccaaggtggggattgaggggtcctctaagacgtctttttttttttttttttgagacagagtctcgctctgtcacccaggccggagtgcagtggcatgatctcagctcactgcaaactccgcctcctgggttcacgccattctcctgcctcagcctcttgagtagctgcgactacaggcgcctgccaccacgctcggccaactttttatatttttagtagagacggggtttcaccgtgttagccaggacggtcttgatctcctgacctcgtgatctgcctgcctcggcctcccaaagtgctgggattacaggcatgagccaccgcgcccagccaagacatcttgaagatgttgcaagctgcagacgtttgacatttccttgtggctgtctatcatcacaccagcagttaccactacttacctgccacacactctgaatccaggagcagtcacatcagaaatgtcacacgtatgctgtgcttcacccaagtttgaccctgaaactgtgacagcaaagaacagctgtcatgggaaagaatctattagcacctacccatacaatcagagaaagttgggatggaaaaggcttcatcacaaccttttatcatcgttctgccttcatgcagaaccacatctgccactcaaatgggaggtggaccacctcttccagacgcttgtcagaaaataaaattagtgcagtttcctaaggtcccgcaaacaaattctctgttcaaacaacccccaaattttcggtgtctactcccaaatcaattcttgtgcaatttaagtccaagccccgtgactaggtatcacttagtctctctcagccttctttttagacaaaataatgctttattttccttaaagtagtgaattaatatatgtaaagtgctttgtctagggcctggcatagaatttaaaaaccaatgatagctattattattagcctttcttctcattgccgctttaaagttgacaggcagtttttgttgttgttttggggaaaaagagacacagagaaggtaaagccatctctcaaagtcctccagatgatgtagattagaatcctgacctaaaggacctagagccaggcatctccgactgagaatggtgaggaatatctctctgatgcagaccactagcaggaaaacagctccccaagctcagccccctctcctacagcaaacgtgagggacatctccctgcaaaccagtcagggacttggggatggggggtgttggaggtgggattgaaacaagcttctgagagaggagcttaaagaagaacaggagctcaggggcgcacaggggaatcagatgtggtcctctcctcgccacttccctcttccatcagtatctccctcagtttttccagcctggcaagaacacagctcagaatgttattcagaagctttgggattcagtggagcagggcgggtacaccagtaggaatttggaaagacttatgtcagtatttaatttgggctagaaaaatgtcctccagtgcctccacgcagaagcctgtcctattcatgggcttggggaagacgggggggtgctcacagtacccagtatgtggctagagtccatatacactgtgtgtctagctccccacaggtatgtcccacatttacctatccacagctgggatctggaattttagcaggcagtctgagggctccaggctgggaaagaatctatcacggagcctgcagctccatcctaagtagggctggaaatgatacttaagctgagccactttgcttcttctcctcaccccactgctctgcttgtacacagataacatagacccagccccggtctaggctctgcccccaacctgctcactcagaggccacttaatctagtccttgggaccagaaaggaaacatccaaaagtattccagaaattctaccccaccaggagtgttttccaaagacgagtatttcccagtttccgctacttttctcagtgtctaattttctttaggcctagattttctgtgttatgcctgcaatacaagttaatttgctgcaacctcacctcatcttatcttggtcagtgcttaacagagactgaaaaccattgaaaatgctaatttaaaaacacttttttcattagcctctttaagctctccatgctgtctttcttggaactgtcttcttcatacctataacctctcccaaggggagccctcatggtcacacctaagaatagagttagaaaagcaccccctgcccccactcctcgtgcctggccccagactgacgcacctcctgaccactgctgcaagccgatggatgcctctggtacaacagcaagccccagctctgggtctacccaagtattacagctgctagggatgtgtccatggacaatcctaccctcaagacccaatgggtaacttcattcaaaccccctttgcagagaatgacaacaggagcaagtttcctgaaagcctcattcaccatggtaaagacagccctacgaggcttcctcagctttcaatggtgacttttgccgtctctcctgaagttttagctgagttcttggcttttcctttcaagttactgacccagtagactggagacagagtggttgatttgtcaaagaggacaaccagagggacaacagggttaatagcaacagaaagatttatgctaataccatccaagcagaactattgtctctactagaattctgcggtttaggggaaaatcttaggagacttcttttcaggtttaaaaaagggagtagattgtaatcatattaaatgcaggaggcagggaaattatttatttgacttttgaggtccctagcagccccagtgctctatgagtccccagcttcctttaaactcagagccttgctcactgctctggcagtatttagaatggagacgtgcaacccactcaaagccctggcacacaaagacacttgtctctcggcccaggctttctctctttaatttcctgccactttttctatctgtaaagtattaagtccctccatttccccagtcttctttctcacagcaattcagcaaagccctccctctccaaaaacaatcaagtatttcaaggtgtctacggttggtctttggctaccctctgcttcccactgctgcccacagctgcccacctgcccccctatcctgctaaaaaaaaaaaaatgtcccagagggaaggacgcttaagaacattcctgggcctgcagagtaaagttcaggttggtggttaggaggtgagctgcagacgcaggcacagtcctcactctgtccctagttctgcccctagtggcgccagtaagtatgactccaatcctggaaaacatctgccctccatccccaacttccacccctttatctaagctgcttcacaaaggctaatctcactgtggcttcaggttcgtaatctgggcttctctccctgacccgtgctcctcttgtccccacagagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccgaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcatctacaagagtggagtcatttaaagcagactgcaggagggttactttaggaggacctggtgaggtcgcaggtcacacaggccttggactgatgagccctctttctcatctattctgttcgggcagatgaagctaagaggaaaaaaaaatgaaaaaaaaaagtcacttgtataaaagctgtagttagcaaactgtgttctggaagttcttctttaagtctaacttcaatcctctctacacattcccttccatatggtccccaagagatatagaataactggggtttttttttcaaccctttccaccatcctctcttgcaaagccggtaattcgggatctggctagtcctgggtattgttgtcttaactgcttctgccctctagtggcaactgtgcagatctgagggcagccaagcctgccaaagcccgttggccctggaagaggaaaacaaacctttaccccccatttgttttctcattcatcctgtgttcatatcgtgaaagcctttgagtgccagatgttgtgataggtgcttagcaaatgtcgcataagttaggagggcagactaggcttgtgccttcagaacaatccactattttctgatagggaaataacaactgatagttattgggcactaaattctgtaccaagcatgttgcaaatgttacaactccatcttaagccaaagtaaactaatttgactatacttctctgacgtgagagttaggcaggaatgctagtgtgtgaaactaccagaaagaaatcatagctctaatcacagtcctctcttcaaggacagcagataaggcccctctgccttggatctccagtacaggaagatgccatgtggaggagacagagatgtggcacatagggcaggaattatctaactataaggaggaatcctctgcctctccgtttttgcttctttgcagctcccatgagcatcccaaccgagacagagcagggagaggaatgggagccagccctgctgcaaggcttcccttgtttctaaacccagtgctttgtaagaaacagagtagcaagaatagactgtccctcaggctcagttgactctttttctttcagctgccatttgatcagtcttattatgtgctaagggctttacttatttagtattcttcaccattctctaccatggagattattattttcactattttacagaggaggaaactggaaacaaagacacagaggtcacccaggaaggacgcatcaaggccaggatctgaccctggccgtctgtctccccagcctgtcagttttgcaatattatttacactgtgctgtcctaaggatccttgtattgttggattattaggtgtatgcgggaggcttgtgggtcactggctgtcataaatagagaaagatcatcttactttttttggagatggacccaaatccattctgctagcattcacagttcctttatgaatttccaattcaaaattcacttttcatcagtaaatgtttagtgagtgccactgagcaggaactggggatactgcagagaacaaaagcaaacagcccctgcccttgggggcttgtagtccagtgcagtgacagtccttgaacaacggcaaaaaaatcacactgaggatcatgtagttagactgagaaagagctgtgacgatgagcataggtctacaccaggattatcaaggagcctggcctagatactctgagatacagagtgagagcatagtaatccagacgaagagatggaagggcaggtccaggcaaagatagcagcatgcatacacaccctaatgcacaaggaagcttctgaggctctagacagcgaaaatggctgcagcacagagagaaa

SEQ ID NO: 13821 - DNA, 15338 bp, Human
gtacaaacagggtccccccatatggcccaggctggtctcgaactcctgggctccattaatcttctgccttcgtctcccatagtgctgggattacagacatgagtctccgtgcccagccagtcttttttgccctctatcatctaccacccaccataccaagggaaacaagcaaatctggcgtctgatgttcccggcctgcagaagacgccatatcccatctggatgagaaatgaagcacatgagcagcctggcagagccacagttaatgtgaacctggagaggaaccgtgctgtcttccagcaagacctcaccagcagggcgtgaagccatgagatctggggtggaagggggttggagaaaggtctgggttttatttttccttctccttttcttaggctaattaccattcatcgcaatccctttcctaaaccctaatatcttcccagtttataaagtgctctcacatttacaatatttaatcttcccaaccctgtgaggtcaatattatccatattttgtaaatgaggaaactgaaggtcctcatgatcaagtgattcacctaagaccatagcttgtgggtggctgagcccagggctgcagaccctaattttaatgttctctcctctaccccatattgcggagggcaggcaggcagtcccctgtcatggggctctgcagctctccatggaaccaataatggagaagaaaattgcgttgcattttctaagtagtcagctgggatggcaggaatttatttattttatttacttatttattttttgagacagagtcacgctcttgttgcccaggctggagtgcagtggcacgatcttggctcactgcaagctttgcctcccaggttcaagcaattctcctgcctcagcctccctagtagctgggactacagatgcccgccaccacacccagctaatttttttgtatttttagtacagacagggtttcaccatgttggccaggttggcctcaaactcctgacctcaggtgatccgcctgcctctgcctcccacagtactgggattacaggcgtgagccactgtgcctggccatggcaggaaattttgatgggcatctacttacctgcaagtgtgttgtgctttcttaattgaggggcattgttagaggattgttagaggtagtggtgttacttgactgggtcttctggggtgttgatgtgcacaggggaaatttggatttcccatcactttgtgtgatgaccacacagcccctaaatctcacctaagtgtgatatggagaagctgaaagaagccactacattgtccacatgagctaggaacagtgactttaggtcttacattaaatcttaattctgccttaactttgctgtgcaactcaggccagacttctccctctctggttctcagaacagccctggcagccaaaccgaagttatctcctatgccagcctgagactccactccctttgcaacctcctggagaagataacttagggaaagactgtcactgctcagaggaagcatcccaaacccctcactggtttaggaatttaacactaccgagcaacggccccagaaggcaaggcgattgttaggaggaattaaacaggctagtgctggacccagccatccagtcctggcttacacagaggttgcttttcatgccttttcactctgttaatttggcttgttttccaaacatgggtcaaacaacccctctccagaagcggcagcagcagaaggaaatgttattaaaaatgagtctgttagtgggaatggtgtgtggatgaagtctttgggagttttggctgccaaataaagactttattgtcattcctcctttcccaagctccctccctctctcctcccctcccctccctccctcctccctcctctcctcccctccctccctatgatctgcccctccctccccccaagctaacctccccaccccaataggatctggtggaagaaaagtcaggcaaacacaagcacgcacacaccactgggagatcagatcttctagctggctctctgctgccacagctccgccgaagggagggggtggaagaggaggactaaactcagagctgagaggagaggcaggtgtgtgcaggtaagcccagttgggagatgggcaggagactgggaagaatctttcatccagtaagtttcctccagctctgtccatttattgatctagtctctatcctctcactccttccttcctcccacctctttctcctctcaaatgagttcaaatttagtcttcctaacttctttcctatagcctcttccttttcttttcatcactctgtacccctatatttgcttactgcaaaagttaagctttcctgctgcagatgtttgttgtagcacagagagccacgctgcacaaagtgtttctacagatcaggtgtttccatagaaactggactccagaacccatttctttgcaccttttgtgtattgtcacacattgtggaagtcacacacatcacacggaggctgcacgttcactaccatcaccccacacgaccatacaaaatgaagacatcctgtccattcacctctgccctctgcatctgacatgcagagctagaccacatcatcaccagacaccagcagacacacacacacatgcatgcacacatgttccctgcatcttgtctctcgccctctcacacacacctccctagctgtaagagcaaagataaagtacgttttcccactgagatggcagagccagaagaaaatcttgcatcccaagtccaggccgaatagggaggagataagcaagagcgggagctggaagggtttcttcattatttagggcttcactgggtaggagggagagaaaaacggctttttccaacctgcacagtgtcttctcagcagctttcaatttctgtctcactggtccaaaccacttggcttttggaaagaaagaagaaagcgacccagttcccaatccttgaaggtcctaattcccagctctggggacagttcatttttttatttttttttcctgcaggcagccagaaaaatatttttctttaaagccgttctgaaattattccaaccatttaggttggcaaaaggtcctgtggcagaggagaaaaaaaaaaaaaggcagcagttccttaagcagttggggaggggaaaactgaagggcggcccctctcctgctcccctgctcattcctctctattaatagagagggtctgtcccaaggcaggcggggtgtagggagatcaggggtcccacacacagctgatcttcacagtcacctaagggctggagagggaggagtgtggagggcttactaaaaatacagatgtcggctctcactgcagatctactgaatcgagacccaggaatcttgttttaatacttcaggagattctgatggtccaccagggctcgagaatcaggggcctgagagagagctttgctgtaatttttaagcccaagactccggcagtgttagctgggcagaaggactgtgtcctggaaaaggagcaccagagtgtcccaaataggccacctcttttttggggagtgggagtaaacagggaagagctgtctccctctctcctccttgcaagcacaagcagccatatataccacagaggaacattccagtaagaaagttcccccaagatggctccacagagcttctgtttcccctcacctgttaatctgcctgccccaggaccccaggagcatgtgctgggcccttcccctgacccttataggtccctgctcctccttcccagcagccacctgtctgggctctcacagagggtgagctgaacactttcttcatgccccctccacctccctagtgggcaatcccatttattgggcatgtgagtgaagcatttcaaggctggaaggggcaaaaagctgggagaagtcaagaatcgcagtggaactccatggcccactgaggaaggcagacttgcaccttctgtggccagtgtcccctcacctgttgcagaaagcatcggtgagaagttggtgaattagaaagacagaacaagctttccctaggtggctggggacttccagagtctcctcagttagttgtttctgagacccaagtgtgatctcacaagccacaaaggggaggaagttgctctgtgtggaagagctggtaccccactcacaaggatccctgccttcgagcagtgcatgggggctgccctctagccaggctggagggaaggagaccccattactttgaaataatatcaacaagaccttaacattcagaaaacactcactttgcatgtattaactcatttaaccctcaaaacagaaaagaaggtgttagtatccccattttatagagcagaaaagcaattgctttgcctaagcctacctagctaagcatctgaatgaagaactgcaggattgggtctcagatctataatcactcaaggcatcagacacactcttctaggctttcttcaaggcttggagatgctgggggaatggggcagaggatatggtaggtggcgggctgtcagagaagagtcgtctcaccctggtttcttccccaccgctcagaatggaaaactttctcttctaaactagtggcctgaggccagaaaatcttcattctgtttacactttgccttgtggtagacactggggagacagatggtctctccataatagtgttatttttatttttagcactttttgatctgtagtgcattttaaagctgctaactgcacttgcttctgacaattgggtaaggaatataggtatagggaagatttttttattcccattttacagataagaaaactgaggcccagaacagggttcgcatcactaggtagtggtggaggggtgagaatcttctctcctaactagtatgcaccacaggctctcctcccactgccccaggcaagctcatccttgtatcgtttcaccttcctagaaaggggcatcttgaagtcatcatgcccccataaggctcctttgttatctcaggaccacatcagccctaatgggggccttgaaagggcctcaggctcactcctctactaactctgctcataaattggcaaagactgcttgattctccctgcttccaacacccttctggactacaggaagagatacagagagcaggatggctttcagacacctaggttgagaacagaaagaagggaaaaaagagagaggggtgttccgacattcaccggcacagcgctaggtcagaagcagccccattctccactgcagggtagctctgggtcaaggcatggaggcttaggggtgaccaattagacaggagatctgacaagtaagaagaatgccagttcagagtgcggcgtaaccctgctgctagccctgcctagccctgggagacaaacccaacctcattcccagcccaacctcaacctctccatacaaagccaattagccttaaatagctgctcctaatgacttgaccaacccatcaggacttccacccaaccctgccctgagcagaaacattccaccactcctgggttttaacattaaattaatgagagagatagggaagggggctatctcactttaaaaatcaaggagtccttggggcgctgtggctcatgcctgtaatcccagcactttgggagactgaggaggacagatcacttgagctcaggggttggagaccagcctgggcaacatggtaaaaccccatctctacaaaaaagacaaaaattagccagctgtggtagcacatgcctatagtactagctgctcaggacgctgagatggaaggatcacctgagcccagggaggttaaggctgcagtgagctgtgattgcactactgcactctagcctggtcaacaaagggagaccctgtatcaccaaaaaaaaaaaaaaaaaaaaaaaaaaaaaatcaaggagtctctctagagaatctgctgtttataaacaaataaatgagtaagtaagcctctgccacttgcagagattttgcactttataacatgccttcaaatgcatgatctcatttgatcctcacacagatgaggagcccgggttggagagtcagagccaggagtcaagcccagatccacaatagttggaattgaaattagaatttaaaactctcttagaggctgggtgcagtggctcacacctgtaatctcagcaatttgaaaggccgaggtgggaggattgcttgagcttaggagttcaagaccagcctgagcaatacagtgagacccccatctcatttttgtttaaagtgaaaaaagaaaaaaaaattaagattctcttaggaaacgttctttaatgtggagagtgaatgttgggttgggcaaagcaattgcctttctcttccgtgaagcagcagcttttccagaactgatggtggagagcagaactgcatgcagttggctgttgtaggtggtcaacaaaccttcactgattgagcaatgagcagagcccagtagaaagctgtgggtggagaagtgcacttgtgaaagcataagaaaaatttaaaaacacacacatggacccatcctaaggaatcttatgattggacagaagtttctagaaggcaggagcatagagtgtgggtctgaggctttgtaggagggactatgactacccatggagtccaggtaccctcagtctgtcacacagattctggtttcagagacctaggacatcacggagcactgccagagagaatggctgtgctgtcagctgtcagaacttttcatcctgcctcatggcaaagctccggcaggaaggggcatcaccccatgagaaaagccttagaaatgaatgctatttccttaagagagaagcatccctgcacttggaatggttctgattcagccctggggctgagggaaggggaggagagcaggctcagcttccccacataacttgctcctgggagcatttcctggggaacctcctgttggctctgggagcagcttggctaggcccagaggtttggaatgtaaacgggtcagaggactagtgaaaagataagttcccaaagggtctggtgctgcacatggggatgaggaaggcctgtgtttactgtggatgagaaggcgcgcacagccagcctgctgggtggagctgtgagtaacctgcctgttcctctcacccctgacaatgaagaccagggctgccctggcactgagccaaggaaaccccgccccgcccagcacaggtcacagccacagtgcctcactgcttttgctggaagccctgggcaaattggtgcccagtccctggcatatgctttcggtgacaaaggcaatgaagggatatagaaaaactcccgccagtgctgggagcctccttgggacagggcttctcacagtatgaaagatttctagatcatttctaggcttctgggtgattagaaaataaatttttttttttaaatcagggtcacaaaaattgaggcttttagaaatgtttgttttagaataccaatgctttaactacccccttaatttatatgcaagatgactgttctgttttccagaaaattacagaacttacacaatgttaattcatagttcaccaattacaagtgaagtggggttcagccaacaagactcaagcttaaagttttgcaattaatgccttctctttttaacccttgcaatgtatctctgacaatgttatatccttaacgggagatcaagccaaaaacctaactgcaaggtcctttgtgataggaggccagggaaaatggccttccagacctccttggagaggcctgccttggaagagaccaccttagagggaggtggagaaagacagtctctgccttccttcccttccgccttccttctttccttccaatactcagtgtactgcgtatgggctcatatacgcacacagaggataagtgagtgagtttgcttatgtgcatgggacctgaagaggtgtgtgtgtgagtgtgcagactggatctgctgttaaacagcatcttggccttggcgagccacttcttccttccagtcctcagtttttgcaaatggtggggtctggagttgattggtggatttcaagccatttttagcaaagaaacgtgtcccctgcccctcaacaaatgaatgcttcggctaaacctcaatatatataataggtttttttaaagagagctgctgaggttggcacagggatgggttgagggtaccccagggccatctcctcagtctcctccccacaggggtatgtcacagaaatgaaagcagagttggaaaaccactaggttataggatctttaaggacctttctggatttaaccaggacgctaaggttcatacatcctaacatccctctcatgaagacactgatgattttctcatgctgtgaatgggaggactgagggccagagtggttaagggtcttctctgacaagccccaggactcctgactcggagtccagtgtgctttctttctttctttttttttttttgagaaagagttttgctcttgttgcccaggctggagtgcattggtgcaatctcggctcactgcaacctcctcctcctgggttcaagcgattctcctgcctcagcctcccaagtagctgagattacaggtgtccaacaccacaccctgctaattttttgtatttagtagagatggggtttctccatgttggtcaggctgatctcgaactcctgacctgaagtgatccacccgccttggcctcccaaagtgctgggattacaggcttgtatgccactgtcccaccagccccaatgtgccttttttttttttttttttttttttgagatggagtctcactctgtcacccaggctggagtgcagtggtgcaatctcggctcactgcaaactccgcctcccgggttcacgccattctcctgcctcagcctcccaagtagctgggattacaggcacccgccaccacgcctggctaattttttgtatttttagtagagacagggtttcaccgtgttagccaggatggtctcgatctcctgacctcatgatctgcccaccttggcctcccaaagtgctggattacaggtgtgagccaccgcacctggccaccaatgtgctttctaccagcatgtcccccgccctcttcagagcaggctcaacacatcgagtggctaagccaatggccagggaatccagagcctcaagcccttgttattcccttacctgctgggtacaggcaaacaaggagatgcttccacagctccctgagctctgcccatcttccctagagctctagttctgcccaactctggcttcaaaaacatgacaactagttactgagggcccaaggataatgaccttatgtgtcttctccctgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagcaagctggagaacctgctgctcctggatctccagcacaacaggctgagcgacggcgtcttcaagcccgacaccttccatggcctcaagaacctcatgcagctcaacctggcccacaacatcctgagaaagatgccgcccagggtccccaccgccattcaccagctctacctggacagtaacaagattgagaccatccctaacggatacttcaagagctttcccaatcttgccttcattcggcttaactacaacaagctgacagacaggggactccccaagaactcctttaatatctccaacctgcttgtgctccacctgtcccacaacaggatcagcagtgtgcccgccatcaacaacaggctggaacacctgtacctcaacaacaatagcatcgagagtgagtggggtgggccggggcggggccgaaggcaaggaggttggcttgtgtagcacttccaccctctctagggagactcagggtggggtggtataaaaagcatccactttggcactggacttcaattcatggccttgccacttgctatctgggtgaccttgaaaagatatttgaccagtctgggaagtttcctcatctgtaaagtgagaatggtaacaatatcttctatcacaaaggtgatatgaggatgtaatagtttaatatggagaaagtgcccagaataccatacttggagggtcataggttttcttcctccattcttcctcagccccagttccttggcaactggatctataggtagggtagacatggaatatactcctggacattctgctaaaaacagaacagagacatttaaatacctatcctgaaatgtcctgggtctgccctctgcagaaacctgcccctgtgggaagatgcttcttcccaagcctgagcctgggttttgattcagggtatgcaactggtaaaaatgtggcagtcaggaaaagaaggtctgcatgctggtgctttctgaatctatctggaagggtgcgatgtttaggtgcacttaaggaagagtttgcctaagtgacatttacagggttctggacttggagtatcaattgcagcccaggagaggaggctggaagttgcagttttgcttcaatcaaaaatttcagctcggagcagagcattagcagaaaggtttagaagtgaaataatattttctggtccttgaacaaaatcagcctacattcacagaagggatgcagcagcagaagggaagagagggattgagggaaaagagaaggacccctagaatgatatttggggatccttaggttccaaaccaaagaatgagatggagattgttggtgtctctaccgacaccaacaatgggcgaatagatcgttcactcatttgggataatttcaagaagtaggggaggattttttttttaatcttacaaaaaaaaaatgggaaaaggggaagactgtataattttaccctggagacagcacactaaaataaaacacattacccccaggaagctatgaggccaaaatacagacagaagggataccttgattaataaatggctgataggtctctaccagattgtggaagaacaggttgctggaggatatcccaaccttctaaggttgaagtcagagaactcacacctcacccacatgagcccaccccatccagcctgtctcctgtgccttttacccgacagaatgggctgagtggggcctaggtcagtggggtgattacgttcttcacaatgaccataatgctgccactggtactgtctttaaacagcttacaaaatgcctttgccaacattctctcccctgattacagggcaggcaccactcttaccatttcacagattgaagaactcagcatgagggtggctaggccacagccccaagctcataagagaaaacccccgtgtcagggcccttctgctactccaatggcaaagaagaaagacgaggaaaaggaagaggaagacaattacaatgaagatgatgcctactcttcctcctcctgctcctccataaatgataagtgaggcaaggcttagggagaataaaacagttcatttaaatgctggcatgcctggtgccacaggcatccaacaagatgtgatggaggaaatggaatctcaggccatggacccttcagaatcagtaggctcatcatgtcccgggggttccggagctctccccagatcctctttcctcttcctgtcatccttatttcagttaccatcttttgcccatcctcatgtctcacatccaattcaaaggaaaacctgcagagtaattttcacatccacctactggcttcagatctcaccttactccattgcttctccacagtgtagccggattatctttgtacagcataaacctgaacatagggatctctaaggacccttccagatttaacgctccaggataccatggttcaagtatcctgttaataacatcgctctcacaaagacagtcctgttcactgccattcctcagaccagagatcaaaagcctcttagtgaaagcctaactaccttcccagcttactctccttagtacatcacattgggcactattactattcccagattcgcccacaagcagaattttggcctccacaacttcattcaaacagattcctctatcagaacaccatcccccaggtctccacctgttgtaattctacctattcttgaaggcccagttcaaaatttacttccaattctctagagttaacttgcaataacagttgttgatcaattccaacttaattcattttacaaatgagtaaactgagcctggaggtcaaggcagctcatctatgatcacacattcccaaagctagccagtttcagagagaagtctacagtccttgctctcgggtgtcttcccccttccccttcctcatcttggccgccagcctccactcccttctgatttctcgtcttctttttccgtagaaatcaacggaacccagatttgccccaacgacctagtggcgttccatgacttctcctcggacctggagaacgtgccacacctgcgctacctgcggctggatggaaactacttgaagccgcccatcccgctggacctcatgatgtgcttccgcctcctgcagtccgtggtcatctaggccctactccgccaccggatctgctctgaccgcacttgaaggctggggcccaggcacctgtgccggccattcgttttctctctctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagccatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagcccc

SEQ ID NO: 13822 - DNA, 27270 bp, Human
ttgagcccaggagtttgagaccccatctctactaaaaatacaaaaaaactagctgggcgtgatggtacgagcctgtggtcccagctactcaaaaggctgatgtgggaggatctcctgagcctgggaggccaaggctgcagtgaactgtgatgatgccactgaactccaacctgggtggcaagagagccaggccctgtctcaaaataaataaataaaaatttaaaaatgaagagacagagaaagagcaagcccagagcagagagcactgcagtaggtcaaggctgggttcagacactctctgcgcacagactgggaaagttaccatctactcttgtggcctcagtttcctcatctgtaaaatggggggtcaacaacatgccactttgcaaggtgatgatgtaagtgaagaacagggcatcactgggcatttgaggctacggcacaggctggtctgaatcaccctctcctcacccaaagcagtgacagcaccggcctcctcagcctggaacgcacgttcttctgtctgtctcacacccagacccttacataccatcttctttagctttgcaaactacagagaatggccctacagctcttaatgtagcttcctcagcagaaagactaaaatgtctgttgagggggcaaaacaattcacaaggaggtcgtctagcttcttcagttgtaagtccactccaagcaaaagggaagccagggaaatgtggttaaccagggcagggagacgtggggagtgtgggggaaagtctgaggtggagacacacagggacatggggggtatgaggtggggacaggcagggagatgggggtgcaaggtggagacacgcagggacatgagggggtgtgaggtggggacaggcaggaagatgggaggtgcaaggcggggacaggcagggacataggggtgtgaggtggggaaatgcaggaagatggggggatgtgaggtggggactggcagggatatgggggtgtgaggtggggacaggcagagacatgggggtgtgaggtggggacaggcagggacataggggtatggtggggataggcagggagatggggggtgcgaggtggggacaggaagggacataaggctgtgaggtggagacaggcagggacatggggggtgtgaggtggggacaggcagggagatggggggtgcgaggtggggacaagcagggacatggggagtgcgaggtggggacaggcagggacgtggggcgtgcgaggtggggacaggcagggacataagggtgtgaggtggagacaggcagggacatggggagtctgaggtggggacaggcagggagatggggggtgtgagttggggacaggcagggagatgggggggtgcgaggtggggataagcagggacatgggggtgcgaggtggggacaggcagggacatgggggtgggaggtggggacaggcagggacatagggggtgggaggtgggcacattcagggagatgggggtgtgaggtgggagacaggcagggacatagggggagcgaggtggggacaggcagggagatggagggtgcaaggtgaagacaggcagggacatggtgtgaggtggggacaggaagggacatgaggggtgcgagttggggataggcagggagatgggggggtgcgaggtggggacacgcagggagatgggggacgtggggatggcgacaggctgggagagggagaggccaggctgagacctccccgcgcggtgccagccagtccaggcagatccaggactcagccaggcctgatacccagataagcccttcctcccagaggagataagggagcgacgcggccggccgacaggtgaactagagctggcgagttagtcggcgccgccccctcccgcgagcccggcctcgggggagtaccgcccaccccgccccgcgctcgctccgccccgcgctcgctccgccccttcgcgctcccgccgctcctccacgctcgtgccgccccccccccgcgctcccagttgacgctctgggccgccacctccgcggaccctgagcgcaagagccaagccgccagcgctgcgatgtgggccacgctgccgctgctctgcgccagggcctggctcctgggagtccccgtctgcggtgccgccgaactgtgcgtgaactccttaggtacgcagagggcgcgccgcccgagagggtgctagcaggccctagagtggacgctgggagaacttggccaggggcgcactgggctccggaggaacggggcagagctttccccggtgagaggccaggaactctgcgtgctggcacggggaggggtaaactgcattataggcgggggttctcggagggtgggcggcttgtaggaccagaggagcagatgggctgagtgtccagggtcccacctagccaggtggctctccagcctagaataccaaaggagcccgcagctccttccgccttcctcaactggggacacagagtgtcacacagaggactctgatctgtccctgccagaggtgagcaaggacgtcccagccttctctagcagcttcccccgggacttggcacacaggggatccccgtagtgtcttgggagtcccatctgtagagtaggttggacgggctgtttggaacagtgaatccctgtgcaacggcaccagggaaagcactcagaccaacagcgcttttaacagcaccccagggcccatggcgtcaggtggagccccaggactcctcttgttggccaggttggctgcgactggtccagcttcgtgctgcccttgcatcctgtctactgcccgggctcaggcacctcccctggctgaaggcaaggagcctgctcttccctactgcctccctcctttcctactgtccctggtcccagcctcagcccacaggctctgaacttaaagaccacctgcccccttcacagagaaaagtagccaagaaacaacccaaggagccaagaacctagggagggggggtgccctgagctctggaggaacgggacagggctttcccccagctagaggctcaggggatgggacagagatcactgaggctgaatctgggccagagggttgcctcattccttcccacctatttatttaaaaagctccccagccttgcaaacctcagtgggcgcccagctccaggtcagttcccgcctaaggaaaacctagctgccgcaagcgagggctgcctggagaaggctggcgctgagaggctgtctgaattccagagcagggcttggcaaactttttctgtgaaagaccagacggtaaataacttaggctttatggtggtctctgtagcaactactaactctgccatggtagtgtgatagcaaccatagattgtatgtaagtgagtcagtgtaactgggttctaataaatgatttttatggccactgaaatttcagtttcaagggatttttgggtgctacgaaatatgtttcttctaaccatttaaaattgtaagaaaccgtttgtagcccaggagctgtactaaaacaggagtcagggaccggctgcggtggctcacacctgtaatctcagcaatttgggagaccgaggcagtcggatcactttaggtcaggagttcgagagcagcctggccaacatggtgaaaccctgtctctactaaaaatacaaaaattagctgggtgtggtagccaggtgcctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattggaatggatctattttagggtaaggcacggttcaccagcagattattctggccccagaataatctctccggaggcaaactggtagtcaattgtcctaaactcaaaccctgcctccaactcttgtcctgagttgaggtctgtcttcctctaaagccctcagctgcagcagggcccttaatcaagatctggaatcccctgaaaccctaaagggagccatgttgaggaaatgtgcattttccccagggaaaacggccatagattggtctctggaacaggttcgagacccaaaaacggagatctaaatgctgtgtggtagtgatcttcacactggaggtatggatccttggggaaacacgaagatatttcaagtgatgccggcagagagtgttctggaaatccatttacagaccttttatttccaagtgtcctctttgctaaaactgggagagagcccctgaaggcaagggggaacctctttcctctcattcaatctgaacctgaacccatgggtataaaaacaatagggacagcaaacaaaaagacaaaacggtaataaatcgttcatatctggcattctcaattcctcaaggaaactgaattgaagaggagaggacttcatggggatatcaactgatgaggtcttaaaaataatgttgagtgaggccaggcgtgggggctcacgcctgtgatcccagcactttggtaggccaaggtgggtggatcacctgaggtcagaagtttcagaccagattggctaacatggtgaaaccccatctctactaaaaatataaaaattagccgggcgtggtggtgggcacctgtaatcccagctacttgggaggctgagatagaattgcttgaaccagggaggtggaggttgcagtgagctgatatcgtgccactgccctccagcctgggcaacagagccagactccttctcaaaaaaaaaaaaaaaaaagaaggaaagaaagggagggagggagggctgagtgatagagcaccatgggattggatgcacagaaaggagtgcgaagaattaagtggcattgctcttaaaaactgcctccattcccagctgcttatttgagcagggtttcccagccctttgacctataagaaacaaaaataagagcagaaataatgctgaaccttttctcaaccaaacaatattcactcatgaaaatataaatccattgcgggggatgggcagtagagtactgtttatcacattaagagatgcatttctgatacaattttacttttgatgtttaacaattacttttcataatgtataatacatttgaaatgttttaatcagttgggacactaataataattatgattactcaatccagaataaatttttttttttttttttgagacggagtctcgctctgtcgcccaggctggagtgcagtggcgtgatctcggctcactgcaagccccgcctcccgggttcacgccattctcctgcctcagcctcctgagtagctgggactgcaggcgcccgccaccacgcccggctaatttgttttttgtatttttagtagagttggggtttcaccgtgttagccaggatggtctcgatcttctgaactcgtgatccgcccgtctcagcctctcaaagtgctgggattacaggcatgagccaccgcgcccagctccagaataaatttttataatattcacagatgtatgggtcacaggtagtaaaaacatttaatttttttttttttttttttttttttttagacagagtctcgctttgtcgcccaggctggagtgcagtggcacgatcttggctactgcaacctctgcctcccaggttcaagcaattcttctgcctcagcctcccaagtagctgggactacaggtgcatgccaccacgcctggcttatttttgtatttttagtagagatgaggtttcaccatgttggccaggctggtctcaaactcctgacctcatgatccacctgcctcagcctcccaaagtgctgggattacaggcatgagccacggcgcccagccaaaataaataatttaaatttaaactttttgttgttgttgcagaaaagaatgtgaaggtgatcaagcataaaaatgtatgttcccttaggataaaattctgccaggtggggatggagataggtgttcaacaagaaaaagaaactctgtataatatctgactcttttttgttttgttttctttatttgagatggagtttcgctcttgtcacccaggctggggtgcagtggcacaatctcggctcacagcagcctccgcctctcaggttcaagcgatcctcctgcctcagcctcctgagtagctgggattacaggcgcctgccaccatgcccagctaatttttgtatttttagtggagctggggttttgccatgttggccaagttggtcatgagctcctgacctcaggtgatctgcccaccttggcctcccaaagtgctgggattacaggcgtgagccaccacaccccgcctaaatacctgactcttatagaaaagtttgttcatgttactgatggtggatatcaaatcatcatggtatttagattccactggctagctttaaaagaatgatataacaatcttatttttagagatttttttttttttttgagacaaggtctcactcctgtcacccaggcaggaatgcagtggcgctatcatagctcattgcagcctcaacctcccaggctcaagtgattctcccgtctaattttttttatttttttgtagagacgaggtctcactttgttgcccagactggtcccaaactcctaggctcaagggattcgcctgtgtcagcctcccaaagtactgagattataggcttgggccacactgccaggtgttatttttaaatctcaatatttataagttggaatatgtctttggaggtattcaaatttaaaatgaaatgtttagataagaacatacatggggaaatacggcaggaatccaaaaacaaatggctggcctgcttttgtaaaatattttgtcttgtttgttttattatgtttttgataatatctgtacatatttgggggtacatgtgaggtttcgtttttgtgaagtcttgcgggaacgcagtcctacccattaatgttcacagtctctgtggctgtctctgagccgcaggggcagagttgagtagttgtggcagagaccatatagacggcaaagcctgaaatatttactacctgtccccataaggaaaaacagtgcttgcccttggaatagataggtttgttttttgttgttgttgtttttgagacggagtctctctctgtcgcccaggctggagtgcagtggcacgatctcggctcactgcaacctccgcctcccgggttcaagcgattctcctcagcctcccgagtagctgggattacaggcacacaccaccatacccagctgatttttatatttttgtggagacagggtttcgccatgttggccaagctggtcttgaacccctgacctcaggcaatcggcccacctcggcctcccaaagtgctgggattacaggcatgagccaccgcgcccagctggagtagatagctttttaaattaacttcttaccgaaatataacttcatacagaaaggggcacaaatcattgagtatgcatttccacgaattttctcaatctaaacacactcagttaaccagcgcccagttgaagaaacaggatatgagcagcatcccggaagtgctttctgcaccccgacccagtaggcataaccaccatcctgactttcaacaccattgactaatagtatatactttttcacattaatttggggtacaaaaccaggaagagtcggagtttctttttgcattctgcattatataacaccatttttggtgttttaaatttagtccagttttcgaaaatgcaaatcagttctaaagtgccctactttgctatagactcaacattactgtgatgcgcccagacctaattttttttttctttttacagagaagtttcacttcaagtcatggatgtctaaggtcagtgcccaacttcttctttttgaagtttttcatttcacaaagtttcctgttatcaaaccaaactgtcccagatttgagacaatgaaaaagggaatttccaactttgcctagtggggtctttccagaagttgaactggccaaacactgggaaagatgcagttaagtaaattccttccaaatagtggtcccaagtgattaacttggctgacagccttccaagccctgggattcatttctgtattttgttttcaaagcacattgtggagaatgtaaattagtacaaccattgtaaaaaaacagtatggaggttccatcaaaaactcaaaacaaaactaccatatgacccagcaagcctactactgagtatatatccaaaagaaaggaaattagtatattggagggatatctgcaccctcatgtttattgcagaactagtcacaatagccaagatatggaatcaacctaagtgcctatcaatgggtaaagcaaatgtggtgtatgtacacaacggaatattattcagccataacaaagaatgaaattctgtcatttgcagcaacatggatggaactggaggtcattatgtttagtgaaataagccaagcatagaaaggcaaatattacatgttctcactcgtatgtgggagataaaaaagtggatctgatgaagaaagacagtagaatggtgactagcagaagctaggaagggcagggaagcagggatgaagataaactgattcctgagtacaaaatattttttttttttttgagacagagtctcactttgtcacccaggctgaagtgcagtggcacactctcggctcactgcaacctccaccttctgggttcaagcgattctcatgcctcagcctcctgagtagctgggattacaagtgtctgccaccatgcccggctaatttttgtatttttagtagagatgggggttcgccatgttggccaggtgggtcttgaactcctgacctcaggtgatccacccgcctcagcctcccaaagtgctgggattacaggcgtgagccactgcacctggcccaaaaataattagaagaaatgagaccaagtgttcaaaaaacaagtagattcaactgtagtaagcaatcattattttgtatttccaaatagctagtagagaataatttgaatgttcccagcataaagaaatttttaaagtaatggatctcccaatgaccttgatttgattattacacattatatgaatgtatcgaaatattacatttaccaaaaaaagtacatcagttatatatcaataaaaaattatacacatttgtttttagaaaaccaaagcacactgtgtactggttgcagaatcagttggggaacaccagtgcatgtgcttttgaaaaatggtgatctttgctgtaaacttgacccagcaccagcagtggcgtccaggagtgccccacatgtggcaggtttgttcaccagtgcctcttggaccacattctgactttcacgcagctgcatggtcttcattctggccacaggtccctgaaaacggggttgttttgtaacttcccaaatttctcagcagtaccccgcccattaacacagatttggcctgagaatcatagcagaaagaaaaccttcatctttcctcttaggaaaacaaaaaggtctccctctagggagctgcagcctgtttccatgacttgctactggcgtgttttgttttagcaccgtaagacctacagtacggaggagtaccaccacaggctgcagacgtttgccagcaactggaggaagataaacgcccacaacaatgggaaccacacatttaaaagtacgtggaacgccttccttccttcctggaaggatgtcagttagtgacccagcccatgaaagggcccgctgggggctggtgggtggagggagcagaagcccaggctctgaagctgtgtttggctgacctcagattgtggctccgctgttactctctgtgtaatgtgggatcgtaaatttgggacaaagccggtacccctctgggtggttgtgaagtttacaagagactctgtagaagcccctgccccattcctgccatctgagggtccagcctggaagccaaggtctgtctttggattgttgcggggggtaggggttgctcatgggctcagagcagcccctgggagcatctgccttcactccggattaatttcactagaaactcacataggccgggcgcggtggctcacgcctgtaattccagcactttgggaggccgagatgggtggatcacctgaggtcgggagttcaagaccagcctaaccaacatggagaaaccccatctctactaaaaatacaaaattagccgggcttggtggcgcatgtctgtaatcccagctatttgggaggctgaggcaggagaatcacttgatcccgggaggtggaggttgcggtgagccgagatagtgccattgcactccagcctgggcaacaagagtgaaactccatctcaaaaaaaaaaagaaactcacacgcacgtccagcgtattttctgaggactctgagaaatattggtagttgactaaattggtaataaaggcatcaagcatgagctggaaagaaacttgggcttgaacctcatttctgcccagtcctagcctgtgacctccagggatgctaacatgggcagtaaagaggaaatgagcccaggtgtggtggcccacacctataatccctaaagacagggtcaggagttcgagaccagcctggccaacatggcaaaaccccatctctactaaaaatacaaaacttagccgggcatggtggcaggtgcctgtagtctcagctactagggaagctgaggcaggagaatcgcttgaatccgggaggcagaggttgcagtgagccaagatcgcgtccctgcctccagcctgggtgacagagcgagactctgtctcaaaaaaaaaaaaaaaaaaaagaaaagaaaagaaaaagcagaaatgatcacgcatccctgctggggctgtgtagagaccaaattaggcagcaggtgggaaggcccctggcaccagtggagtggttctttacctagctatccatcagactcacgaggggagtatctaaaaaagtaagtgcccaggccccaccccagaccaactgcattagcatctctggagtacggcccggacatctataccattgaaaaagctccccaggtattttggcagcactgtaagggctgattgaattatctactgaattatattaaatacaaaaacttaaaggagatgggttgcagtggttctaaatacgacacaggtaaacaggaggtttcatcactttttcttgtttcttcattagtgattcactaaccatttctgttttggttttttccttctcttttgtagtggcactgaaccaattttcagacatgagctttgctgaaataaaacacaagtatctctggtcagagcctcaggtaggtataattcattgcaaccaaatctgaatccttttactgaaacctttggaataaatttggagcctgctctgcttctaggcagattcagtcccatccccagatgcagctgagggtatccccagattctttgggggaaccagaagagtcagctctcagcagttcctcagtccaggcccatggccttagcattgtggacccttaacttagggctaccagattaaaatatagatactcagttaaaaatgaatttcagatacacaacaagtaattctttagcataagtatattctaaatattgcacaggatatacttacactacaaagttatttgttgtttacctgaaattcaaatttaactaggtgagctgtatttttatttgctacatctgtctaccctatcctaatgctctggactctcaaggggacatgtcatttagcacttgggaccagtagacaggagagggaaggttctgagagctgcagcctttcttattctctcttggtgattccatgtttatacatttcttcttcttgttgtcagaaaggtttttggttttgtttattttcctgaaaataatgtgtttggttgttccagaattgctcagccaccaaaagtaactaccttcgaggtactggtccctacccaccttccgtggactggcggaaaaaaggaaattttgtctcacctgtgaaaaatcaggtatgcctggcaatctccatcctctccctgcaaaacggccacactcccagacaatacaccaggaagaacaactcaaaaggtccacaaaaccaccacaagcacatccctgcctctgtttcctctcggcatctctccagccctcttcctttgaggggccagggaggtcagcacttctctaggctgctctggaggatgcaaaagttcctctttattgggctaaagtttactcccttccttccccacgccccagattttcccattggtcccaggtctctcctacagagccatccaaaacgttatgttccctgtgcccatctggacaccagaaccccatgcatctcctcttcccgcctccatcttctccgagccaccagggtccagcccctgccctggctggccgcctccctctggttagtccatgtgtcatgcatcagcaagcttctcatggcaggggctggcctccgtggcccttgctgtggggcacagagggcttggcaaggtgagaggccctgccttcctccatgggggagcagtctgggggcatctcagcacaggccctgtcccagagagtctggaccctgcccccgctgttctcccggcctgctgcggcccctcccctagcagggaacctgccgtggccttcttcagaaggatgccgacctctggactctaggaaatatgaggtgaaggtttccttcctggaaactcctggctttccatcgaaattctccatgagaaatgttttttcactttccaaaaagccatccatgcagcacagctttaaagcctcccgggcttgcagtgttcctggagcctgccaagtgctggatgtttaactagcatcaggagccaaagcaaacctccccttgcagcaggaggtggagtagaagcctgcctttgccccgtgacatttttagaccctctgagaaccacatgacaattcagagcaacacgtaacctaaacctgcccaccacttggacaggtgggaaagagaggcccaccaagaattttccaagtcctcctgttaactgatcctgggccatcaggcaggacgcagccggctgggctaagggagcggaatgaggtgcttcctgacgcagatgtgtgccgtctcttactgtggccgctgtgtggggatagagacggacagcagccacagcgtccatcagctcagcaccctccttgagagtttctcactttacagagggagagcctgagagggagggtggtttgcctgaggtccaaggtaagtaagtgacaaaggggactcaaaaccaggcccctgccccaagtcgagcacccaagggtcagccgagctccgcctccttcagcagtgagcttagtctcccccgaagtggccacgtctgcctcgttgactgtctcatggaccctctcaccaggccgtccctccctcccccagctgagagagatatgtgaagggaagagattgggtgaggccagtgtcaacctagggtgatgacctgggaggcaggtaggggacttaagagacatttcagaagtagaagctggaagactgaaccagcaaggtgaggaaacagagatgaacctgagagaaatccttacagcagccaccagcattgtgcccacgggggtgactgcctgaccagcagaatctgacttaaccctgctagcgccctgcaagcaggaaccctcgccattcccactttacaagcaatgaagccaaggcttcgagaggggaagtgacttgcccaggtcacccacctggtgtgtggcagagctgggatgtgaaccaggcaggcaggctgcagccccccacacctaatcctcatgttattctggaggtgttgtgaataagggggctaggcagcggcaatgaactgttagaaggtggggaaatgggtggatggggcgggtcccccagagtctggggtgtcaggggtgtctgggtggggttgtctggcagttagttggatgtctgagcctaagtggaggtcagcactgggctagggtttggggagctgttagtttaacaggactgggcagaagagactggaggtggaaaggtgagagaaggttctaaaaacagaactttggggcatccttctgcagggaaccagtagggaaaagaggagccagtgaagatcgagaaggaagagagccagaagactgcagaatggggtgggggactccaggccctggcagaatggtggggattggccaccaagaggtggtgattgggagtccacaggcactggtcagaggccacctgctgctcctgctcctttgcaagcctctcaggacttgcgaggctcagaatgaatggatctggaacagggcttgcgagcctcagaatgaatggatctggaacagggcctgcgaggctcagaatgaatggatctggaacagggcttggtaaactgccaaggcacctggggactcgggagctctggcagggtcagcagaggaaggcagaaggcagggctgtctcacggcgtccccatcactgatgtcctctgctctcccctggcctttccagggtgcctgcggcagttgctggactttctccaccactggggccctggagtctgcgatcgccatcgcaaccggaaagatgctgtccttggtaagaaatcagccacaggcgaccccctgcggaggacaccccatcctgatgtgggccaggcctgggcctttggtttccctggagcattggctaagggtgctgtttcaggtggacccagatgccccagccttgtggacatctggcatgagaatctcaattgatgcttttcccgggaaggatctgagtttattaaggaaccggcccaagggctcattcctagatggatctgggtggtccttagcttgacagcctggagccttcccggcggaggggttcagaaaggcggagcctgcctggtgggtagccaactaggagctacacccttcccagcagcctcagttgtcttcatgagggaagagccgggacctatgcatccatcccctcgcccacaagagacggatgatgcccctgaaggaactatcctagcccctgcctctgtggagaaaggagggacagtgcacagccggcctggtgatgccatgaggaccctgggttgtggacaggtgggggtagggtctctggctgggcctgtttcccccatcctatacaccgctgtgggaccccacactctgcatcgtatgggcacacctacggggcaggggtttggacccaacagcccttgccccctctcaccttccctggctgcccctgcttactgagcccctcccgacatgtgccagctgctgggctggcactgcaggacatacagcaactgtccctgcccttggggagtttataatttggtcaccttgacacagcactgacggggcctcagatgtggctcagccagggaggcttagcgcctcacgccaaagccttgacggcttctcagctggcaggtcactgggttgtgtccttcttccaggcggaacagcagctggtggactgcgcccaggacttcaataatcacggctgccaagggtacgtctctgaccagaaggggcccaaaacttcctcatttcccactgaccgcttcgacaggatccagtgtgtgctgggtctgccacagatataacccaccactgccctgggtgatggcaaaatggtctctgttgtacaggggtggtcacctcacatggccaggtctcatagccaggacagggcagagctggaatctgagtccaggcctctgtcctctctccactgtatcacctggctctccacagtgcggttggcctcacccgccaccaaggcctctgggagtgtggccaaaagaatttaatagagtgagcaacacaccattacacatcatcctccaaacccgagatccacacacagatacagggttggcctttagatgaactcactaaagtcccagcctcccaagctcattgcgccctgtgagggtgaggtggctgtgtgtaagggctgtaccttgcctggacctgctttcctggcccactgtaaagcaggttgccaggaatttgctgacatttctacagtgactctagccctcccttcatgcagtgctctgagacatttctgtggtctttgctcacctggcacatggtgtgcataaagccaggctcttggggtgccgtgcctcgactcccctccacctccctggggcacatccctctcccagaccccagcccctctgagctggctcttcctcctgcagggagccgtgctgcagccaagtcctggggacccaggggtgacgtcgtagcctgctctcagatccaccatcatgctcagtgtccccttacttttggtctgtttccactccacagcttagaaacccaacccataacaagagtctgacatttgggcactctggggtcccaccgtttttatttttttttatttatttatttatttatttatttattttttctttttttgagatggagtctcgctctgttgcccaggctggagtgcagtggcgcgatctcagctcactgcaagctccgcctcccgggttcaccccattctcctgcctcagcctcccagggagctgggattacaggcgtgcgccaccacacctggctaatttttgtatttttagtagagatgggggtttcaccatgttggccaggctagtctcgaacccctgacctcaggtgatccacccaccttggcctcccaaagtgctgggattacaggtgtgagccaccacatccagcctgtttttcaaaggagtctatttgctttggttcaggacagtacttccttttctcattcatacaacaaatatcacagagcacccgctgtgtgtaggccctggggatacagcgctcagcagaactggaagagcgggcattctggcaggctcagagagaccacagtcaaggctagactaggtcaggcggtgcggaatgctatggagagaaacagagaagggacggggattgctgggcagctgctgagtttttgtttattctgggaggccacatgatgtagaaaagacccacttttggaaccacttcccagctttagctgtgtggccctggccaggttattcagcctctttgcctcagccagtgacagcatccaccacacagggtcgacacgaggggtcagggagtcatgcctgggaagcacctgcccaggggctcggctgtggcgatgacagtgctctgggctgatgctgttgaccatggtgtggggctgtgcactcctgacagagcggctggccttaaggggtctctatcccactgaggcatgtttgggctggtccttggactccggtggcctcatctgagtttgctgagtcttatcccaaggctgggcctctcagagaccccctctgccactgggacatgcccaaccaagtccccagcctgccaggccagatatctcgccacgccagtccccgaggccccgcctctatcaggacagccccaggtgggctcacctgtgtgtacttcttgcaggggtctccccagccaggctttcgagtatatcctgtacaacaaggggatcatgggtgaagacacctacccctaccagggcaaggtaactccaacagcctccactctgtcttcttggcgtacagcatgcctagcttcactccctccccagccttggaagacatcccttctccccccacctccctcccgccggaattctcacaattgtctgttctctccaaattcttccttcccctcctccacccacctgagcccactgctctcaccagtccaggggcctctttatcattctcaccccatacccgctctgcggcaccatctctttccttcccgagccagacttctcaggacccctccttccccccacctgccccatcttcctggctcctctccctcctgccacgagcgccatcctctcgcctctgtccatgcagttggcctcttgtgccaaggaccctttgggggcccacccccacccctaccctatcaaggctgctgggcctcccaccatcacctccgcccagcctggccacagccaagtgccttgtctttccccaagacctgttgctcctcctttatttcccctcgtggtgatgagcagcactggcctccctcagaatttcccaggtgtccacagtcctgttgggccggtccccctctccaccccaccctgccgccagcctgctgaccaccacagacctcacatgactcccttggcccatctgtgtcgctgaccactcagaccggggcctccatccagacccctgagggtggcctcccccaggcctctcaaacccagctcagaccccacgcctgcctcgatcagaatgccgccgaggctccatgcggccttcgggagaaagcccagactccaactcagtctccctgtctcttttactctcccttctttttttttttttttttttttttttgagacggagtcttgctctgttgcccaggctggagtgcaatggcgcaatctcggctcactgcaacctccgcctcccgagttcaagcagttatctgcctcagcctcctgagtagctgggagtacaggcacccgccaccacgcccagctaactttttatatttttagtagagacagggtttcaccatcttggccagactggtattgaactcctggcctcgtgatctaccgcctcggcctcccaaagtgctgtgattacaggcgtgagccaccgtgcccggccaactctcccttcttaacctcacgcccaggcccagccacatgttggttcctaaatgccaggtcctaccctccctctagttctgtcccttgtcctgctgccttctctcctgccttgaaagggctgcgcttccctccttgtgaccttacccctgcacctgcctcttgccagcattgttttttgggctgagactgtccccactcccctgcctcacaggctctgactcggcctccacttctcagtgagtttcctcaggccgggtgaggcccctcctcaggctcccaccacacaccatgtgtgcccacctctgccaaagccagcacaggaccatctgctaccagaccctaagctccttgaggacaaggatgctttaattctctctgaaattatcccatcccccaggccctggcacatcttgttttgtttagtaaatgttattgaactgcgtggggaggctgagacttcgggtccataacctgtatttcatgccctttgcatcctcaacaggatggttattgcaagttccaacctggaaaggccatcggctttgtcaaggatgtagccaacatcacaatcgtgagtgccgatccccctctgggatggggaatgtgtcctgatgaggaggcctctctcatgctgtcggatagccagtgggcccagcaaggcagcccttctggcagcacatccctttgacgagttcatattatccctgggtctcagtcgctgtgatggtggcgaggcaggagatgggagggagagcgcaaactggcaggcaggccctctggttctgaactccagatccacacatgccttcattcttttggttctgttttcttgcttgtaaaatgcaagcaattgtccgcatcctgcagaagagggtatgagcacgtgcttgacacagcgtgtgtgaaactgaggagggtgagtgtgtgtcactcaggatgagccaggttctgttgcaataacaaccgtgcccaatctgcatggctgacaacagtcaaagggtgtgtggcactcctgcgcccatgcacagcttagggagggtggtgtgtgctccgtgtcattggcctcacgccaggactagagggaaagaaggtggtaaatgatgccctagctctaaagccaaaacaagccgcccagtcacagttgacctcaagtgaatagggaagtgtggtcttaccctgcttctcccagagagaactggaacgtgaatgaacgccttcgtgactgcagtgtgcatgcatgcaagtgtgggagggtgtgtgaggagtggaggaatatcgcttaggttgtgtgtgcgcccacgaatgtatgtacagttcacaaacgtgatgtctgtgtaatgacagcggctgccatttagttgaagcatgtgccaagctctcagcaataacatcttaacttgatggagtacttctaggtgctgtaccaaccctcaatacacactatcccctctagacccgaactggccctaggagatgagtatccttattacctcatttgacaggtgaggaaacgggggctccaagtggttaagtaatgtgcccaaggccacagagctaggaaatagatgctggatttgaactaagaatgtgtcattccagaaccagggctcattgccttgacaacatacagcgcaaatcctgtactcaggatgtcaccctcttcagaatgttgctgctgtcactcaagctggctgctctgggccatgatatcccaaggacaggtgaatttgggcctcaaaggtatccctttgcatggtccccaggagagcctcattggtgacacctgcagggccctgacgaccaggccagaactagcattcagccctcttgggcaggcccatggggtggaaatggtgccacctgcagaagtcatcgcccctgtgctgggctggcctctgtgccctccatgtctcagatatgccctgacctgttgggctcacaaggccttgtccacataccaggaaggagggcactcccttgccaggcacctgtttgcttttcacagctgggtctctgtccacccctctagggaggcaggactgagggaggctgggcgccccgtccctcctgcacttgctttccttcagtagggccctggcctcagcacaggtaacttcccccctcatttcagctcccagaggtctcttggttagtgcacttgaacccagccacccccaacccagaagctccaaaaagtgccaatgcctgggacccaccctgcagatactgttgtagttggtctgaggcacagcctggacttggggtttttttaaggttctgcatggggttctacctgctgctgtcacctggtctctgcagctctgttccaaagctgcagcctccaggaagccaccctgacttccccccacctaccttcccccttggaggggacaggttctactcagaagtcacacagccctcggatgggtcttctcgtttccaccgccatctgggacctacccgtccatggtttataacccctgtgttctagcagcaaagctttgtagactctgggtttatgggtgtaggggtgagagctgctggcccaggagaggacctcagggaatggatgtgaatgactgaatgagtaggtccacgctgtaccccgtggtccctatctcagagggtgcagggtttcctaggagcagagttggggagaggaacgagagatggccagacagacccagccagagacaggaagggagagaggccgcaggggagctgcttctggccatccatgctgctctgggcctctagcccctagcttgaggcaaaaggctgtactgtgaaaggagtggggaggtgacaggccatgtgtttctgtctcggtcctgtttccacagtatgacgaggaagcgatggtggaggctgtggccctctacaaccctgtgagctttgcctttgaggtgactcaggacttcatgatgtatagaacgggcatctactccaggtgagtcagggtcccaggagccaggagggacagtggggaggggcttggtgggcctcctcacaccccactcgtgggacttgggctcgtggcccagactcctgtgtgtcagacccttcatgacacctgccaggtgctgggcgttttgcacatccctcagttaatcctcacacagccccaagggccaggagccatggcctcttctcacagcaaaggagaggtggtcagaagggatacgacagacacaggccacctggctagtgagagctagggccaaaatttgagagctttgtgctccttaacagaagagttgcctccagtttaaaaaaaacccatgttcaggccaggcgtggtggctcatgcctgtactcccagcactttgggaggccgaggcaggtggatcacttgaggccaggagttcaagaccagcctggccaacatggcgaaaccccatctctactaaaaatacaaaaaaaaaaaaaaagccagcgtggtggtgcatgcctataatcccagctactcgggaggctgagacacaagaatggcttgaacctaggaggtggaagtagcactaagccaagatcgtgccactgcactccaaccttggtgacagagcaaagctctgtctcagaaaaaaaaaaaaaatacccatgtttaaagatttgaagacgtaaaatagggagaagagtagctgccctcacacactaggatcctgtgctggaggagtcaccccaggcttcttcagaaaaaccaagctttagcctctttactatggggtttctctcacccacaccttttcgcctgcctggtttgcagcctcatttccctcccttcatcagttgctgcccgttaacgtcactcactaatgtcactcacgtctgtgctctcctctccctccctgaggctctgccctggtcaccattgtccttggaccccctaaccccccacacactgttccagcttccactgggagctgtctgccttctgaaacactcctcttgccaacgccaacctttgaatacaccagtgtccctgctttcccagggtcctaccctgagggggaccctcatgatctggtcctccctctttttccacactcatctgccatcaaacccgtccccgccgttccaccctgcagcccccaccccagccacgcagaagggttcgcagttccatgggcgttccccgcctccacagggagccttccctgacccaccctgcccaccctcccccccccccccgctgggttggatcccccccacctcctgggggctctgtcgccctcccactgtcagagccctcaggccactgtagagaagcagcctctttgccaacctgctccctgccaaacagggcttccaagggacagttatgcatgctgcctggatcccggcacctggccctggcgcgagcctatggcccacttacacatcagctgaattcacacctgaccactgcagtttgttctcttgaatttcttggaatttccttatggaggctagttcacttttgtaaacagaaaaagttgtatttttgccataggtataaagtaatatttaataaatgcagtggcaacaaagcaaagctgtgttaaagtctgccagacactgttgcctacagaaggtgcagcaggaaggtggctctctccttgccaggaaagagggagtagaaagtgtcaggggtgagacacgggccagcaccatatggagattctcctgacagaagcagaagaaccaaaagaactgaaagggccgggtgcggtggctcacacctgcaatcccagcactttgggaggccgaggtgggtggatcacctgaggtcaggagctcgagaccaacctagccaacatgatgaaaccctgtctctacccaaaatacaaaaattagctgggtgtggtggtgcacgcctgtaatcaggctactcgggagtctgaggcaggagaatcgtttgaaccctggaggtgaaggttgcagtgagcagagattgcaccattgcactccagcctgggcaacagagtgagactccgtctcaaaagaaaaaaagaactgaaaggagttctctcacggagactaaatgtgattacatcaccaccttacatgcctccctggtccgctgtggggaacattgctctaaagcgctcaaagaggcgttgttggatgggactgtcattgcttttatccttcccatatgatcacctctttttgaattttgttttccagtacttcctgccataaaactccagataaagtaaaccatgcagtactggctgttgggtatggagaaaaaaatgggatcccttactggatcgtgaaaaactcttggggtccccagtggggaatgaacgggtaagcagctcccaggtcccacttctgggagggggatgttgctcaggcctggaggccctgggggcatcacttccacctcagagttacggcttccacagacgagctggtcagccaagccctaggccaggccagggggaaagggagcatgagaatgtagcctccacatttccaagcccccatttgcagccctcacagggccccaggtctttaggacgctgcagggagagcaggaggccagctggctcagaaggactgctaggaaaacagctcagaacttggaactctgctggcacgaaatcagtgtctgggagggtccgtctttgagaaatcaaagcaacaaatgtacccctgatcactgacagcccctccttccgggagaaaaggctggcatggggcggcctgggtgtatatgctgctgtgcctttgtcctgtcctcccagattccatgtccttgtctgaaaaggagagctttcctgttccctcgggctcctggtgataaaatagctgtgtgagggcccggccagggctaagagggggccctcggtaaattttcgggagaagtgggatatggatcattcatttggcagctaaggagagggaagaatgaattcttcacaaagtcaggtccgtgatttgccggtgatcaaataagccgaatgctactgttttatgaataaatttagagggtctcacccctgaagtcagctcttggtgagcagcaaaacattctagaaaggcctgtggtggggagaccgccggccgggcctcagctcctctttctgcccaggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagatggagcatgctggtcctgggccatgactcaaaccaggtctgtcctcgccactcagtctcccaggagggaggcatcagggggtgtccaggctctggctgggaggatggtgggggtgctggcggtattatccaccagatggggtatccaggatgaagagcaggcttaatttgagatcttgactatttgtcccaaacctgagtggagaggtggggaggaaggagaaaaacgggccaagctgcggcagaggcaggattcaaacccacaatgtcagcccagaagcctgtacttctctgtgtggcctccccagtctcagctgcctactcctactcagactctgccccccacctccacatgagactgcccaccccttcctcaccaaccccttatttatttcaaacgtgcccagatgctcctgtcgtttccacaccatcccttcccttatcttgccttttgagaaatcttgatctctgtttagagggcggccatgaagttgctgctgcttcctgaagcctccgggctctgggatgtctgtagaacaagctggagtccaccagctctttgtcctatggctcacagactttcttaatgataaaagctgtcatcttatttgggcttcctgaaaagctaaaggcttgagaatatttgaaaaatatatatgttcatgataaggcttatttagataatgcaaatatagtttaatttattagaaaattctagtaacataagaccacaactgtataagacaaaaaacaatcaccttgctaggcatggtggctcacgcctataatcccagcactttgggaggccgaggcaggtggatcacctgaggtcaggagtttgagactagcctggccaacatggtgaaaccccgtctctaataaaaatacaaaaaaaaaaatttagccaggagtggtagtgcacacctgtagtcccagctactcgggagggtgaggcaagagaatcgcttaagcctgggagatggaggttgcagtgagctgagatcatgccactgcactccagcctcaaaaaaaaaataataataataatagacttcattggatggaattctattctagatttaaaaaaaaactaacatgaaatgaaagcataatttctttttctttctttttttttttttttttttagatgtagtctcactctgtcacccaggctggagtgcagtggtgtgatctcagctcactgcaacctccacctccccagttcaagcgattctcctgcctcagcctcctgaatagctgggattacaggcatgcaccaccactcctggctaatttatgtatttttagtagagatggggtctcaccatgttggtcaagctggtctcgaactcctgacctcaagtgatcccaaagtgctgggattacaggagtgtgagcaaccgcacccagcctgaaagcataatttctgaatttgacaaagattctcaaatcaatggtcagttgtataaaaggattcccattgaagtcagtggtataaaaggattcccattgaagatacatggcaaataagtctaagggtaccattcttgcttacatctatctggaagatctggctgctgtgataaataaacccaattaatatttgcagacagcatgataatgtggctaaaaacattcaggagaatcaacaaaacttagaactaatgaaagagttctgaaagtggctggataccagaaaaaaaaatcaaaaactcagaaaaaatacactattttttgttactattgcaactttactattgcaacaaaaccagcagctaggaataaccaccaaaaagtcttatatgaagaaaattactaaattaataacactataaaggaagacttagataaatggagagccaccatattcttttgttgttgttgttgagacagagtctcacactgttgcccgggctggagtgcaatggcatgatcttggctcactgcaacctccgcctcccgggttcacgtgattctcctgcctcagccacccgag

SEQ ID NO: 13823 - DNA, 60003 bp, Human
  misc_feature (1)...(60003): n = A,T,C or G
ttgagggttggaagttcaagaagtttgctttttcctgaaaagactaaccgttttctttgcaacagaatcctattgactagatatgaatcattcccttggtatttgagtcaccaggtggaagatttggatacttgattgcagatgaccatatataggaaagtatgcaggtgctgggaggttctgggtcgctggaggcccctctggctactgatacgaaattgcatagcccaggccgaattctttccaaggatttgtgttcagcactgacagcaagaccctgccctccgggaaagatacatttactatgttcaccaacatcattttttaaaatgtaactaattaaaacgttactccatgaagataccacctttggttttcacgaagacggaaaacttcagactgaccagaaagggaatttttaaatgtaaagaaaaccagaatcttgttcccagaactatgtggttgtgtagagaaacctgtttagaaataaccgtagaggaggaagtaaaaggaaatgatgtaatccctttcaggaaaggatatattgaaattctgtttaagtcatttggccttcgctgtggagtaattctttacatcttaaaagttaaatgatagattagtaataattcttaataattttccagttctgctggatcaatgcatattaagtgtcagatttggtcaggtgtgggccaggcagcagattaaggcagaagcatgggggttaggttcatacctttagagtctagctgcctagatgcagtaggggtccactcactagctgtgtgactgtgggacattaccatacctctctgggctccagcttcttcatatgcaaaacgaagatgtaatacctaactcactggatgattgtgcggcttgtattaaatcattcatttaatcaataagttttttttttaaatatctaccgtgcaccagtgcacacagataagaagaatctccagccctgtgaaactgacctcgttcaatgctggcaacacccccttcttcactttttacagatgaggaaattgaggcccaaagaaattgtgtttagctttaagaggcaaaatgagaaccaataatgccttgttttcactgtacagatggtttgacttctgatttttagacttcagaatagtttatctggctgtaacccctcataagtcaaagagcatgtatttagagagatgcagtattagactctaactggagagttgactgccctaggctacagagagcctgaaaaaaccaaggtgaaatatttccagagactaatagtgtaatttcccattgaacttttctctgggggtgtcagggaatttttagaatattttgttcccaggaagggtgggagcaacttgcatttctaaatcaaccctggagatatgccagcatgtttgaataatatctatttaagaaaaatgtgtctggcttcccaatcaaagaactgtgcctttcacctctgcaccccaccaaggactggaccacctcctcaaagagcagatgtgtctttataacagactgtaggcttggagccttgtaaaatgtacatggagtttcacaatcaagcacaaggaatccaactgaaggcagctaaactttgtgttgatttggtgaggaggagtaaaatcctgtgtttttgttgttattgatccccgtagtggtagcctgtcagtaatcagcagagttctcctggactttaaataagtcaaaaattggcttttcaggaagtatatttgtaagcatcttaagtacaaagatttttttctgtctcttgtcttgaagtcctcacaggtctagcacagtcccttgcatatggtagatgctcagtaaatgtttgtttagcaaatgggatacccaatgtcagatatatgctcttcctgagaaggtttttctgtgaatgttgacatctgttttctggattcaagattaagggttggactaagattattgtgttctgaatcacatattgataccatttactaattgttttcttttaatagattagtgtgatctcagctcaaggcaaaggtgggatatcatggcatctatctgggtaagtaaaaattaagccttcacaacacagtaacatatatgagtcaaaccaaaacacagaaggtcaagatagcaaggaaaattttaggaaagtttttaagtttatctggcaaaattaacatgctagaaaagccagaggatgtcaaaaataataaaatatttttaaaaatgcattgtaaagttacatagttaaaataacttatgatgacaccaaggcggaaaggtcaaaatcagataataaatttagtatataatttgggaatttattatatgaaaaagatgacatatcagagaagaagagacggattattcaataaatgttaggaaaacttctagctgtttggggaaaaagtaaatctgtattcctttttctccttacaataaaataacttccatgtggataaaatacagaaatgaagaagatgaaatatgaatgggccgggtgtggtggctcacacctgtaatcctagcactttgggaggccgaggtgggtggatcacctaaagccaggagtttgagaccagcctggccaacatggtgaaaccgtgtctctactagaaatacaaaaatagcccggtgcgatggcagatgcctgtaatcccagctactcaggaggctgaggcaggagaatcgcctgaacctgggaggcagaggttgcagtgagctgagatcatgccactgcactccagcctgagagacagagtgagactccgtctcaaaaaaatagaaaaagagaaagaaatatgaatggattgaagaatattcttggagtggggaagatgcttacaactgtgacacaaaaccaaacgcctaaaagaaaaatattgatctattttaactacatacaagtttatcactatgacagccaacaatcccattggtagaggcagaagacagctcgcagggaaaaaatatttgcagcacattagacaaaagacttatttccttaacatacaaataacttgaataaattggtttaaaaaatgaacttgacagaaaaagttgtaagggacataaacaggacataaaaagaattataaatgtccaataacatcagaaggtgctacaaggttggacacagtggctcacacctataatcccagcattttgggaggccaagatgggaggatcatttgagcccagaagttcgagaccagcatgggtaatatggcaagacccagtctcttaaaaaaaaaaaaaaaaaactttaaaaattagctgaacgttgtggggtgtacccatggtcctagatacttgggaggctcaggtggtaagatcgcttaagcccaagaggtggaggctgcagtgagccatgttcataccactgtactccagcttgggtgacagagtgaaaccctatctattaaaaaaaaaaaaactcctgcatctcagaattgaaaaaaacataaatatcatgatgagaaacacttttctacttaagagattggtgaaggttaaaaaaaaaaagtaatgtagaggatgtggcaaggtgatatttttattctctgttcatgggagagtaaatttggtacacttttggatagtattttggcaatatctctcagtccttaaatgcacatgtcctttaaacccagtaattccacttgtgggtatgtatcttatagataaacttgcataaggttgaaaaaataggggcccaagtacatttgtttgtattaatgaaaacaaacatgcagacagcataaatgtccatcgatagggtaggaataagtaaattactcatttataacttacaggcatttttatgtgatcattaaaatgaatgggaaaaaagtggatcagctgtatgtgaattgacattaaaaaagtcccaagatgtaataatttaaaaaatcaacttatagagtaatatgtacagagggattctgtttaaaagaaagaacaaagaaaataaaaaatttacggaaagactattacatcaaaactttgtggaaaggtggaattgtgagaaaggaattttacttttcaatatatcaccttctgtactgtttgatttttttttttaatcatgagcatacattatattttataagtaaggtggagggcaagtttaaagaaaagcctgtgcagagatgtgaccatcccttggcctggcgtatggatggaaggtgtgctgttggaaggctttgtttggcccaagttactcccttctcactggctaggaggctaaactctcatctttcatctgaaatccctgctgcttttatgaacatatcatagaatcagatgaaaaaagcatctctccaaaatgctggtgttaaaaaaaaaagtcgccctctggccctcgcccatgagtaaattaacatggaattatttgggcaggctctcctgctgacaccttcaaaggcgtggcacatttctgaagggctaggagagacccaagtgcgtgtgatcaagggtgtattcatttcctattgcactatgacaaattatcataaatttagcaatttaaaacaacatccatttattatctcacagttctatatgttagaagcctgaaatgggtcacacagcactaaaatgaaggtgttgttgggactgcattcctttctggagactttgggaagaatcctcttccaagcccttttaggttgttggtagaatttagttccttgtagttgtcgaattgagttcttagtgcttgctggctgccagcagaagctgtctttggctcctggaggtctctgcctgtccttgtatgtggcccctgcatctcagaaccagcaatgatgcatcaaatcttacttatgcttggaatctctttggcttttctttctgggggatctcttttctgccattctcttctccctccagctgaagacatttctctgcttttaagggtgcgtgtgattaaattgggcccacctggataacacgggctaatccctgtgttttaaggtctggaaccttaattatgtttgcaaagtctctttcatcatgaaacacaatacattgacaattcccaaggattatggtgtatacattttaggaggctgttgttctgcctaccacaggggctaggagtatggctacatcagggatggtagcatttggcatcagatagcaggaaagaggtggggaggggccaaaaacaggaggctaacctgagcctggagggcaaacccacacgtggagaaagaggccctagccaaagaagggctcctactgtctctgggtttttctttcttttttttttttttcctgtttacctcctctccctcaattaaagaactaatacttatgagtggctcagagagcaaacattaggaacaactcagaactgctatggaaaacaagatagcaattctccaaaaaattaaaactagaactaccacatgctccagcaatcccatttctgggtatatatccaaaggaaatgaaagcaggatcttaaagaaaggtatctatacacccatgttcactgcagtactttttacaatagccaagaggtagaagcagcccagtttccattgacagaagaatgaataaacaaaatgcggtacacacacacaatggaatattattcagtcttttaaaaacacatgttgtgtgagaggaagaaaaccctgtcacatgctactatgtgggtgagccttgagcccagtatgttaagtgaaaaagccagtcccaaagagacaaaatactgtatgatttcattgataagaggtatccaaagcagtcaaattcataggaacagaaggagactggtcgttaggaatgaataaggaaagagaaaaagaggagttgtttaatgtgtagagtttcagtattgaaagatgaaaaagttctgaagatgtttcaaaacaatgtgaatattctaaccactactgaactatacacttagaaatggttaagatggtaaaaaccctcagatttccaattgtaaacattcttatcacaaagttttatgtgttctttttttctctctgccacacaaaaccacatacacactcaaacataaataagcaatcaagtcattgcatttctacaaaactgtatacgtgattatgtgtatgattaatttattacagtggtatgatcaagggagaagtcattagttgcaatttcaacgcattaccattgaagatgaaagaatggctggtttcttaggtcttttatattctatctaggagtgttgcaaccctaccattgtttcagatgaatcaacaatctatgttgcattagtatttcctttgtttgcaaattttgaatatctctgttcagacatatgttctaccacttcacccttgatgaaagggcctgatatcttattggtttgtactccttggacttagagtcccttgtcatatgttgcctgtaggtccacagcaagcactcaggaagcccacaaattagaatgtcttagaacgtgactttttattaagctaccacagcagtattttttctgcgtaccttctgttatacaatgctggctttcttaggtaaatactctgagctctttcctccttgatcaattcctaacttacatttacagaataataataaatgtaattcctattagtttgaactctcaaattagaatttttattatggtactagaatttttctttctttatttctttatttttttttgacagagcttcactgtcattcaggctggagtgcagtggtgcaatcacggcttgctgcagcctcaacctcctgggctcaagcgatcctactgcctcagtctcctgagtaggtgggaccacaggcatgcccccaccatgcccagctaatttttaaaatttttttatagagatgggaattcactgtgttgcccaggctggtcttgaactcctgagctcagctgatccacccacattggccttcggaagtgttgggattacaggtgtgagccaccacacccagtggtgctaaaatttttttaaattaactcacaatcattgtaatcaccatgaactgttagtaacatcctaacttgggatacattctcctttcaccactccaaactctaatttacaaaatgaggaaagggaatatagagctactctgcaaccaagggataagagaagttttataaaaatatattacctaaatacaatgcctactaactttgttttgaagttcatccaaaacagttaaacaattaaagcagcaagtacctagtgcgacaggctctgctgggagcagaatgaagacagtctaaccaaaattgtaactctccctttcagaactccctaatcatttaaaaggtaggctcttgagcaaattgcttagtctttctctacttcagtttcctcatctataaaacaggtagggtaatagtgcttatctcatctacggtttgtaagcattaagccagttcatgtaaaatgtattagcagtgcctggcatggagtgagcactcaataaatgttagttttaatcagcatgatttcaatatattaattttattctaaaatgtatttcttgccaaataatatcgctgcaactgtttttgtagaggggcttctgcctatttcctgggcctgattttattacacatcaatagccccctctccccattggaatggttctttcagccatctaaaagagatgtcatgtcctcaatcagattccttctgaccactcttgttttcaatattttataatattttaaacacatatatatttctaaagacataaaatactccctttccactcctagtgggcatactggaatacagttctgacactaactacccagcattagcatcagattccacaggattaagggttcagtcctctgcaaaactgccctcacttcagatgtcagttcaagtgtcgggaatcacctgcacttctggccaactggctataaatttaggagttttcatgaccctctgaaattaaagaattccctagaatgattcacagaactcactgaaagtgctatccttatgaatgcaagtttattatgagggatacccatgggcaagctctggaagggtcctggacccagagcctccatgccctctccctgtggcatcagggcacctcaccctcctttgtgtcagtgtgttcaataaccaggaagctcctctgagcctcagtgtccagaattgtaattggagttccattatgtagacacgaatgattgattaaattatttgttacatgattgaactcaatctccagcccctctttcctcctcagaggtctggctgaccagagttgcaaccctgtgatcacagggctaatctttctggagaccagccatcattctaaggctatctaagggtctaccatgagtcaccccaattgcatcacaaagtcactcctatcactcaggaaattccaagggtttttgaagctctatgccaagaaccagtgcaaagaccagatacattcctaattatactacacatctataactcacattaaggcacacagtttccaatatatattcttttatttttgactaacattatattaaaaataaataaagttatattaataccaatggccctggctatttatgttgatcagaagctctgattgttagatgtatttttcatatatgggaaaaataggaaaatgaattaatgtttggtaataaatatagattagcaaggcagaatcattcaaaacatgggatccatatagaagataccgaaaaagggatccgcggtggtagaaatgttgggaaaggctgccaggatggacccttgcagataggaaaagctaatctatgatcaagtgttcatggtgagagaaggcacagccccccttccctcccgaacccttcctctctggtgggaacaagattggtgcagtttgacatatgaggacacagtcatctcatttccactgttaacccagaggaatggcagtagtggtagaggctcttaggaaaggtgcaatgtgctaacatgagagagaaatttgggaagataatgcctttcaaattctgtcccatagaagacaccagccctgggcatttggatgctgttgttcctgggttcaaagagtttgtgagtgtcctgtccagtttcatactccttgctttgacacagacatcccattagacctttctttcctgatgtgattgctcttctttgctatgcaaatttaaaacgtgtgaggagaaagctgtgttcatgcatgtgaatatgctgaactcctcctctggtctccctcacatctaccacatccaggaatggaagatcaagcttggtgactattttcactgaaagagacttttcacatcccaagcagaacaggcatctttcctggttaggtgctgttcaagtctgctgtgtgttttaaaccatgttccctgaagctgctttaggtaaatattggcattcagacaggtacacaaatggtcttttgcagaaagttgatttaaaacaggttagacctggatttcaaatcaaaacatttaagctttgttttgggacaaagcctggaaagtttctcatctgagtgagaacagagaggcttcctaggaatgagtggaatgaacactaaaaagctgttctttgccattctctgatgttagcccaactgtgaaggagggagggtccctcttttatatttaatcatgataaaactatagtatgcaaagctaatgtttaaccattggaaaagcctggtaaatcagaggtaaagaggaaaataaaaagctctagatcagaggaaggaatgtaaagtggagaaggtatgatttgttctcttgaaagtctatttttttggtggatgtaaagcagttagaaaaaaaagaagtatatagagtactgagcaataaaatgaatacacaggtctcacgtgaattataagagaataaatcaaaagaggagaaaattctcaagtctatcccttcattatcagatctttatttctttcatttgtaactctttgtgtttgattcagtacctcacgtaggttctggaggcatgtttaaataggagtagtgacagtcccatgtgaacagggtttaagaaaggtgaagattgcatttgtagaatttttaccatatggcatggagctctgaaaagtctgacaccggcatttgagaattattgaaagaaacaggatgcagaacaagaaagcatttttaattcatttattcactcaactaatatttactaactatcttttatatgccagatattggctctggcaacacagcagagaaagagaaataaaaaggatggcacctacattttattagggaagacagacaataaatgaagaaataaatgtacagtataaaaagacagttttaagtgctctggggaaaagtaaaggtggataataaatatgatggggggtgtgattttctgctcagatataggaggagaagtcaacgtggcatgagatggtgagctgagggaatatctcgggaaagagcagccaggcagacggaatgataagtgtaagccctgaggcagatgggcaagacacatttgaatgcaacaggaagattcccacgaagcaaaaacagggatacaagattacaaggggattgggggaggtattacaattctcttttatggtactttattatcctccaagggccacagagagtcccaagaagtcttcacatggactgttcaaggagtttccattctctaggtttactttacattaggaagcattcttaaatttgctgcaacttcttgttgggattatcgctttttaaaaaaactcataaataacccataaaataatgcatttaccatcatgtccagtagacatcatttaccttggccatttatgtaagaagtattctgcccagaatattacaaacaggagacatccctgatcccagtccctcacaggtttctcatcctcataggagtgaggtggatagagtaagtgtccccaaatcctgcaaagccagtgctgtggtctaaatgtctgtgtcgttccccctcccccaccaacctgccccttattcataggttgaaatcctgaccttcaggatgattgggcgatgggatctctggggggtgattaggttaggtggggattattgcccttttaaaagaggtctgagggagcttggtcacatcttctgccatgtgagaacacagccagaaggtgccgtatatgaaccataaagtggaccttcactagacactgaatctgctggcaccttgatcttggaattttagcctccagaattgtgagaaataaatttttattatttataagacacccagtttgtggtattttgttatatcagcctggaatgctaagacagacagccaccgttctctagccaagggccatttaagaagatgtggattctgcacttcagtgagccaaattccctatatttctccatatatccaggaagatataaattctctatatattcctgttagattgcaggacccttagacagggacgtctcccgcagaagttacacatgcacagggctgagtatgtggccagaatagccatgttagtcttcaaatctttgtgacccttggccaagagaatttggtcaagaactcttaactaggttaagcactttactttgattgtagaacaaagagataatctacaaatactggtgctagatgactcaaaagaagattaatacaaattatttataatctgctttaaacaaatacatgaaaattattctgagaaagatgttcatgttaataaagtctctggggaggccaagtgtttcaaactcaatccagatagttgggtttgctacctttgtcagagaaaccctgagcgcttggagagacaggaaggaagatgtaacagaatcaccagacacagtcatgcatttcatgtctccagtgtactagaaaacactcagcttctgaagtatctcccaaatctcccagaatacaataggaactttgatttctagactattgatacttgaaggaagcaactcatcgggcagccaaccatctagtgtagagcttggagaaagtccacactgtgagatgtcattgtcttgctttcatattcttacttagcaaactaattcacagttatgtattaagcccctatctggggactgagcactgggctcccagctggataaataggaatgagtgaaacaaatgtctctgccttctggaattttattttagagggggtggagagacagatataaacagcgagaggtattactcaatgctgagtgccctaacaatggagaggtggctgagatgcagaataacagtagaagacctactcagatcaagtgccaaagaagatctgttagagaagatggtctttaaggagaggactgaaggtaaaaatcattccagttagagagaacaacacaaaccaaggcattaaggtgggaaagagttcattgtataccagcttgactttcaaagaactgaagtgtgggaactctacctctcatctggagagagtggctccagataagagtcatgaaggtggttgggccaaaccatgcagggccctatggaccagtgtaaggagtttggactctattcagtgtgaaataggggagtgacaagatctgacttagattttttttttttttttttttgagatggagtctcgctctgttgcacagaccagagtgcagtagcacgatctcagctcactacaacctctgcctcctgggttcaagtgattctcctgccccagcctcctgagtagctgggattacaggcacctgccaccacgcctggttaaattttgtatttttagtagaggcagagtttcatcatattggccaggctggtctcgaactcctgacctcaggtgatccatcccaaagcacagagattacaggtgtgagtcaccccacctggcccgacttagatctttaacagatcccttggctgctatgtgggaaatggctggagatgggaagtaggaagtagagaggaacatgactcagatgttcaagtacgggagagcgatgattgtgagttggacaagagcaggagcaaagaacctggggaggagcgcccatgcgattatcttcttaaaataatctcagcaggccttgctgatagatggaattcagagggaaatgcaggtgaaggaatcaaaggggactcccaggtttctggtggctgatgattgctccttttacagggatggggaaggttgaggaaactgagcaaattggcgatgagcacagaaactggagccagattgcctaggttcaaatcctggctgtgccacaaactacctatgtgaccttggcgagtgtcttaaccgctctggaccctcttttttctcctctataaaatcacggtattaattgtacctacctcatagggtggttttgaggattaaatgatcaggtatatgtaaaatacaagtaagtactatgtaagtgtcagaagggggaagaaatagcttgggaggaaacaatgagttgatataggagataatcaaaacaaatacatggaggagacattgaatatacaagaccagtgctcagaactgaagtctgggctagagctataatgtgggatttttctgtatacagaagagggagtggaagaaataacccacagcaggattagagggaaagaaaagagagagccactttccactttagaattgcgtattttatagaggtcagacaaaggtgagtgcatcctggagaggcgggaagaaacctaggaggtgaggcacaggagccaatggaaggcaggctagctgtgagtgacacatgctccaaggggtcaaggcttcttattataactcatgtgtcatggaaaatacaacatcaatggcttgtttgtccctgtcttccctgatttctgaatctcattcatctttctactccatcccacaccctcctctgttctcacattccagtcctcttgctctgacactgccctgatgatgaaatcactctatttaaaaaagaaaagctgaactattcacagtagcaaaaatatggaataaaactaaggtttatcaacagaggattgaattaagaaaatgaatgtagaatactatactatactatactatagaatactactcagccactcagccacaaaaaaaaaaaaaaatgaaatcatgtcttttgcaggaacatgaatggaactggaggccattatcctgagtgaaataactcagaagcagaaagtcaaataccacttataagtgggagctaaacaatgggtacacattgatatagagaacggaataatagagattgaacacttcaaaaggtgggagggtgggaggggctaagggctgaaaattacctattgagcacagggctcactagtcgggtgacgggtacactaataaaagccaagacttcaccaccatgcaccatctgcatgtaagaaatctgcacttgtaccccctaaatatttttaagaaatttaaaaaagaaaagctgaaaagtatgaatattttttctttgagtgagcccaagaacaaatataaactttttcttcagtactttggacacattatgaacaaagccatgttgtcagcctggcatatctcagggatcccagcgtctgccagtcttgcctgctgtggacgttcagcaccgcctactccttactgccctgtgggctgcagagcatgcctgcggtggtggtgggaggcttctgtttgtgcatcatcttccataggcacagtgatcattgccagccagtggcacttctaggtgaggaggctcttaggcgaggcccccaggatttgccctgtaggaaccgcttggttaccagtatttttctctggcctttacctgctgtattagtttcctagggctgctgtaataaagtaccacaagctgctggtttcgaatgacatgaatatattatctcacagttctggaggccagaagtctaaaatcaaggtgtggtcagggccgtcctccctctgaaagctgtaggggagaacttcttagcctcttcctggtttctagtggtttactggtataggggagtaacagtaatccccataggttcttagttggaaagcacctttgttacaaaagacagattgacaagagaaaaccagacagaagtttattaacatgtgtattttgagtatacatggagacaccaagagaatgagtagttttcagaggtggctttgaatttcagcttatatagcatcttcaacaaagaacagtaaattttttgtaacaagacaatagaaaaggacctttgaatctctgtgggcagcaacttgcaggtggggcagtgaagaaaggcaaataacttgcagataaaggttagttagtacagcttgctaatataaattcttctaataccattgtcaggctgataagggtcttaaactatcttcagtctttaacctttgttctccctggtagtcaggagggcagaataccttttgtcttcataaatctttgtcctgcttttaggcaaatggaggaaagatatctcttgagtatctgtttcttcttgtcttcaacaatccttcatgttttgaagaggcacattctggtctcatactggcagctcgcagctgcgtaactccagtctctgccttcaccatcacatcacattctttctgtatgtctctgcctttacatggctgtcttataaggataccagtggtattggattgggggcctgccactgtgacctcatcttaattaattacatctgcaataacctggtctccaagtaaggccacattctgtggtactgtgggttaggactttaaggtatttttttggggagacacaattcaacccataacacctgcctcacttgactgcattttatttcagggctgtttacagtaaactttctttggttttgaaaaatgctttttactggaaaaattgaacaggaagtcttaacaatttccaagtttgattgctttattttttataatctactccatttttccttgtatcataaagcttcatgacccaacatagcatcttgacattgaacagagagccatcgtttctccccggctctttgagagctccttgtcctggagttttatctggagctttgatttgatgcctcaatttttggatgtggcctttatagggctttctgaagtgatgagtgatctggcttcaccgcatcttcaaaatgtccctgcagcaactgctattcttgctctgtagcatttggctttaaatatgtttcatatcaacagggttggcaccttctgtttttctcttccactcatccttctgaatgtaaatgtttaacttcttgcaaacacagtacactttgcataaagaaataggtacaactggcttttgtgagtcaaaaacagactggcctctcccaggggcaatagcaaacagctccctaggcccagcttggccaagcagtggcttcaaggtgtcatgtgctaaggctgacctccgaaggatgattttagaagatcaagggagattatattgtcttgaaaaagatggtttaaatgagatgaaggctagtctagtttaggagcaaagactgttggaacagaccacttactggctgtgggaacttagacaagttacttaatcatcagtttcatcatctgtgaaaaggatttattatatctaccttataagtttattgcaaggattgaataagcaaatgcaggaaacgcgcttagcacagtacttggcacatagtgattagcagcaattgttcttagtataaagagctcctgttactttccccctttatctagacattctttgctttaatttgttttccaactggcttcagcagcatttttcttttggaggcatctgaaggtcaagtttcagaaaaggaaagcaactaaatgtgtttaaatgtgtggatggaaatctgatcaaaggcaatttttttttttttaaatagactttgccaagtattcaggtgatgttctacgctagcactgactatgttaggacactagggttactggaaataaactcagccaagtattgattagtaatataaatgtcaaggaattaagcttgcagtggagcaggcaatgcaagcagtcctgtttggctgtaaaaatgccgacattcctgaagcgatgagctcatcattaaattcttcatcttccacacccataagagaattcatggcttgtttgctcatttttgctttggttttctagacagctaagaaggaaataaagcagtgcttcttaaactttattgtgtactagaatcacctggaaggtttgttaaatcgcagattctgcatcctggccctgcagttgttggttcaggaacactggggttgggcctgagaatttgcatttctgtcacattcccgggtgatgctgatgcagctgcttcaggaaccacactttgagaaccactaagatgaactccctcgaggcattgtgatgtgacatagagcagggggcattttagtcataaggtgatgggtttgagtcctggggctgtccttattagcagagctcttttaagcaaataatctctgtgagactgggtttcttccattttcaattagaaataataaaattcacctcatgaaggctcttgtaagagttaaatgtttgtaaatcactttgttcatgtattagttttaaaagatttcattaatctttgattgtaagattattttgtaagtcatgtaatatttccgaatgatttgggcaaccaagtctatcaaatgaataatgccattcgtttaaataatggaagcagttttaaatatttcactaaaattccacttcagaattcccaagccctttttcaagttggggtgtgtgtgtgcgtactttcttccccccttgtaattaaacaagttattcctcccccatttaattcttgctaagtactaaattgcataataaattgggaatttcctccttctctaattctgtgcattggcattttagcatattttgatgtgtaggtggtaaaggccagtgaaaagttcacagctggagtgcaaaccctgagttttcatgatgcatgaacaactgggatctgaccacaattttgtctttttatatttagaatcagccacgtcaatatctgcatggcacagaatcacctgggagcttcttacacatgtagaatttagcaccccatctctaaaacatatgattcagtatatagaaggtgtgtcctggtcatatacatttaaagtatcactccaggtggtacagagactgcacttcatgaaacaccaggaatggtctggaatagtctagtttgcttttaaattcagcctctgcctgcaactagctgtgtagacttgatcaaattctctggtcttcttaaatcttggtgctgtttatgtgaaattgctcactctcatttattggggctgttatgcagattataattaacatatataaagtgcttagcatgtaaagtgtgctgggcatgaagcattcaaacaatctaacattggggtagttcttttacaatgccagacactggaaggtggacaggtaagatcaacacaaaagttcctagatggatagaagtgaaatgaagccagttggctctgtgaatccataaaatatttatcaagccttggagaaagagaattcatcaaaaattatattaaagtgactaatttattttctttctttctttctttctttttttttgtgagacacggtctcactctgtcacctagactacagtgcagtgacacaatcacagctcactgcagccttgaccttctgcgctcaagtggtcctcccacctcagcctcccaagtagctgggaccacacctgcacaccaccacacctggtaattttttaatattttgtagagacagggtcttactgtgttgcccaggctggccctgaactcctgggctcaaatgatcctctgtctttggcccccgaaagacctgggagtacaagagtgagccaccatgtccagactaaagtgactggtttgttacaggtatcttcaggtcaggaacattcacaactagtttctaacttgcaattattttctaggttctaaagttcttattttagatgctataagattaaacagtgtttgagtgtattgaaatcaattattcagtctaatctaatgaatcagcagactatcatattttactgtgccagaacactaattttccattcactttaatgtgacagataatgtcctttcatgaaaatattaaacccttcaagagagccaaaatgaacccatattaatacaagacaacagagccaatactattcagtaacaggatagaaaaatgctgtttaaaaggaaatattattactgtaaagacagatttttattcaagaagttaggaactaccacataaatctacgtttactttgatttttctcaacatctttgtggctgtccttctttagtctcataagcaattttaaaatattttttctatattatggtctttcccagcttactgacatgcttctaatttacatgcttaaaattagtagtgtggcattttttacttccttgcaattcctgaagatctatgatgtcagtagagcttttagaaggtcttctaattgcacattcattaaacaaagcttaagaacagacagtcctaagggggttttcatttatggatcatttagtctgggattccccaaggacaatggtcaacattaattaaaacatcttgaagtctgtaaaccacagttacttctgtgcgagatgccatgatgagctttgaattatcacttgaaaaataagaagatttaggaaatttcagctttcttgttgctctcctgcaaatgctactttaaaacaaattttcttcagtgtcaccaagattaacacaacttactgctctagagaaccaatgttttatatttgtaatttgttacacaaaagaaaaagaggactcctgagatatggggtagatatcatattccctgtgtctggggggtagaccatcacttcaactgtaactgccagatgggttcttcctgctcactgtgcagacaaaatcagtccactgagaccatcacattgcagtaaagaaaaagtttaattgatgccaggctagccacaccatgtgggagacagagttattactcaaatcaatttccctgaaggctcaaaagttaggggtttttcaaggttaaaatggagggcagggggctagggaaggggcatgctgattggttggagatgtaattataggggtatagaaaacagtccttgtaggctgagtctgcttctaagtgggggccaccaaaggagttgctggtctgggtggggctgtccagtagtcagaaatgcaaaaagcctaaaagacttnnnnnnnnnnnnnnnnnnnntagtgatgctatctgcaagagtaattggggaggttgcaaatattgtgacctccagaataatggcaggtaattatgtaactatgcctgcatcttagtaaaattcaggcccctctcatcctcctaacttggtagacttccattaattttacaagggtagtttagcttttgggaagagctagtatcatttaaactataaactaaattcctcctgaagttagtttgccccacacccaggaatgagcaaagacagccagcctgtgaggctagaagcaagatggagtcaaccatgtcagatttctcttactgtcataattttccaaaggcaatttcagagccactcctgaagtggtaggaaggtgtgcgaattatgggtttgtcatatgcctctcatatgcatgaaggaatatgcatatgtaatacaagaaagatgtcattttgaaccaatgggactttcaagtatttccttctaggttggacaccgaggaacagtaagagattatccagactttagcccatcagtggatgctgaagctattcagaaagcaatcagaggaattggtgagtgatattttacaattcctttcttaatgttgaagcaaatcaggcaagttacaatctaaaagttcagtttgctcagattggcttactcaatttaataaattgtcaggaattttctaaaattgtgaaataacgaggaaatatatagagaacccagttttattaaatcttaacatttatcatatttacttaatattaaaaattaccactgatactagtggtctaggggagatccccaaatgccgggggaatctcaaccctggctggtatccagactcttgacaccatctagagaagaaattcaaggatgggtcaaaaaatactgaaaacacagagatttattgcaaagtgaaaaatacacactcaggaaaggggagtgtgagtgtactcaagagacagtcgtgcacaagggggtttggggctgttgcctttatgggtttctttaaccaaggggtggaatagtcatgaagattctgggaaaaaggtgatttcttgaaactgtagtgccacccctttttacaccaaatgtcggtgtttccggaactgccatggcactggtgggtgtgtgattgagtatgttaattagcatataatgagatcctaggagaatcctaggtcaaatccagcgccatgttgggtccagtgggtcttagccagcttgatccacactatgggttttcagggtcatatcagcccctagtttctgcagctatttcaacagtttccttttgctagtcatgtgaaactgctgcctggaattttctgttctcctgtgaccatcctgtattagtcctatctaaccaccaccaccactgccaccaacaacagtaataattatcataataaatcattacaaatatggcccccttggttgggcatggtggctcctgcctgtgatcccagcactttgggagggggaggcaggaggatcactagagcccaggagttcaacaccagcctggcaatataaggagggcccttctctacaaaaaaactcaaaaaattagctgggcttagtggcttgggcttgtgatcccagctacttgggaggctgaggtagggggatactttgagccagggaggttgaggctgccctgagctgtgattgtgccactgcactccagcctcgatgacagagtgagagtctatttcaaaaacaaaacaacaacaacaaaaaaacccaacacaatcccgtcagttcttcctggatttcactcttgcccctttccctagagataaacaccatcccaaattagagttcattcccatgaaacttttaataccataactacatatacatgtacatattgttatgcatggtctcaaacagcataaaatgaaatcatactgtatacattcttctgcaatatgtttttgtctcttaacattatgtttttgagatttatccatgttgatatggtgagctctagtgcattaattttaactgcatggtagtctattgcatcactatatcagaagatgggaatattgatggaacatttaaattgcctacaattcttttatattgcaatataaaaatgctgcaatgaatattcctctcatgtctcattgtgcatatttgctagcatttctctagaatatgacaagaactggaatttccacattgatggggatgcttctcttcaaatcaactagaaattttgccatactgctctctgaaatgaatgcagaaattagcattcctttcagcaatgtacaagacttccttttgctccatattctcaccaacacttgctatagtaagactattccatttttctaattaagtgtgtctaaacagtatcttatactgcatgtgtgtttgtttcctgtctctactccaatgactgatgcagttaagcatcctcacttgtgcatctgcttccactttcatatgtcaataaaatataaaatatattttatctatttttttcagttggtttgtcttctttatgattggcaagagtttttttataattcctcaatacagactttttaaaaaatattacaagccatgaaaatatttcctataagtttatggttttttttttaacattggtgacatggtttggccctgtgtccccacccaaatctcatcttgtagcttccataattcccacgtgttgtgggagggacctggtgggagatgactgaatcatggggacaggtctttcccgtgctgttctcatgatagtgaataagtctcacaagatctgatggctttataaggtggagtttccctgcacaagctctctccttgcctgccaccatccacgtaagatgtgacttctcctccttcccttccaccatgattgtgaggcttccccagccacatggaactgtgagttctccattaaagagttccttcataaattgcccaggctagggtatgtctttatcaacaacgtgaaatggattaatacaattggttacagtaatttttattgcatagaagttttaaattttagtgaaatcaagtttaccaatatttttgtccaggatttatgcttattgaatcttttctataacgaagtcataaagttagatattctcctactttttttttcaaagttttgaaattttatttttcgtattatgatcttaaatctacatggaattagtgttcatggatggtatttaaaggtgtctcattttattctatttcatgtggacatttaattgtcccagaacaatgtattgaagagctcttccttttcacactgatttgtacgtaatatcacctatgttttatgcttccctatttttctcttctctgttatgcttcatttatctatttggccctcccaacaccacattgtcacaattattaggattttataatgacactaaatatctaccaggcaaggtctttcttggctctttgccctcctctatgaattttaaaatcagcttgtcaaattcaataaatatactatattagaactttatatcaatataatattatgttttttctgcctgtttgaggtttattttttccatttttcaatgtaagttatttcttcatttatctcttgatttccttattttttttttaagagagaagggcttgctctgtcacctaggctcgaatgcagtgatatgatcacagcccactgcagcctcaaactcctggatcctatggcctcagcctctggtgttgctaggactacagatgctcatcacaatgtgtacctaatttttaaattttctgtagtgacagggtcttgctatgttgcccacgctagtcttggactcctgggctcaagtaatccttctgccttgtcctcccaaagtcctgggattatagatgtgagtcactgcacccagcctgattgccctatttatatctagtgttgaatagactgtttcatgaggttaatagtctttaaattctgtcacctctttttaaacattatgtttcttcatgaatttgcactttggcttacaggccttctttaagaaggaggttattgtttatgagcaccacttctgataggttctgagttcagaatgaggtatcataacggtgtttgcattagggatgggtcagacacagtctctgaacctgaggcatcttggcttagtttttgatcttgggcatgtttaaaaataagagatgagaaactgccaggcatacaaactacacataactgcaggtagtttggtatagttgtagtctaggtgcataggttatagagatgcagagagggggtagaaaatgagaacaaagacataaggcaggagagatcataatgagctgatacatgagctaaggggcttaaacttcatcctgaagattacaaagagccattagaattttagccaagggggtgacatgatcagattgtatttttaaacatttacttaggcagtagtttacaggaataattatatgggagtcacattaggaggtgatttaggttatccaggtaaaatatgataaggacacaggagcagagggcatgcagaggagacgacaaatttaagagatgcagataattgctataatatagagaataagataaagaaaggaatctgagatgattcccagggtttttgcctggatgactatatccatagttgtggatgagggaacataaaaagaaagacaagtcagagaggaaatacaataaattccacccagaatgtgctgagtttcagatacttgtgcagttgtggtggccggtagtgtactgacacagatgctgggtacaatacacagcaccaaattggtgctcagacccacagagcacaaatacactttaatctgattcggtatttatttaactatgtgtaagaatacaaaaccaaagacacagaaaggcagcatctttcattgggaggcccagcagctaaccaagtacacagaagcttttgcttcatcattgatgtaagctgtgtaccactgccacggaagtgtgtagatgaggtctgtgagggtcaccttgacacaaagaagttgagcattgagttccaggtgctcttttatacctctctagtcatgcatgctctaggcctgcaagccaattcacagcttcccaaaccaggtatcatcgtgggttgggaaattaattagacacaactttccacgtttttcttactactgtagtcaccaagataagaatgaccttgaggtcattcttaggcaggccagcatcagctctggcctgatgttaccttttgcttacaaacaattcattttgtatatgggtttgaaatttatgagagaggccgggtacggtggcttacccctgaaatcccggcactttggaaggctgaggcgggtggatcacctgaggtcaggagttcgagaccagcctgatcaacatggtgaaaccccatctctactaaattaaaaaaaaaattagctgggcatgattgcacatgcctgtaatcccagctacttgggagactgaggcaggagaatcgcttgaacccgggaggtggtggttgcagtgagccgagatcgtgccattgcactgcagcctgggcaacgagagagagagaaagggcgaaggggagagagagagcgagagagagagagagagagagagagagagagaaagggagggagggagggagggaaggagggagagagggaggaaagaaggaagggagggagggagggagagagagatgtggaagaaatgcatgagagagatgtggaccaaagatagaaatatatgttttggggtcagagatttgggttcaacttcttgctggaccactcagcagttgtgtgactttggcaaggaagataagttcgtgtcttcatctttagtacagcgggcccctgtgaatattaactatggcaatgaataaaagggtgtttcatgcagggcagattttcaataagtgttggttcctgttttccagaggaagaaatattttgatatcaagtatgggagagagataaaaggcaataagacagtaaccaaacctcataaaggtaaaaaagtcaagttcaaaagtagtaggttgttttgtctgatgtacagaaaggagtatttagacaatgattgtttccttccccccaaaactatccaaataaagttaacttttttttcccaaaactcaggcaaacaaaataaataaataaataaataaataaataaataaataaaattccaaccagataagatgctagaaattaaaatgccttactctctgcatttgtctcaggccattgatcattttgcttttgttcaagacaaatgttgagcataaatattgagtaaaataacttttgtttcatttaggaactgatgagaaaatgctcatcagcattctgactgagaggtcaaatgcacagcggcagctgattgttaaggaatatcaagcagcatatggaaaggtaaggtcacattaacatgacaggcagtaaagagatcattaatgtaccatggtcgctcccacatggttatgcccacagtcttctgtttcaggctgagtgtaacagaagatgccctgtgcatccagtcaggagcctggaatctgagtcgtggttttgccttgaactagctgactggctttgggcatgttacttggtctttctgggcctcagtttcttcacctgtaggataaggtttgccttagcccagtgggttctaaaccagaagtgattttgctccccaggggacatttgggatgaatggagacattctgatgatcacaaacaggatggtggggagtacttctagcatgtagtaggcataggtcagggatgctacaagcatctgagaatgcgcaaggcagccctccacaacaaagaattactaaggaaactatctgactaattctgtcttaggtaaccttttatttctcttttaattttaaaatatttatgtagttataggtttaattcattcagcaaagaaaatttagtaattaccagaaactatataagaacaagtaactttgggaggctgaggcgggtggatcacctgagatcaggagtttgagaccagcctggccaacatggtgtaaccccatttctactaaaaatactgaaattagcctggtgtgatggcacatgcctgtaatctcagctactcgggaggctgagggctgaggcaggagaattgcttgaacccgggaggcggagtcttcagtgagccgagattgatccagcctggaaacagagcaagactccgtctcaaaaaacaaaataaaaaggaaaaagtaaaagtaagacttggtctttgctatacagtttatttgtccaatgtctatttctgagtactaatctgtgttaggagatatcctagacattggaaatagactggtataaaaagcacatcctgccttctttcatggagctaacattctattagaatataataaacaagtaaataaaaataattcagatatgataagtgatatgaaagaattaaaatggttgatatgatagacagtgactggtgactggctcctgcagatagagtgatgaaggaatgtcagtgaggggttgttacctcactccccactaagcctaaacaatactaggggttctgccctgcttgatcaggagatagtatttaaggtacagaaaatataaaagccctgaagcaaaaagaaactgggaatatgtgagaaataaagaattccaatatggcaggaatgtagaaagtgaagggggcagaagaaagagatgaggctggagacaggttgagaacatgctaagccttgggtcttggtagggtttagattttattctaagggctacagggaaccactggaggtttgtaagcagaggaataatatactgcagtttttatttttaaaggattattttggctgctgtagataatgaactgtggggggaaaaggtacaaacagacccggccaactgttgagagggtctagtgaccatccacaggcacctcaggaattacctcctgggagtgttctccaggcccccaggctccattaagacacccttctctgagctccctttatcagataacatattatattgaaattttatctttgaatatttctgtttttcccatgagggcagaatgccttaggataaggactttgtctaacttacctttaaaggactagcacagagcaggtgcccagaaaacatttgttgaattgagtgaattgcctagcttcagggcaagacaacactttcacatacagagaaggtgaatgatctattggccttttggtatttccaaaatatggaagaaagatggaggtggaggggaacaaccatttctcacagtggaataggatgagagctgtgaaataagattcagctgcagtggcttggattgaggacagatggtagtgaaatttaccatttagagaggaaaaaaacactgtggcaattaaagcagagttgataacactgaatgccaccccatttgtttcagcaggaacatgccactgctgcaccccccaggagtgtggttgtgtcaatctgtgcccacagcgtttcagcaggctcagaggctaccagcctctatttcagagctgaaaataatcaggagcaggaacaaacattattcagtattatgccattgaatattgaaaatagaaaccctgttacccccctttaagcaggggagatggactgtacttaggtgtgaaaacagtgctcaaaacaatatcaataggtaatgtctgtaagaggctaaattctagtgttccatcgccctgtaggataactatagttaacaataatatagtttcaaatagctagaaggaggatattgaatattcctaaaacaaaaaaatgttacatgtttgagatgatgggtatgcaattaccctgatctgattaccatacattatatgtattgaaacatcactatgtaccttatgaataagtacaattattatttgtcagaaaaaataagtctaatgtattgccacacttagggttttcttttctttacttgttgccagaaaattgcttctgatgccacctagttccacattctcaccagagacaaatgaccagccactgtcctcccttccccttcctcttggagctctttgggagttactgagaggcaagacaccgaggaagagagcacctcccactgaagctgggcgtgaatttataagggttcctcttcctcttcccttaccccaatctaagcattgaaagcatggcggatctaggaaatgcatttgaatacagttcctaactgtggcactcatggaatcctcccatttggctctccttcaaaaaacctctacaaaacagaacaatttgggagtaattagaaaatgcagattaatattcatagaaatattttcaacacttctgtttattccctgtggatggacatgttttgtctgattttgatacatatgttcatctttcactaggtgactttagagaaagagaaaaaaagtatttcacatttttccccttggttttttgattttaggagctgaaagatgacttgaagggtgatctctctggccactttgagcatctcatggtggccctagtgactccaccagcagtctttgatgcaaagcagctaaagaaatccatgaaggtatgagccccccacaagccatttctgcccagggtttgaccaagtcatcaaaaatagtgactttcttgcagtgcacacttgtgatgggtggacttggatgcccttttggtctggactctcccagtggtagaatgactctgaaataggcaacagctatagaaccttaagcccaaatgttcctgggctggaagaattttgtcatatcctttgtttgacatgaagagtcaagttctctaatttgtcatcgttgaaagtaaatagcactatgattaaccccaacactcaagctaaaaacctagcattatccttgagcccttgttttctcttacccttccaagctcccaaatctatcagcaagttccttagttttacttcaaaatccattataaatatgtgcacttctctcaaaatccattgctactgttctagtctgaccaccatcatctcttgactggtccatatcaataggcttctaactggtccctttgcctccatttttgcccatctcaaattcattctacacagaatagccaaaattatttttattaatttattttaaaaatcagattatgctacttacctgcataaatttccaatggctttgtacgcttaaaatccaagcttcttatcatgactttcatcacccaacatagtgcagctcctgtctaactctgtgactttttaaaattctatttatatcagtcagggttccctcagagaagcagaaccaataggcaggacatagactttaaaagatttattgtaaggccaggtgctgtggctcttgcctgtaatcccaatactttgggaggccaaggtaggtagattgcttgagctcaggagtttgaaatcagcctgggcaacttggagaaaccctgtctctacaaaaaataaaaaaaaaattagctgtgcatagtagtgcattcctgtagtcccagctacttgggaggctgtggtgggaggatcacctgagcccagaaggtcaaggctgcagtgagctgtgattgtgccactgcacttcagtctgggtgacagtgagaccctgtctcaaaacaacaacaacaaaaatttattggaaagaattggaggccatggtgggaggattgcttgggctcaggagttcaaaaccagcctcaaactgagcaacatagtgagaacttgtctctacaaaaaatttttaaaaattagccaggcatggtggctcatgcctgtagtcccagctatttgggaggctgaggtgggagaatcacttaagcccagcaggtctaggctacaatgagccatgaccgtgccactgcactccagcctgggatgctgtctcagaaaaaaaaaaaaaaagaagaagaagaagaagaaagaagaattggttacatgattatgggactggttaggcaagttcaaaatctgtagagcaggctgtcaggaaaggcaggctggaactcttgggcacaagctgaagctgctgtccacagaaagaatcttctaaacagaagccttgcctctggtcttaaggcgtttcaactgattggatcaggtctgccgagaaaggtaatctcccttacttaaagtgaatcgataataaactgaaattatatctacaaaataccttcacagcaacacctagattagtgtttgattgaataagtggcattatagcctggccaagttggcacataaaactgaccgtcataccccctcctgctcacccattaatgatgtagctacactggccttttctctgctccttgaacatcataagcttattcttgttttgagatctttatacatgatgtttcttccatctggaatgcttttcctccagacattttccattaattcactcaaatatattttcttaactgcacttattactgtctaaaagtatcttgtctatttatttgtttttgagacaaggtctcgcttcattgcccaggctctagtaaagtggtgcaattatggctcactgcagcctcaacctccctggcaagcctccaacttcagcctcctgagcagctgggactgcaggcacacaccaccacacctggctaattaaaattttttttttttgtagagacagggtcttgctatgtcacccagactggtctcaaactcctgagtcaagcaatcctcctgcctcggcctctcaaagtactggaattacaggtgtaagccactgcacctggccttttctatttttaaaatccatttgtttattatcttttttcatctaactaaaaggcaaacctccaccatggcagggaacctcattggtcttggcctatatcttctgttcctagagcaactcctgaaatgaagtgggtgctcaacgtattaattaataggaaggaggaaaaagaagggagcctagatctgaggcataagccatattctgccttgccatcagggaatggagttatcttcttttctgtggaggacatatgggcatctgagaagcagatggcaagatggaatttgatgtacaggagatttattttgagaaacacctgtgaaggataaagaggcgaagagcagggtaggtggggtgaaccttcagactgcagtggtggcctgacccctatgagaggagagaggagaggaagtaggctgagattaggaagagcctcagtgcatagtgaagctccgagaaaaccttggtaggctgttggggagcccctgagcaaagactgccctttggaggagttctgtgttgggcgcaagtccagtacccctgttgtttacagtcattgactgacagccacctggagagggcatgacctcagtgtgaactttggtagacccaaaggtgtggcagttggaggctgttagctaactgcgttctttgcagctgattctcttgaagtgaaatctgagcattgtttctctatggctacccaaaggggagggtttagcaggtgtaattgtaaggattagattcaccaataagtattagaacagtttctcttttacataaaagaaatccaggctgtggtggcaccaccattatcagagactcagtctccttctatcttgaggctctgccgtctttaactcatggttttcacttcctggctaaagaaggctcatgactcagccattatgtcttcattccaggcaactcaaaagagtaaaggacaaagaagggttcactccctcactctaaggatactccctgagcatacatatggtacttctgcatatatcccattggtcagagtttagtttctggacatatttcactgtaaaagaagctgagaaacatagcctttatatgggtagcaatgtaccaagttaaaagttgggggttccattactaagcaagaaagacaaaagagatactgtggtaaactaggaatctctgctacagagagacagaattcagtctctgttcatatgctgcactggccttattcaatcaagtcttagtgtatatgacttttcttggagtcacagtgtgattcagtgaccttgatataaacaggactgagaggtaattagtccccatgccagccaggcccatgatgcacattactgaggatttgaaaggctccctgtatgaagagaatgatacatgctgatagacccagtacagtgatgcaaggatgaaatcattcaaaagtattatagagccttttctaaacatagtggaatgtttgaatgttggtagggttaatcctgttagactgtcacttctaatcttgaatgacacaggctttttcttttatactatttctttccagaattattcaattgattttcacactagagtgaaaaatttgctgtcactttattccagatgatttatgttattactaaaatatatggaaaaatagaaaacgagagcaatagagaaccttgtattgatttacttaaaagtgtcctttcatctatataaacaagataataagaccaaaaggcatgagattaagttatttaagtgttctaaaaattagattttcttttcctttttagggcgcgggaacaaacgaagatgccttgattgaaatcttaactaccaggacaagcaggcaaatgaaggatatctctcaagcctattatacaggtgtcttattttctgcttaccttcaccactgttcacacatatttgagccaatgttgcttttcctagaatcctctcaatctcttcatgaggcattttgagaagacaagacttacagaaacgagaatacattctaaaatcagctaaagactatgagtttccaggaaaaattggaatatgatctgagctagagactgctacataacaatagcattaatgctttacatttataatattacagctgcagtggattttgctctcggcaatctctcattaattgaattaaccattgtcatcaatgtaagagactcaaatcgtattttatttttaggcgttagaaatcactcagattagatccacgattttgggtgtgggaaattagattaatttagaggatgtgttgagcataaggattcaatagaagtagctaaagacctaatagtctgctggctgtgtaaaattagaaagactctgaaatgtaattctgactgtaactacccagggttagtgtgacttcacaggttaaggtcacagtccccacaagactaccttcacctcagacaccagcccacaagctcaggtgttttcaggctacacgtgcttttaaccagctggctacaaattcagggttctcactaccctctcaggttgaatagcacactagaatgacacagaactcaagaaagtgctgtgttcacaaatgcgatattatcataaaggaaacaaatcagggccaatccaatgtggagactgcatatggagatatttggaagggtccagtggaagcttccactctcctgaccattgatatatcattaccaaccagcaagctcacttgattattggtagccttagtttttattggggttttgttatataagcatgattggttgaaccattgttcatgtgattgaaccagtccacctacactccccagaggtcaggctgatattgtggctcaaagcctcaaccttttaatcatatggttgatctttctgatgtgaccagcctttattctgggtcatattgttagcataactgagctgtagtccaagagaccaaccatgaataacaaggacacacctatgacttgggaaatccaaagaatttagagtttacctcccaggaatcaggaataagaccagcccaattctctactattcaatggccccatagaaccctctccaagtactttaagggagccacagtttctctgtttgtgtctcacagaggtcagttgtgtcatagcagcttttgcagtgggagaggtccaaagaaggagtacatattggtcctcatgtaggtgttaaagaggatgctttgggagattcttgttagaaggtaaatacctcaatgtcaggtgactgttttgttattgatgtactaattgggttctaatcagaaaaacagaaacagcactaggtattttgacagatagaatgtaatataaagaactgcttaaagggccgggtgtggtgactcacgcctgtaatcacagcacttggggaggctgaggtcagcggatcacaaggtcaggagttcgagaccagcctggccaatatggtgaaatcccatctctactaaaaaatacaaaaaaagttagatggtcatggtggcgtgcacctgtagtcccagctactcaggaggctgaggcaggagaattgcttgaacccaggaggcagaggttacagtgagccgagatggtgccactgcactccagcctgggcaacagaatgagattccatctcaaaagaattgcttaagctgggcacagtggctcatgcctgtaatcctggcattttgggaggctgaggtgggcagattgcgtgagccaaggagtttaagaccagcccaggcaacatgacaaaacccagtctctataaaaaataccaaaaattggccaggtgtggtggtgcacgcctacagtcccagctcctcaggaggctcaagtgggaggatcacttgagtctaagagattgaggccacagtaagccttgatcatgccactgcactccagcctgcgtgacagagtgagaccttgtcttggaaaaaaaagaagaattgctaaacacctttcagaggactgaaaaagcaaaaagggaacaaaaggattcatgcaggttataaccccccagacctgagacaacaaaggaaagaggttgaggctatcagaaactggaagctagaatgagggacatacctggctgatgtcgggacctcaggggctcagagcagaggcttaaggagcaggagttcagatctctgaaaagagggctccatctgtaggtactggagccagtacctacacgggggtcaaagtgactttttctaggaagctggagccagttgctgctgtcggggtgaacagccttccctgggttgacactgacatgactagccgtcagatagcttgcacttctttccacctcctgccttccagtcccctctactccccagtactggtggaacctaatagggagcgggtacagacagaagtagacaagagaattgcttaatcattaatgcacaaaagagtatgttttaggtgtttaaaatatttcagttcaacaaggtttacatattttacaaaacccatcagaaccaggcactgtttcccaagttggcttggtattttctggtgtttcttagaagagccactgctccccaagtggacctgccctgtgacagatccctggagcccagcatttaggtacaaacagttccaggatgtgagctttatgaggatgaggattttcgtctatgttgttcactgctgtatcctcagttctaagaacagtggggcagataagtgcaaatatttattaaatgagtgtcctcaaaattgaggttaaggtcttaagagccaagtgaaacttttaccattcaggatagtgttgtgcagatatgacagatgataatagcacaaagttaccagagcctcaatttctatgtgagtaatgctctctgaggctacaaaggatacaactgcatcaaggttaccttggttactagagattaatgatacacaagaagatcaagaaggaaattgtctcaatcatgcatagccaaactttacagagattaaagtcacagcactacccgagggacccagttatgttgtcactctctcggcagcaggcatccattgctccccatgctaatgttttccgtgacagtaactgctcctcttcctttttgcttctaatgttcttgacaccagcaagtaacatcccctcccctaccacatggtgtttgtctacccaaggcttataaatatttgtgcatagcttttggttattcttggctactgttttcttcattatttccaggagtcttttggttctttgttattctattgtctttgtctccttttctgtgtcactcgctccctaagagagaagatacaatgggttcaggaagtcactatcatgttggccctcataaagggaccagatgtcttctacagcttattcagtacagtggcacaatagagtctaaataaagagagatctaaattcttaacttttttcggtattctaaagtcaatggtgtgtgagagagagaacactgaaacagggatcagggactcaaagttctagtccaggcacctgtactattaaaatattctatttgattttatactctactgtgcctcaaaatggataaagtagttgtcaacttaggttgaaataattttttactctaatatcccacaaaatatttgaaggaaagggagaggctgtgtgaaatgacttataaagtctcatctaaataattccaaaattacaaaatacttccccaagttctaagaaatgggatattcattcttctacttgatattttcaaatttaaagttttttatctaactagaatgaaggatagatgtaacaatatcacaaccattaggtttaatgatgcctactaaatattattatttagaaaaataacacacttttttggtggattttgcttatatgaattgctttgaaaagttacagatttcataaaaaagagacttactaaaatcatgctgaagaagtttccatctcagcgcagttcttgctattggataatctcatatcactttctataattgtctttcattgatttaaatagatgagaattctcatggctagtatggctaatttatagaattcttgagaatggtgcagacagttcagatagccacatggtgtcacctacaacaaagggtatagtggctccaagagaatcaccaccccatggatggggcagacagagatttaagactgatgggcactgcacatcacaggccatgcaaaaggggctacaactagtcagtactaaaatatatgaacacacagttggcatttgtaaagggaaatggcatgttttgggtagctttcttacttttgggagatacgaaaaaatatggtttaattatattcattaagattagggttagattcgataaaacagaaaaattacagtggcttacaaaaggtagaagtttatttctatcatatgtagaagtctagacattggcaattctaagtctagtatgacagctactcaaagcttttaggaactcagacttcttcttgattacttttatgccatcactaagaagtggtccttatcttcacagtccaagatggctgcccaagatgcagatatcagttcacatgtaaggcagttggatggaggaaggactaagatgaacatggcctcatccctttaaggagatttgtctgccttcatttcattgtgaataactaagttatagaactgtactagctaagaggaaagctgagaaagtagtttttaagctgtgtacattatatcttgcttaaggttagggttctcttagtatggaagatggccagaatggaaattgaaaggcacactagtagctcatccaccccagcttttccactatgcatcccttagtgccattgtcagatgaaataaaccaagatttgctccagaatgacaactctttctattcttttgcatctaccacaacacagtgcagtaagagttacaagaagaatgtaccatctcacaacagaaaagcatgaagaaattaaataaaagggcaagatttatcttatcacatacccattctttgctagtgttggcatttaaacttttctctgttttataatcatatttttcagtttgtcaaggcttaatttcattctgatttggtttcagtatacaagaagagtcttggagatgacattagttccgaaacatctggtgacttccggaaagctctgttgactttggcagatgtaaggttttattttttattttttaactccccagtaagctgcatgctcaataacaatttttagggagtttaaaaataaccaaactgagacaatgagttcacaattttccttatgaaatggtttgttcattttacattttcattgccaccaagcaatataatgtttaaccaagatcataaaagcatacataatgatgtaacaacaaagaaaacttatttgagtcagtaagtggaggtgttttggtcaggtttcacaattttgacattagaagacattctgatacatcatctgacatacaatatttatttccattataagtgtctccattttaaagaacaggtttattttcttctggactctgaagaataaatatttcttttgttagcttctaaattaaataggaagcatgatacagaagaatgatctttagagatgggaattaaattgagtatcagtctcaggattaaaaaaaagaaaatgattgctgcaatttcagccttgccaccttggaaaagctgccaaactattaatcatcatgtgacctaatgaggccacaccttgctttctctttttagaaggcttatgacttttattataaagatggtaaggtcaaggatgaggtgtattcacagctgtgtgtaagagagaacgtgatttaaaccatagctcaccaattttctttcagctgatttacatagcacctaaatgtgagaaaatcccaacaacggtctcagcctcatggttgaaacagcacctgtcaaagtgaggcattatgccattaggaagcgatttatctaaattatggtttcagttactttaaatgtgaaaaacttatgaaggttgaacccacaacaccaaatttatgaagcattgctgcaaacatatgctctcagaggtatatattcctaagtgcacatctgtttgtgtatggacatgaatgcacccacccacaggaggcagtatagagtagggctctaggacagggttctagaatcaaacagggctggaatctcatgctgccaactagctttgtatatttggacaagttctttaagtcttaaagcattcattttcatatctgtaaaactaaaatactaacaataacaagtactcatagggtgttatgaagattaagagaaagagagagtatgtgaagtacttagtgatcaacacagggtggtagtggttagtattatattaagaccgatgataatcagcatttatgtcattggagcgagcgtaagtgaaagagaacaagaagaaagcaaacagcagcagggtatcagcagcacagaaaagaaaccaggcaaaaatcagacagtcatacaaggacctaatgtttaaaaataggaacaaattcattttaaactattgtagctaaatgtttcattcacctataatttgccaaataattcaggcaatcccgtgttttggttttgtctcctgtctttccataatgtgcttaagtatttgtacatgaacacacataccacacacacacacacacacacacacacacacacacacacacacaccacttaaaccatagagcctttaatatcacagttggggatctttgaggactttttattttttcttttttgagacagagtctcactctgtcatccagactggagtgctgtggtgcgatctcggctcactgcaacctctgcctcccaggttcaagcaattctcctgcctcagcctccctagcagctgggattacaggcacacgccaccacacccggctaatttttgtattttagtagagacagggtttcatcatgttggctaggatggtctcaaactcctgacctcaatcaatccacccgcctcagcctcccaaagtgctgggattacaggcgtgagccactgcgccccgcctttgagttttttttttttttaaataaactttactttttagagcagcttcagatttatggaaaaattgagcagaaagtacagagagctcccatatgaccctattctactctctcctttcctttccattattattattattattattattattttgagacaggatctggctctgttgcccaggcttgagaactatggtgtgatcttagctcactgtagtctcgacctcctgggcccaagcagacctcccacttcagcctcctgagtaactgggaccacaggtgtacaccaccacattcagctaattttttttttttttttttttttttttagagcgagagaaggtctcactcttgcattaattagtatgtgtatttattataattggtgaatgaatattgatacattattattaactgaagtttatagtttacattagggttcactctttctgtgatatagttctatggattttaataaatgtataatgtcatatgtctatcattacagtatgatagagtagtttcactgtcctaaaaatcctctgtgctctgccagttcataccttcctccccaccaactactgatcttcttactgtctctatagttttgccatctctagaatgtcctatagttggaatcatacagtacgtagccatttcaggcaggctggcttctttcacttagctatatgcctttaaggttcctctatgtcttttcatggcttgatagctcatttctttttagtactgagtagtattccattgtatagaatatttattttacctgctgaaaggcatcttctttgcttccaagtttggcaattataaataaaacttctgtaaacattcatgtgcagatttttgtatggacatgttttcaactcctttagttaaatagcgaggggtgcaattgcttgattatatagtaagagatatttagctttattaaaaaactgcagaactgtcttccaaagtgactgtaccattttgctttcatatcagcagtgaatgagagttcctgttgctccacattctcaccagtatttggtgttgtcagtgttttggatttaagcccttctaataggttgtgtagtggcatcttattgttttaatttgtaattatctaatgacatacaatgttgagaatcttttcatgtgccatctgtgcgtcttctttggtgagatgtctgttgagatctttcaaccatttttaaattgggttgttattttcatattgagttttaagagttctttatgtattttggatacaagttctttatcagatacatgttacaaatatgttctcccagtttgtaccttgtcttttcttccacataagacctctgtgttgggttgggcacagtggcccacacttgtattcccagagattcaggaggctgaggtgggaggacagcttgaggccaggagtttgagaccagcctgggcaacatagcgagatcccatctctaaaaaaaatttttaaattagctgtgtgtggtggtgtgcacctgtagtcatattagctattcaggaggctgaagcgggaagatggcttgagccttggagttcaaggttatagtgagctatgactgcaggactacactctggcctggccaacagagagtgagaacctgtctctaaatatatatatatatgaattttcggaggagggaactgaggcccccaaaattgtgtgatttgctaaaaatttcatgactagtcaatggcagaaccagaactggagccctgagtacatgatttttctgtgcaacctgtcctgccttaaagaaaaaccactaagatcccctgctggttgaagtactatgtgttagaatcttctatctttaaaggatggcccttgttttcgtcctcctgtttagggcagaagagatgaaagtctgaaagtggatgagcatctggccaaacaagatgcccaggtcagtaacaaagcgggaaaacatttcctttacctattctcctatgtggctgcctttgcatttatgtgaaaagggagaaaaatagcagcaacagggacttttctttttttttttttcctgtttgaaagagaagcctgaagcttggggatcggaaccctaactttttgcctgccccagtggtagttatcattctccttggctcctgacagcccaatttttgatttctagtcttctgaaagtgagagatttagataatagatgatggcactgacctctgaaatacaactccgattcttctcatgtcacctctcaaaaagaaaataattgtgtctctaatatcattctcttgtgaatagattctctataaagctggtgagaacagatggggcacggatgaagacaaattcactgagatcctgtgtttaaggagctttcctcaattaaaactaagtacaaactcacattacaatcctttgtgttgtatgttgtttttacaaatgtttttgcatttagtatacaaagatctagaaaaacgaagtttaaaattgcgaagtctgttccagttattcacacttcaggaaacaaaatgggaaagctgtattgtaactcaaggaagtactgacactacacttttgtttttccatagaggctgagtagattacctagtgagtaccaggtaatagatgggggagggaggtggcagggagaagaaaagaggccaccctctagggtgagagtagaagggcttgttcctgtggaatggagaagcccaactgcttccactccacctaacagttctccctagttagccacttccagaaaagccagacactgcaggtgagtctctgttgacacatcaatactgattaacctttagctatttctgatatgaaggtaagtggtagaatggatcaactcttatcgtcagaccagctattacatggaattgtgggcacccgccctcttgctcatggcatctcctagaactgttctggaagcaacaacacctagaaaactaaaccttcatttactgtgaacatcttctgactgtggcttccagatgctagtttacagaacaaccacacagcaagaccaagcttatgctgagttgacggaacaatgagtaaacataaggatattactgtgactttgaaattctgaaattgttctttcttaacttttgcattaaaatcacatttattttataaaataatgacaacagtatgtgatagttgctttattcatgtctttgtttgaaaaacaaaaaccagataaccctaggtctctctccaaaatttctttttttaaaaatgtattggggaaaaatatacttggcttacaaaatatgcctgtatacttggtgacatatgtacaggttttgcttggggcaaatactgatcaagaaattcaaatgccttctgggaggtgtgaagtaggccatgccaccttaggaaatgattcagcacaaggaagtcttcagaattaagatttctttaccagagaaaacatatttgactagtgattatagtatcatttcccaggtgctgctataaataaaatttaaaatagcccaacttactggataaattatttattatttaactatttaggctatttaaaatgcttactgcttgagagaaggggaaagagaaagagagatcattgaagaaaatcatctagggagtttgggttttgttgtagatgatttccttaaaaaggaacaaaagaaaaacaaaaacttctgtgcccagattttcatggtttaaagagggagttttttagcttgctacttgatcttctgcatatcaaataaaaaactagaatatattcaaatgtgctcaactgcgttgctttaaataattttgtggtgcttctttttagcatttgatgaatacagaaatatcagccaaaaggacattgtggacagcataaaaggagaattatctgggcattttgaagacttactgttggccataggtaagacttcgagtgctggtaaactaagttactttgcacttgctttaactcagtgccgaggcctgctccttttgggcaagaatcctgactgatccattttttttgctccctacagcccccaacatggtccaggatacacacagtacgctcaacaaatattgttaaatgaatgcttgaagaagttatttttttaagtcttttttctttttcttttttgaaacaggatctcactctgtcacccaggctggagtgcagtggtgtgatctcagctcactgcagcctcaacctcctgggctcaagcagtcctcccacctcagcctcccaagtagctgagacaacaagcatgtataccacctggcccagctaattttgtattttttgtagagatggggtttcaccatgttgcccaggctggtcgtgaactcctgagctcaagcaatccatccacctcagcctcccaaagtgttgggattacaggtgtgagctaccacatccagccatctttttaaatcttaccttgctttttaaatttgtatttgtcttgtgaccatgtttagcttgtagacttcttgagagctgaaatattttatttctactggcatttttattgagctttgttgaaaactgagacgtaggcaaagcacagtggcatgcacgtgtagtcttacctacttgggaggctgaggtggaaggattgctggagccaaggagttcaaggccagtttgggcaacatagcaagatcttgtctctttaattaaaaaaaccacacacacacacacacacacacacacatgcaactaagacctaagccagtttggtaatccaccatatttggttatttatgaaagatatcagtggcttttcttttctttctttcttttttttttttcttttgagatggagtctcactctgtcacccagactagagtgcagtggcacaatctcagctcattgttgactctgaattgctaaaagataagccgaggaggctaagaaagggaaaactttcttcttcaattaaaaaagtagaattgagatcagtcttcataattagttctcagactgttccagtggtaatgatacacctggttaatttttttttccattttacattgttaatctttttttctttttttttctttgtgacggagtctcgctcggttgcccaagctggagtgtggtggcgcaatctcaggtcactgcaacctccgccttccaggttcaagcaattcttgtgcctcagcctcctaagtagctgggattacaggcacacgccaccacgcctggctaacgtttgtatttttagtagagacagggtttcaccatgttggccggggtggtctcaaattcctgacctcaagtgatccgcccacctctgcctcccaaagtgctgggattacaggcttgagccaccacccctggcctatattgttaatctttatattaattctgcttgctgtttttcatttggtgttcttgctaagccgtaatgtttgaaaaactttgttgagatgtacaaactctcattcactgagctaaggagcattcttggaaatatatcattgaataatgtattacatttgggctataatgcacattattttatcatgtaaaaaaagaccttataattcaattgaagttcaaaatatgttacactttcattttgtttcagtctaccattggaataaaccagtttataaaattttttattgagatataacttacataccataaagttcacccactcaaagtgtgcaattcaatgctttttaatgtagtcacaaggttttgcaaccatcaccacaatctaagtttaggacgttttaatcagccgcataagaaaccctgtaactattgacagtcactttccaatcctccccaccccctggctcctataatcattaatctactttctgtctctatagatttgcctactctgcatatttcatacacaaggaatccaatacaatggtcaacacatagtttttgacatgaaaaacgatctgagctgtgtcatcttagaatcgtgtaataggagcatactacttgccaaataagaacaaatccagacttaagtaaggagaggctttattcagtagaactatttcaatagagagaacatgttgatttcagaaacctgaaagactgggctgggtgtggtggctcatgcacataatcccatcactttgagaggctgaggcaggaggatccctttaggccaggagttcaagaccagcctgggcaacatagtgagagcagcattctgagactgttccaatggcaatgatagaactggttaattttttttccattttatattgttaatctatatattaaagattctacaaaaaaataaaaaattagctgggtaggttggtggacgcctgtagtcccagctactcaaggggctaaggtgggaggagtgcttgaacccaggaggtcgaggctccagtgagctatgttggtgccactacaccagagcctgagtgacaaaagtgagatcccatctctaaaagatggggaaaaatgtgcaaaagtttcaaaatccaacagaaaagtcttagcagcaacttttaatgttgggcaagcacaagggcatgatcactggggattgacaggaaacacgtctggcagtggacagctggactctcaagataagctgcaacagaggcatgttctgcattttagggcttgcccaggactggggacaagccagagttcaggaacctgtgggaggagagaggcctgatggaagtgtggtcaagacaatgaagagggtagggaatgggcaattatgaattcttggtcatggtaattaactctaacggactcccaagcttccctgcctatggtgctgggtgataaagcctccttcccactgaaacatactgccaccttccaaaactttcagatatgaagaacaaatctagtaggtaagaatataaagcagaaggcaagctaaagggaagaaaggatcatgaaaagaagggattgtacaaatctagttggcagggaggtgactggaaagcttaataggatgaaagtgggcatcattattttttatcaagctattatggcttacttaatgtgagttttactagtttaaatggttagtttcttgtcagagaacttcatgtaacagtttgattctaaatgctgtgtttgggtttctaatacatttctccttctatttcccttaaatcactcaaaaagccaaaagtcttttagctttccttaagacagtctataagccacgatgagaaagtcacttattcttgttctgagctccaaaattcattataaaatccattcacttttggttggattcctacctagagatcagatttaagattataaaaataattgtgttgctgtaaataggtttcttccctacagacttttctattcctattttctttttatttaaaagataatttactcttgcgtttttgtcagtttcctttttcttgttttatttctgctttacttgttatttcaaaataaagaattgaaggattgtattttttttttaaggcaactgaatttagatgacagatacttgttctaatggagtcactctaaccagcctataaattctaatccagtcatttaaaagaaaattctttccatgggaaaaattgcttttaaatggaactccagtgcccctgcgtgcctaatgagttatttggagcaacatcgctgcagttgtcaggcccaggttgttcatcagtagcccgagatgctagtagctgagcagtgtcgcaccctagggagttatcagggaaagcgtaggtgttcggggtgtctgggatccagagatgagtcagtcgctgtgggagtttctttggcaggtaattttattttccccatggctggagataattactgtgctaaagttctgtgcaaatatggtattaaaaggctatgaaaatcagggtaagcagcctttctttcattccaagtaaaagccagttgtggggaggggatagagtggtatgacagtccaaagaatctttttaaaaaacatattacttactatagattaacccaatttctattccgtgaagctgaacattatttgctttttgttacagttaattgtgtgaggaacacgccggcctttttagccgaaagactgcatcgagccttgaaggttggtctggaaagttcatgtgcattcttagcgtcccttaattcccttgggaaagtatgcaaatagtagaacaaatatttaaaaattagttattttaatgtaatttaaacattttaagataaattatattacagcaaatcaaggtatgatacaatacactctttacacagacacctgattttctcttcaaaataaacagacctgggtttatgaaataatttttttctaagtaggtataatttgatttctatttaactaaaacattctcattttctctaatatgatgagtttaagtagatgctaatattccacttgtatgaaagatgaaaattcatgtataatattaaattttaaaagttcatcctctattttaaatagaaaatgagaaggcaggccaggcgcggtggctcacgcctgtaatcccagcattttaggaggcccaggcgggtggatcacaaggtcaggagttcaagaccagcctggccagacggtgaaaccctgtctctactaaaaatacaaaaattagccgggcgtggtagcagatgcactgtaatcccagctactcgcgaggctgaggcagagaattgcttgaacccaggaggcagaggttgcagtgagcctagattgcgccactgcactccagtctgggcgacagagtgagactctgtctcaaaaaaaaaaaaaaaaaaagaaaatgagaaggtaaaaatatggcttaatgttgatagaatgtcatatttcttttccacttagattagttttctacagtagctaatttgtctactgatttgcctcataggttaatagtattctaacccatatagagataggtacagagaagtattgaccacattattttcactgcttcacagtaagtgcaggcagtaaaacttgttttagaatgccaaacctcaagcttgagacccagtagatcctgtggcctctcaaactgccttgcttaaaataaaccaagctgagttggcagcctttaatgatgccgtaaccctgtgtttgcttgtctgtctttactgccagatggtgcgctccatgagtacagactcctgtttatcctcagaccctagggccttgtgcacagaagatgcttacctccatctctttaccagccattttctgtggtcccacacgtaccttcaaagtcatatcctaagtgaacacatcctttccttcatctcgcccagccccacatctgctccccttcccctgttcagtcatcccagagaatggccccaacaggaatttgcccaactctctgaagtcgtaccattcctccccagacttcttgactatgcctcagccaccccaggcttctttccattcctcaactgtggcaagtctattctcacatcacagtctttgcatccattccttctctggaatgctcatcctctagatctttacctagctgactccttctcatctttcaggtttcagctctcctcctgagagaggtctcccctaactgtaccaggccaattggttccctttcagtcactctccatgccatttccagctttcttttcttcatatttctgatcactatttacttaagcaatagttaatttgctttgctgtctgtctccatctactagaacataagctccatgcagacagagatataatctgttctgttcaccgccattggcacagcacatggaataatgcctggctatagtcgatgctcataagcatttgctggatgaattacatagatgaatggaatatcatttagtatgttggccatcattaggtcaaaatccacctaactgctcagctagaaattttacactatctctctttttcattatcctgtagcgatacatcattatgttttgtcaatccatttacataagcaactctcaaatcttcccattttctccatccctactgcctttattctaaggatggccatcatcatctcttaattactcagtctcctcaagatgagtctcaaagcctctagtcttaactcccttatcttccttctactcctaccttgcaatctgtttctcatgctgcagtcaaagtgattttctgaaaccacgaatttgatctgatctcaacattctcatgtttaaaatattacaagagctctccacacttaggataaagtcagaatttcatttcatggttaacaaggtctggcctttccagacacatttctttttatccctctttgttaacttacgtatccttgaacgtggcgttctttattgccctaaaccttcacgcctgctatttcctctataggaagtttctctcctccctacatgaacctactccttcctcttgttgactgtttagtccttgcttaaatgtcactttctcagacttttcctaatccctaatctttcttaggcccccctgaagtatgctcccatggtacccaatattttcaacatgtcagactgttttgcaatggcttactttcttgcctgtattctttacaaaactggaagcttaacatgggtatctcatctctgctttgcagcatttagcatgatgctgtcacagagtaggtgctcaacaaatatttcttgaataatgaatgatgagtttgataataaatgaaaaagaatcactatagttgaatattttgcacaccattatctgattcttataaatatagatctctatgttgctttgtgaccaatgacatttgtgttgtgaacacctgcattccttaacagggtattggaactgatgagtttactctgaaccgaataatggtgtccagatcagaaattgaccttttggacattcgaacagagttcaagaagcattatggctattccctatattcagcaattaaagtaagtctacttttaaaaatagcaaaacatattttgcccttctctacccatctccttactcttatatgccttaaaatataaagatatttgacttagatttctctctccttgtcaatgtataaatgtgttgtctgagcttaaaatagtagcagcaaaatatcccttattttcagctctaaaatcccaggcatataatagacactcaatatttttttaggtgtactagccactaatttttcttcttttgtgaattacatatgcaagttgtttacctgttttttatattgcactgtttttatttatttcagtctttatgacaatgtaagaaaagaaaaatacgtattttaaatttcctctctgttttacatgagacagcatggttctgcagcttagagtgcttttcatttcagtatataggaaactttctcattttatttaacagctgtatatcattccattgtttgtatatttgtacccaccacaacaaacagaggcttccagtttattgctattgcaaacaatgttgtataatgcatacacaacttcatcaggtacgagtgtatctttgggatgaattctcagaagtaggatttctgagacagatataaatgcattttaaattttgacaaatattactaattgaattccattttgcaattccatgaggaatgtatgagaacttctttctccatagctttggcacagagggtattttcaaacttttaggtttttaaaacattttttagagatggggtcttgctgtgttgcccaggctgaagtgctgtggctgttcacaggtgcgatcataatacattgtagcctagaactcctgggctcgagcagtcctcttgccttagcctccaagtagctgggactataggtaaacttttgggttttcataatctgataggtgaggaattgtatctcagtgtagttgtaatatacatttttcttagtataagtaaggctgaatatattttcatgtttgaaataacatttgtatttctctttctgtgatctgtctttttacattctttgtccacattcttttgggtttttgttctttttggtcagtttctaagacgtttttcacataaggtagattagccttttgtctggtcatattttcccagtccgttctttgtcctttgacttggccaaaagtatttttttccaagcagaggttgcacatcttatttaattaaatttatcaatctttcacagtattttagtttttaaaaaatctggtcccttctgtttctttcattctggatgagaatcttcctaaaatgggctccttcctttctcttttaaagcatgaaacccattttcattgttttcagatctcagttgatatattatacatagaaacttcaaataaattacaaattatttgaattaatagggcagtaagcctgacaaaaattgtacaagaggcttctgtaccttaagctcatggttcaaaagtcatagtcccaacaggaagatggcaactagttagtggagaactaaggggctagccccacacctgctcagtagccttccattgatttacttttctaccttgatgctccagaccacatatgaaagtctctagtaaatgagtgatagagagtgttagtccaagctggttccctggaacaaagtggaagctggggttggtgagtggagcaatccactgtccttgcctccaaggccacactgaccaggggaaaagacagagtcagggctgccttcgcagaggacttgcaggctatgcagacctctccgtctctttgctactccatctacccttgaatgtctcgaggaaatcagcactagagagtattggacccaggtgaactctccaaggtctaagctgagacttggggcctagaaggtgatccaggatgaagagggaagcagcagccaagcagagtgtttgctctgagtgctgagggtctaaaactgggaatggagtccatgctgattagaccccctaagctgtggatcattatgcaccatgcacatcctgatcctgggtagcagcaccctctctcaagcccctacaaggctggagcactacctctgtgggggagcttacactcagcgatgtcccctggggacacctggcttagaccacattccagtgtccctgccagcagctggagtctttggtccaaccttcgctatggccctacccacaatagccacccttgaacaggcacaaatattagcctgggtctttctgcagctatcttgggaaggtttctgcctctgactttacaaatggcctttgaatgaatgaatgaatgaatgaacatcaatcagtcaactagattcattcactaaaatctctctctctctctttttaatcagagtttttgtttttgcactaaacttttacagaaagagagctgagatgcatgcataagttgaaatcaggaacttactcaaaaaggcaattctcagactgtgcctgggacttagcacaaattgcatcaactgctcacactcaattctatttgaatcagtcctgacacatcacaatagtttcaatcatcagaggaagattcaataacattaaccatgttgtagctactaaggcagaaaaatagactcacacattttctaaagattgtcagtaacaaggttgagacataaagagggctttcagttcaccctcagcaaaccagaaaattaaattaaccagtggctctccgttccccagtggtctgggtaattgaggcttattgtattagaaaacatttaaactatttgtagtttgatagaaaagaaaaatccatcactgaaaacttcagtttgcagtttgaaatagtacaagatttctttatttctaccacctaacacatattattaagtaatctcattacatttttgctattgaagaacaggatctttttagatggttgtttctgaaattcatgggatagagttccattttgcatatcatctcagcctgtcatcctgcctgttttcttccttccacctattgtttagacatttctttgtccattgacacctttctcagggggtaaccggtgggaaggagaaggcaaggaagaacagaggtgaaaaaccaatgtgtacctcttactactttataagaagatattatggaaaatttagatgaaattatattttttggtagttttccttcatagacaaattctgtatttatttaataaatagcacaattccaagctttttatgggaaaatatagtagccactcacaatcaactcataatctatgtggagacttgaggtaggtatgaagaaacaattagaagataataattgaaacaacagacaattaaatactagattgttgaatatagagctagtactatcggaattgagaagaaaagaagtttggggttagagaaatgggtcttgagcctgcctttcaggtcaacaagcatgtgttgagtgtctcctgtgggccaggtgctctgctggagcatttacctttaagaccccagatcaatagggtcttaaaagtaaatgctctagagacagatatgggaagaagcaagagggaaagaagtaataaggcatttgtttgattagagggtctaccttggggaatattgagaaataaaatccaagtagcaagatgagttcagttgaaagagagctttgagatcagcgaattcactcattcaattaaaaatattatcaaatgcatattatgtgctaggctcagggttacaattataagcaaagggggtagggtgggggaagacattttctgcccttatggaattacaactatgttaaatgtaaaggaaagtgacattgtgctaaaagatcctacaatagtaggacttgacttagaggaaaggcttctatgagaaagtcatgattcagatctggaaaataagtagatattaataaggcaaaatgtatggaggtaagggagccagtagaacattctaataaaagaaatgacaaatggaaaggcctcatggtggaggaagcataatgaaaaatgaggatgtgggggccagatcatgcaggacctttttggcaatgtttaaggaattttggctttagcttaagagtaaggggaagccattgaagagttctgggcatgagctcttgaagagttagtatcaggatcatgaaaagatccctgtaagatcttcttattctggagaataagaagggctcaaaagatatttaggagttgaaacttaagggacttggtataatatcttggtgtgaggaaaggaagatagcaaggatgacactcaagttcctaacttggaaaacagacagtggcgccattccttgcaagaggatcaggttttaggttgtttgtttgtttgtttgtttccttttcttttgggggagtggggggaggtttatgagtttggttttacatgtattgagtttgagatgtctttgagccatgtaagacatgtggagaggtcaagtaagtcattagcggtgtaaatatactttgagttacttggatgtattttcttgactaactggtagaacgcctaattgtttacaactctgatcagagatgtctagaaggagctcttttaatacaaagctggagcattgttgacttgtcagctctgctattgcagagcaagacaggaaaaccaatagcataagaactaaaatctatataaaaacgaagaatattgtcatatattttgtgaaacagacaaatgaacaagaaataaagaaaacagaaaaatatatataaaggcctattgtgtcttactatgaaagtaatgcttaacttcttcactaaatgagccttctctgagacttcctttatattaccactttctctaatattcaccccagtaacagccattccaaatgtgaaacttaagtgataagaagagctcactggttgggttacctcaaataaaataaaaataatgtgagcatcttacacaatccaggttgaaagccaagttttacctcctgtgaagtcttttgcgttacaaacttggtatctttgccctttaagcctcaacctcacgtagtatcttttctggacaacagtctatttttggttggccttgggaaaaggaactgataaacatattctttaaaaatgtggttcatttcactttcctaagttaggcagtgtagcagggtattaaggagccaggatatagggattcaaatcctgcttttgtcacttattctcgataagatttgaggcaagtttcctaacctgtctttctcattttacttatctgttaaatgggggatacgtatagtacctattgcagagagcttttaaaagggttaaagtagttaatacacattaagccttttgaatagcaagtgttcgataaatattattaaaactaaaatttgaagtttttatagaaatcaatattatgtaagtgatgcaatcttattttattaaaccaaaattgaaatttaactgcagtatatcaggaagaatctaaatattacttacagtgaagaagatgctggtcagaacgtaattacactcaggtatgaatgaatgatggaattgcaggtatgttttactaaatggtatagctcatgagtctcacacccaggtgaattccctagtgctataggatttgattcatttatggtctcccattatttatactgtatttgttcttcattgattttattctttgcagtcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaatttctttgtttgctttcagagcttgccaacattgtttgatgcctggtgccaacaactaatattttaaaacatgtttctgtatagaagctgttactgcttcagtttatcaccttgttaatcacacttttttgaaagaaaggaataagatgaagatgtatgtgaccctggcctaccctttgtagttgtgatcaagctataggagtggtaatgcatgataagttatttcagctttcagaaaacatctgctgaaggattaatctaaccacttcctgtctgaatggcaagcatgaattatggttgcttcatgctaaatactactttcccagaatgggcatttagaatcaagcctctaaggtttccttttctcttgagttggcaaaactatgcatttaaagaatccatcatgccatctttgagtgggacctaatatgaaataccttgactgatatgaaatagataaagtgaaaaaaattccagttagagttattttcctggaccagaatagaaatgatcgtactggccatgtgcagtggctcacgcctgtaatctcagcactttgggaggttagcaggcggactgcttgagcccaggagtttgagaccagcctgggcaacctagtgagaccctgtctctgccaaaaatacaaaaattagcctggcatggtggcacatgcctgtggtccaagctacttgggaggctgaggtgggaggattgcttgagtcaggaagctcatttggcaagttagttctgtaatcaatactataaatgtcagtcataactaagatgatggcaggagataatgaaaacaactacttaaatatttgggagataaaattgagtaaacatggtattcaaagttaccaagtgtcagtcaagtatgccttcacgattttagtgtaagtgatttagtgagtaagtatatcacgaagcaataaatcaatgttaatactcatagagtgcttactatgtattaggtactatgttaaacagtgtagtatattttaatttgttaatcctcaaggcatcttacaatgtagataccaacacagatatagaaatggaaatggaagcttagagaaattaagtaacttgtcactgtaagagccaggtagtccaactccagtgtccaggctcttaaccactgttttgccttagaatttatcccatcccagggccactgtagttttcaatgcctagtgcttagattagaacagtgctcagcacataaaaggcatttaatacagtgaatctttattttagatctcattcatcctcagagttgttataccacttatgtattaagtactttctgaaacaaagcatggttacatgtgtcaatatttcccctgttttgcaagtgaggaaaatgagactcaggttaggtatccagcccagggttacacagtggcaaagccaaggcttaagatccgggtcatctggactttaaaacttatctgtggctgggcaaagtggctcacacctctaatcccagcatgttgggaggctgagacagaaggatcacttgagcccaggggtttgagaccagtccaggaaacatcaggagactctgtctctacgaaaaatttaaaaattagctgggtgtggtagtgtgcacctatagtctcagctactcaagagactgaagtgggatgatcagttgagcccaggagtttgaggctgcagtaagctatgatcacaccaccgtactgcagcctgggtgacagagcaagaccccgtctcaaaaacaaaacaaaacaaaaaaaccttacctgtgcatgagtgagtttgaagaaggtgagaacttgaacacagtagtgatcacacaagagaattctgcagaaaaaaaaaaagccccaatgaggtaaccctctaacccttctactcacatctgttttgccttgtatgcattggacttcaggcaattacctttctaagccacatattcctcgtctttaaaatgggacaacaatagtacctacct

SEQ ID NO: 13824 - DNA, 7765 bp, Human; identical to SEQ ID NO: 12771

SEQ ID NO: 13825 - DNA, 38052 bp, Human
  misc_feature (1)...(38052): n = A,T,C or G
aatagtaacacaatcctgtttctacataataccttctctattaacaatcctgtagatggccagaatgtgtaagtctttaataacctctgtcctctacaactggctttcaaactcagttcttactgaaattgtttttttttggtttgtttgttttctttttttcagtctcccaagtagctgggagtacaggcgttcacaaccatgcccagctaatttttgtattgttagtagagacagggtttcaccatgttggcctggctggtatcaaactcctgacctcaggtgatctgcccgccttggcctcccaaagtgctaggattacaggcatgagccaccgcatctggctgaaattgtttcctaaagcatcacttgttcgccaaatccagtattttcagtctttatcctttggttccctgtgagatataaatagattattgaagcttctaggcctcttgcatgaaggggccttaaaatgttatacggttgaatatgattataaagttgcaaaagtaaaatagttttgcgctcttgttcttaagcttcaggcccaacaaaactgaatctacccccatataaaagaagttcatcagattctcttatagcctatagaggtaccaaatgggacagggcttctcgcaacttggacacagctaaggacagagctaattgctacactaagagtcacatcttgaattgaccaaataattctattctttccataactaggcctcaggtctggttctcaatattacaggttcaggaactagattttaagcagtttgaccaaggtaattaaccactgggagattaatgcaaactaaccaaactcacaaaagactataaaaagaatgtctatttcttaatgtacaagaaggaatcaataccttaacattaatgattaataccttaatattgactagggtatatggtagacatttgtctatccaggacactctattccctaaatcaaagtagtttcgagaccaaaatgatcatgaacatttagttatcatgattgaaagtgttattttactggccttatggcctcctcgctgcctcagattctttgaaaatggggtaagctctgttcctgtgtgatttaagcctgtgcatgattctgacctaccagtcttgctcagtcgtggattgagctgcatttttgcatttaaggcaagttttatcgcaagccctaactccaccccatttggctgccatacgcgggtgttgtgcgtgtcctccagatccccagccatcccagcgctttcccattccactcatgccctctcttccccttcctccatctcagtgttttccctcactttcaatggccagactggccttcccaaggtccctcctaacgtcaggtctgtcatcacctaccttcttccaccttgcctcgcctactaatcatcacctcctaaactgtcaccgttatctcctacctggctcacactggccccaccgcccagaacagaaaggaagcatggaatcccggtcaggccgcgcctacgcgactcagggcgcccggcgcccgcccctgccccagcggcgatgctatgagggaaaccgtatcgcattttgcatagtcttcgcagtcctacataaccgccacctttacccttcgcgtgggcatcacaatcgcctcctcccgctggggaaggcagaaaggcgcctcctgacgagaaccaaggcgtgtggggacgcagggcctctgcgtgtcagggagcagaacctgggccgagccctaggtgaaggggcggggtggttggccctgagccaatcatggctcgtgacgactcggctcggccaatcagaagaagggaggcctggcgctctcggggcgggtgagaaaccgcccccccttgcagctccgcggccaacgccttcgcccaggggtagttggagcggtgcaggttcccaggctccaggtactgggcgccttacgagctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcggcggaccgaggcccacctgcctccctgcctgcttcgccctggactcgtgactgcgtccgcagaagaaatcacaacagcgctggaattgctagtttgctaggcagcatcttttggacctgcgaaccatatgcatttcacctcaaatttgtttccaagttgaaaacctttgggtctttctatgcgaacggattgaagaaacggtaagtatagtacgttttaaagcttctattatctcgttctttgatctaaaaaaaaatccaaacctttttttttttttttttttttttttttttttttttttttgagacggagtttcactcttgttgcccaggctggagtgcaatggcatggtctcggctcaccgcaacctctgcctcctgggttcaagcgattatcctgcctcagcctcccaagtagctgggattacaggcatcaccaccacgcccggctaagtttgtatttttagtagagacagggtttctccatgttggttaggctggtctcgaactcgcaacctcaggtgatccgcccgcctcggcctcccaaagtgttgggattacaggcgtgagccaccgctcccggccctttaatctgtcttaaacaaaataaaaaattagcattctccaaatatttttatcaaaattgttgcttttagaaccatccagaaataacaccttgcccattggccaggtttctttttcgtttgtattacctttccgttcaagagtagaaggcatgagaagttatagtttatgagtaactgtttcaggaaacaagaggctttgtaggctgtgatacttttaaagtatttgtggacagtgtcacttgaaaaagcaggtgtgttcaatgtggtgtgtccagatatgcaattggttgggagaataaacttgaagcagtcaacttgcattaatgttagcttgggatatgcttcagaacacctcagacatgcttaaagtcattttttttggttcactttgtgctttcaaatattgaggacatcaattacaaaatgttttaaaataatccaggttatagattcaagctatttttgtcattggtatgataaacctaaagcctagtgcttaataaaacatactctcttaatggaagagaaaaaaattaagaagggatagaattatatggagattttttttttcaaatacaaacagtttattaaaaaatagttaatggaagtggaatagaaggtaaaatgtcaaatgcatggaaagttagtgtctgggacactgctctgtaaaaagtttgtagtagaatctactatgaaaactggtagtaaaataataatttaagtcgatgttcattggtattgttttcatttcccacccctcaagatcaatcttctggttctccacatatagctacattaaaaatatatatattataaaatctcaaactattatatgtcaagtgtggaaaacgtattgtatacattggattagcatagtttgctagaacaaagagaatatttgttttgtctttgcatcactgttccaatagagaaataggaaaaacagttcacgatctgagtaaattttagattgccgtaagtatacaattaatacaacaggcaagaattatttcttgttaaaatctatctgtatttggactgaaataattttttatctattattactgaaataatagatagttaaaatctatctgtatttggactgaaataatttttttctgtacgaaagcattttgtccaatgattgctggaccttcgtcaatcattggtaaaacaagaaagattctcttaggattgcctttattcagaaaatgtcatataatatgagtaaaaaatttcaaggccgggcgcggtggctcacgcctgtaatcccagaactttcggaggccgaggcgggcagatcacgaggtcaggagatcgatacaatcctggctaacacggtgaaaccccgtctctactaaaaatacaaaaagttagctgggcgtggtggcaggcgcctgtagtcccagctactcgagaggttgaggcaggagaatggcgtggacccgggaggcggagtttgcagtgagccaagatcgcgccactgcactccagcctgggcgacagagcaagactccgtctcaaaaaaaaaaaaaaaatttcaaacacaaattcaaattatacttatagtgagtaatcattaacagggtttttgaaatacttttactgtacttggtactactaatatttaatttaatttaataattacattaaatttaataaaatttaatttaattttaaaaatctgcttatataccgatgtcattactcttattttctaagttcaatatagtaacagtaacatggcgaaaccccgtctctactaaaagtacaaaaattagctgggcgtggtagcggtgcctgtaaccctagctactggggaggcagaaacagggaatcgcttgaacctgggaggcagaggttgcagtgagccgagatcgcgccagtgcacgagactccgtttcaaaaaaaaaaaaaaaaaaaagaaaaaaaaagtaaagaaaaatattttatgaaagatgctctgtgttaatttgttatgtgatcaaatattttttccaattaagtggaaggtgcataagtatttccaacattgatctaaatccagtgtaacaaaaaagttgatctttattaaaactaaattcaggccgggcgctctggctcacgcctgcaatcccagcactttgggaggccaaggtgggtggatcacttgaggtcaggagtttgagatcagcctgggcaacatggcaaaaccccatctctatgaaaatacaaaacttacccgggtgtggtggctcacgcctataatcccagctactcagaggcggaggcaggagaattgcttgaacccaggaggtggaggttgccgtgagcctaaatctcaccactgcactccagcctgggcaacagagcaagactccgtcccaaacaaacaaacaaacaaacaaacaaaatcccccaccaaattcagttatannnnnnnnnnnnnnnnnnnnctgtcacccaggctggagtgcaatagtgctatcttggctcactgcaacctccgcctcctgggttcaagggattctcctgccttagcctcccgagtagctgggactataggggtgcaccaccatgcctggctaatttttgtattttagtagagacagggtttcaccatgttggccaggctggtctcaaactcctgacctcaggtgatctgcccgcctccgccttctaaagtgctgggattacaggtgtgagccactgcacctggcctgtgcattttgtttatttgttttgttttgtttttgagacagattcttgctccgttgctcaggctggtgtgcagtgccatcacagctcactgcagcctcaacctcctgggctcaagcaattctcctgcctcagcctcccaagtagctgggaccacaggcatacaccaccacacccagctaatttaaaaatgtcttttgtagagacagagtctcagtatgttgcccaggctggaattgtgcttttttttttttttttgagatggagtctcactctgttgcccaggctggagtgcagtggtgtgatcttggctcactgcaagctccgcctcccgggttcacgccattctcctgcctcagcctcccgagtagctgggactacaggcgcctgccaccaagtccggctaatttttctgtatttttagtagagacggggtttcaccgtgttagccaggatggtctcaatctcccgaccttgtgatccgcccaccttggcctcccaaagtgttgggattacaggcgtgagccactgcgcccggtctggaattgtgctttttaaagtgagttgtaattgttatgtgtgatagctcaagtattgctttattggaattaaaaatatatggaatttcattaacatgacatttagtaatttaaagttaatggcttcaattccatttgcgttgtctattatgaaatgtgtgtgaccattttgaaaacatagcttaatgtgtgtgaccattttgaaacatagcttacatgtagaaacactaggaaattgtgaattaatacaggacagccatgaacacagtgactaatatggaaaacaagcagggaagaattaatttgctgggaaggcggaggaaattaacgtactcaactttgttaaatctatgttttggttttcacagcaaaaagtttctacggactttaaattaaaatggaaaaatatgaaaacctgggtttggttggagaagggagttatggaatggtgatgaagtgtaggaataaagatactggaagaattgtggccataaagaagttcttagaaagtgacgatgacaaaatggttaaaaagattgcaatgcgagaaatcaagttactaaaggtgagtaaatgcatatattgaatcaaaaaatatgagtataagtttcttttttggcaataagaagaaatacaatgattagatatgcaaattcatttatctggtgaatgtaaacctgattttaaaagtgtttgttccttctctctgtatctttctgtgtatttatcaatcatctatctatagtctgtgttaggagtcccaaagaccaccccagatttgatgacttgttaggaggaatagcattaatttttgttctttattatttcattttttctacttatttgtatgggtttattttgcagccctttttcctaatttgttgagatagatgcttctctaatttccagacttttttcccctcaaatatgcatttaaggatatacattttcctgtaggaacagcttggtatgtatcctggaaattttgattgttaacaatattttctcatttctcttatatttttcttaatccctgagttatttaaaagtatatttctgtatttccaatcatggacattttctaggttattctttcctggttatttatttgtgagacaactgccctatgttctgagtatacaccatataagaatttatttctttgaaatttcttgatatttgctttttgttcagaatatagtcaactaaaaaaaaccctcttgttcttgaaacgtatttcatatatgttcatgttaattgtgttgttcaaatcttccaaattcttatttattttccttacatgcttgttttatccaacactgagaagaaatatgttaaagtcttcctttgtgattattgatttttctacttttcattgtagttcagttaatgtttatttttataaacagaaacagtattattagtgtgttatatttagaattattatatcttgctgttgagttaaatcttttgttattatgcaataaccctttttattatagtaatattttgtttcgttggttttttttgagacggagtctcactctgttaccaggctggagtgcaatggtgctatctcagttcactacaacctcctcctcccgggttcaagtgatgcccctgcctcagcctcccaagcagctgggactacaggtgtgcatcaccatgcctggataatttttttttttttttgtattttagtagagacggagttgcaccatgttgattgggatggtctcgatctcctgacctcatgatccgcccacctcagcctcccaaagtgctgggattacaggtgtgagccaccacacccggtcgtttcattttgtttttttgagacagggtcttgctctgtcctccaggctggagtgcagtggcatgatcatggctcactgcagccttgaactcctgggctcaagcaatcctacacctcagtctcccaagtagctgggattgcaggtgtgtgccgctatgcctggctaatttttttattttcagtagagataaggtctcactgtgttgctcaggctggtctctaactcctgagctaaagtaatcctcctacctcggcctttcaaagtgttcagattataggtgtgagccaccacacctggccagtattttgttttaagatctaatttatttgaaattaataagagtacatgcattagcttaattttggttagcgtttccatagtaaatcttttccatatttttacttctaatttttctgaattcttttttttttttttttgagatggagtttcacacttgtcatctaggctggagtgcagtggcgtaatcttggctcactgcaacctctgcctcctgggttcaagcaattctgcctcagcctcctgagtagctggtactataggcgcccgccaccacgcctggctaatttttgtatttttagtagggatggggtttcaccatgttggccaggctggtctcaaactcctgacctcaggttatccgcctgcctcagccttccaaagtgctgagattacaggtgtaagccaccgcgcctggccccctaatttttctgaattcttgtttagatgtatctcttgtgaaaaccgtatagttatattttgcttttttcctgtttgataatatttcccttttaattggagcatttattccatttacttgtaatataatatctgatgtattttgaatatatatatctaccaccttaatatgtgctatttgtattaccagttctctatttctttgtcttttgttacttggattgattacatttatcattcctttttttctaataacttggaaattttacattgtgtttctgtcttttagtggttacactagggatttgttaaagtctaattatctaatacttgttcttgatcttaataatggtgtttgacacagtcaaatcttatgacttttcccttatggctatccagttgtcccagaaacatttattgaaaataccatctttttccccactgttctgaatattccttttgccacacgttctcctatataggtaagattttattctgtcccattggtctatttgtttaagcttgcgccagtagcccacaatcatgtttattctagttagtaggtttttttttgagacagggttttgctgtatcacccgggctgcagtgcagtggcatgatcttgactcattgcaatctctgcctcccaggctcaagtgattctcccacttcagccttctgagtagctgggcctacaggcgtgtgccaccatgcttagctaatatttgtatttttttgggtaaagatagggtttttccatgttgcccaggctagtcttgagctgcttggctcaagcaatccgccctcctcagccttccaaagtgctgggattacaggtgtgagccactgcagctggcctagtttgtaagtttttatatctggtagaataaatccttctgttttgtccttcttctataagaccatcttccctatttttgtctgtttgcatttccatataaattttagaatcaatttaccaatgttcataaacactctaggaatttattgaatttatacaatcaatttgtggagaattgatgtgtttacaatattgcatccagttcatgaacattgtataatccttttgtttcttggtcttcttgtctggtttttttttttttttttttttttttttttgatggagtcttgctctgtcacccaggctggagtacaggggtgcaatctcgtctcgctgcaacttctacccgctgggttcaagcaattctcctgcctcagcctcccaagtagctgggattacaggtgcccgccaccacacctggctaatttttgtattttagtagagacggggtttcaccatgtcggccaggctggtctcaaactcctgacctcgtgatccagccactttggcttcccaaagtgttgggattacaggcatgagccaccaggcctggccagtcttcttgtcttaacatacacttcgtcattagtatgtttgcacttttgatcattatttatatgatatatactttttaatcctttctcctattaaccttctgtgtcgttagatgtaaagtatatctcttataagcagatacagttatttcttttgtttattcagtctgacaatctttgtattttacttggagtgtttggtctatttatatttaatataaaacttacatatttggatttatacttctcttcctagttgccttccatatatctaggttttttctttttaaaaattattttgttaaacattcttttgctggtgttttagagattgttctagatattttaatatacaaacttgacttattgatactcaaacaggtacttttacatgcaaaaatcttagaaattttaacttcagttaccccctcctttctcccctccacccatcagatatatgtgttattgctgctatgtaacattgttaaattctgtgtatagttaaatcccttttaaaattgttcacagtcagcagttattaggatatacctaatattaccctttctattactctttaattttccctacatttctgagtttccatctggggtcaatttccttatgcttaaagcacttcctttattttccttaaagcaaatctgatgataagaaattctattcatttttgttagtgtaaaaaaaagtatgtattctactttgtgtttaaaatactatttcaagctcggtgcgatagcgtgggcctatagtctttgctattcaggaggctgaggtgggaggatcacttgagcccaggagtttgagactgtggtgtgctatgatcatgcctgtgaatagccactgcactccagcctgggcactgtagtgagatctcatcgcttcaaaaaaaaagaaaaaaaggccgttttctcaggatatagcattcagggttgtcagttaattacattcagtatgttcaagatagaatcctactgttctgggctccgttgcttgtattgaaaaaatcagacatcagtcttactgtgttccttaataaccattttcttctagatacttttaaggttttctctttggttttcaggagtttacaataatatgcctaggtgtgggtttttttttttttttgtctgttaattttatggctcttgcttctatcaaataatgtcatttgtcattttaaaaaaatgctgggcatggtggctcatgtctgttaatctcagcactttgggaggccaaggtgggcggatcacttgaggtcaggggttcgagaccagcctggccaacgtggtgaaaccctgtccttactaaaaatacaaaaattagctgggcatgttggtgcgcgcctatagtcccagctactcaggaggctgaggcaggagaatctcttgaacctcgcaggcagaggttgaagtaaaccaagatcatgccactgcactccagccttggcaacagagtaagactccatctcaaaaaaaaaaaaaatgctcagctataattgttgcttcacatactgctactgtcccatttaagaattcagcttcatatactaagattcatatcagctactactgatagcttgaggacttttagggctaacccaaatgaaaggatttcaccagcactgtactccttcttttcaccttcacggcccctgaacgtcaatcactgctaccttaggcctgcaaaatggtgaaaagtgctactgatcctcttagtcttccctctaaagtggcatatgtttcttgggttaaaaaaaatttggccctaattgcctggctcacttttctgggtttctgtcttcctagcccaggtattttttactatattatctttttcgttcctccaagtagttatgttatatattttgtccagcttttctacttgtattcagttggagaattgttacaaattaccaagtctactgttactgtgaacaaaagtaattatacttttctatcctagaatttttatttgggtccacatctgttatgttacttttcatggttttaagttccctccattttttgaggttggctttcttttttaaagagtagtagtccatatctgataattacaatatctgaagtcattctgtatctgtttcaatcgccgatatgttctggtatttcttacttatggtgtcttatttcattgtgtgcctgcttatcttcaattttgtgctgaaccttatctttgaaatactattattatcattattattattttttagacagggtcttgctctgtcacccaggctggagtgcagtggtgcaattatggctcacttcagcctcaatcttccagattcaagcagtcctcctgcctcagcttcctaagtagctttgaagcttggactacaggcatgtgccaccatgcccagctaatttttttaattttttgtggagacagggtctcagaatgttgcccagactagtctcaaactactgagctcaagcaatttttctgcctcaacctacccaaatgctagaatcataggcgggagccaccacgcctgtcctgaaagattactttttaaaaataatttgaggctaaggtaaaaatatttttctccacagacaatttttatttcattcttccatgttcatgggcactgtgccagtaatcaatttattgtctctcaactccaaatcactccttttttttacctactttgtgatattagaactggactctgtaaacatttcttttttattgcccgctgatttgattttaggttttgtcaacagatagagggcatggaaagacattgtcggtccttagcaagaggaagagacttttcttccagcttctggtgtgctttttttttttttttttttttttttatacagctgtgagcccatcaccatgtgggaggtctgttagctcacttcagcatctttcaagtaccagttctggcctacctgcacattctggtgagtttctctaccaactgctggccactctacaaaccatctctggcctgtgtgctctggtgaattttttcactattggcaatctttagatttttgtggctgctgggccatttccaatgaggactatgtgtctggtggttattgggggctcttctacatttttagttccttcttgtccctatgtattttccttcagccctaaaagtggggcttcctgtatttgctagtttaaacatatcccttacagtcttcttttaccccctttagtaattaactacccttcataatgaaaaatatttacattaaaattttcccagttctggtttctgtctgatacaagcacactaccagctcaggacctccttagtaagttcaaagttcttgcttatagtctctttttatcttgtgtttctcattatcctttagaattgaatgttgtttttgaaattttatttgtagaaatattttgaggctaaggtagggttttctttgtccagaggtgatattcatttgcttctgacaggtacatggagatgctcccagtccagtatgtgaatccatgttcaaggcttttagttccttgaacgtgatgttaaattaagtctagtgatgcctcgtttatttctgttcattttcactctggaggatgtagttttttgggtcctagctttaattggaggtggtttctcagatatcccacctttagaaggcttttggactttggcttttcccttttagccctggggagccacaaaaatcaaagctcatttccacacttgttacttgatgtcaaaattagctttgagtcccgaggttaactctctggattctcatgttcttgattttagcccagtaatcctcactgtcgttttagccttttatatgtttaagaagattttttgaaaattaatccaacttttaaagaattttcaatggctgggcgcggcaactcacgcttgtaatcccagcactttgggaggccaaggcgggcggatcccctaaggttgggagttccagaccagcctgaccaacacggagaaaccccgtcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtagagacagggattcaccattttggccaggctgatcttgaactcctgacctcgtgatccgtccgccttggcatccccaaaaggtgctgggattacaggcatgagccaccatgcccggccgatagtctgttttaattatgattgcaggtttggagctactgtggaaatctttgcaagaaggacttgacatagagtagagaaagataaattatctggtgctatagtgtgaatttttaaagagtaaaaagttttagtgtaatgttttcttctattagaaatgtgccaaaacagcccaatggaacaagtgacattctagtattatttagatttcttaatttgataaaatagaacttgtcagaatttatagttccattaggatatgaaatttgtgggttttggggcatttttgttggtttgtttagtttttttggtttttttgagaaggtgttttaatcatgcctctaccagttattgctgtgtgaccttggacaagttccttgacctctgtgtgagttagttgcttcagctataaagcaggataataattgtacctatttcataaggcttttgtgcttagaatagtacctggaacatagtaagcattgtgtaagtattagttattattatgtataatatcatactcttttataacttttatttttttcttggcaacgcttcttttacattgtaaaatgtctgttttaagggaaggcagggtagaagtttgtgtttttttttaacttttaagttcaggggtacatgtgcaggatgtacaggtttgttacataggtaaacatgtgtcatggggtttgatgacttggagctctttccaaatggactagactaccaactagttcaaaagtacttgtttcagattattaataatggaattggattttgtcgcagtcacgatgtaagtcttgggtttaaacaattatttgtcagtcatttttcctggtcctctcccttctcccaccctttgccctccggtaggccccagtgtgtgttgttcccctctatgtgcactcatcatttagctcccacttataagtgacaacatgtggtatttggttttctgttcctattagtttgctgaggataatggcttctagctccatccatgtccctgcaaaggacatgatctcattcttttttatggctgcataatattctatgatgtataagtataactctttaaaaaacatttttctatatgatttttgaattcctttttttttttttttttggagatggagtcttgctctgtcacccaggctggagtgcagtggtgcaatcttagctcactgcaacttccgcctcctgggttcaagcgattctcctgcctcagcctccttagaaactgggattacttcattgatattacttcattacttcatggtggtggccaggcatgccaccacgcctgggtaatttttttgtatttttggtagagatggggttttgccatgttggccaggttggtcttgaactcctgacctcaggtgatccacctgcctcagcctcccaaagtgctgggattacaggtgtgagccactgtgcccggcccctgaattccttatattatttttatatttatattggatatgtttccttggtaatcttttttcattttttaattttttaagagagtctcactctgccccacccaggctggaatgcagtggcatgatcatagcttattgcagcctacaattcctggcctcaagctatccctccacttcagcctcccaaagcgctgggattacaggcataagctaccatgcctagccatattgcttaccttgataactatagtgttaaataacatagttacttctttgtaaattaattattctatttctatttcattttctctcccactcacctaccatctgattttagaaaatatcttatttactttagtgttttgttttttcattttgtttcaagataaggtcttgctctgttgctcgagctgaagtgcagtggcatgatcatggctcaccacactcattgcagcctccaactcgtgggcttaagtgattctcccacattaacctcccaagtagctgggactagaggtgtgcccaaccacaccaggctaatttttaaaattttttgtagagatggggtctcaccatgcccaggctggtctcaaattcctggcctcaagtgattctcttgctttgtcctcccaagtcactgggattacaggtgtgagccactgcacctggtgtatatatacacttttatcttgtttacatcttctatatcatttgtgcattgttgcatttaaaatgttcactttctgtttcataaccatgatgcccacatttgtataagatttagtcctgccttaaatggattcaatgctcatgttgtttttacttgaatgctcattcatgcttttacttgaatgacagtttggttgggtataaagttcctggatcatacttggattttcttgaggattttgagagctgtattctgcattccattggtttctttccctttaaaggtggcaacatttttttctggtgagtgttaatctaccatttatgtttctttctcctttcttccccatttcttacatctttgaatagatccttgattggttcctttttgattgtttcttataataaagtctgagtctttggaggactatttgtaggaggttctggggagaggccatgactttgttccaggctagcaggaatttaccataattcacaatggtgttccttatcacatatgcctcagtgtgggatttaattctattaggtttaatttctctaaaacttgcagttgcaggcttgttcataatgaattgttttgccttctacactgcctcactgagagattgtttccagcaaatgtgtttctgtgtgattccttatccagcccttccccaatgctgtttcttggtgccattcagttctagggatgttttcactgctgtctatgagccttatttcatatatatatagtgtatatatatatatgaatatacatatatatatatactatatatatgtatacatagttttccattatattaaaggaggacttttttgtcttttcagggtatgtcactggcttcagagaactcttacgcttccagctttgtagccacagatgatcttttggtgccttcctatactcctgtttgaccttgattagatttagtagtcccatctcatttgttgtgagtagggggtcatagatccctcttagttttagcaaagatggagttacacttatttttcttattagctttattttgttctctgagaggagaaaggagcaatatagtctctcaattgtagtttaaaaaccagaatatgcttttacaatttacactatgtatgcattttatttatatatttttcttacgctgagatctattttaaataattaattgctaataatttgatcttagtttatataaactattttgcatttttaaataacagctattttgcattttttaataacagcaacttaggcatgaaaacttggtgaatctcttggaagtgtgtaagaaaaaaaaacgatggtacctagtctttgaatttgttgaccacacaattcttgatgacttggagctctttccaaatggactagactaccaagtagttcaaaagtatttgtttcagattattaatggaattggattttgtcacagtcacaatgtaagtattgggtttaaataatttgctttatcacatatttattcattaatcctttaatctgtcttattgatttatgcatttgaaaataagttgcagacatcagtatactttaacactaaatacttcatctgtgcatctattaattggagttaaatatttgttttctgagttttttgtttgtttgttttgtttttttccgagacagagtctcgctctttcgcccaggctggagtgcagtggcaagatctcagctcactgcaacctctgccccccaggttcaagtgattctcttgcctcagcctcctgagtagctgggattacaggcatgcaccactacgcctggctaatttttgtattcttagtagagatggggtttcaccatgttggccaggctggtctcaaaactcctgacctcaggtgatctgcctgccttggcctcccaaagtgctgggattacagccatgagccaccgtgcctggctctattttctgttcttttttaaggtaatatttactaagcgaaatgcacaaattttaagtgatgaattttgagaaatgtatagacccaagggtctgtgtatttgttagtttgtgttctcttgcctaattacaaagtgtgaatgtttgaaaatttctacccttaccctgtagtctatcacaataattttatatactttgagtatcatataaaagcacttacaagaagaatgatacctataaagtataaatgaatagctcaacacatagattttgccagttttacaaaatattttaaatgacattctttgtgtgattataagagtaataaatattaatggtagaaaaatttaaaactaaagataattataaaagaaagaaaaaatcattttacatacctgccacctaaattgatatatttcttttcggttattattattattcactgtctctaattttttaactgtcttttattgtgtagttttgttatgttactgagttatagtgtgaagtttacatacataaaaaaattgctcagtagaggcagatacctagtttccactgggaaaaacactgcccttttttaggaggccttccatagtggcctcctggcaactttttaatgatccaggctcagaaaatctatttttttttgaaacggagtctccctctatcgcccaggctggagtgcagtggcgcgatctcggctcacggcaagctccgcctcccaggctcacgccattctccggcctcagcctccggagtagctgggactacaggcgcccgccaccacgcccggagaatttttttatatttttagtagagacggggtttcaccttgttagccaggatgatactcgatcttctgacctcgtgatccgcctgccttggcctcccaaagtactgggattacaggcgtgagccaccgctcccggcccagaaaatctattttgagaaacctaattttgagactatctgtctcttagggcagactcatattgaccaaactcaggagactgaatgccagtttagtaaattgcaaagagagataattgttacggggtgaaatatataaagtannnnnnnnnnnnnnnnnnnntacattcatctctgtactaaggataggcttgccagtggaaccagtaagcaaaaagaaccattgtctctctcacattagaagcgcatttgaatgtgtcctgcctacattgcttctgtgtccctttatttttatactttcatgatgaatcaacccatgtttaatataacacattctacctttagatgtacagatacatccaggcagtttagagtcaagtactgctggcatgagtgccattctgtgtttaaggaaagagattttaggcctggtgtggtggctcatgcatgtaatcctagcactttgtggggccgacgtggtctgatcacttgaggtcaggagttcgaagccagcctggccaacgtggtgaaaccccatctctactaaaaatataaaaaaattagccgggcatggtggcaggcacctgtaatcccagctgcttgggaagctgaggcaagagaattgcttggacccaggaggcggaggttgcagtgagctgagatcgtgccactgccctccagcctgggcaacatggcgagactctgtctcaaaaacaaaaaaaaagattttaaaatctagtgtttctccaggcacagtggctcacgcctgtaattccagcaatttgggaggccgaggcgggtggatcacctgaggtcgggagtttgagaccagcctggccaacatggtgaaaccccgtctctactaaaaatacaaaattagctgggcgtggtggcacatgcctgtaatcccagctactcggaaggctgaggcaggagaattgcttgaacctgggaggcagaggttgcggtaagctgagattgtgccattgcactccagcctgggcaacaagaacgaaactccatctcaaaaaaaaaaaaaaaaaaggtggttccctgctaagcttcagaacatttacatatctctttaaactatagaaaatgtgaatttttatgggtggagaactgatctcactctaacttatgaacacttgtctcaagggagcattagtgttattagtgttgcctggcatactactttttttccagtccatttactcttttttttttttttttttttttgagacagaatctcactctgtcacccatgctagagtgcagtggcacgatcttggctcactgcaacctctgcctcctgggttcaagcggttctcctgcctcagcctctcaagtagctgggattaccggtgtgcaccaccatgcctggctaatttttgtatttttagtagagatggggtttcgccatgttggccaggctggtcttgaacttttggcctcaagtgatcggcccacctcggcctcccaaagtgctgggattacaggcgtgtgccactgtgcccagcctccatttactcttaaactcttctagattgtgatttcttaccctctttcttctcaaaccctagtaccttttctccaatccttactcccagcccctagttaaatggagataataatagcacctatccttagggttattatgagaataaaataagttaaaacatgaaaaacatttagaatagtgcctgacacataagtattcaagtgtcagctattattaccattattattaaaggtatattttaaggttttgttttctgggcagttaacatttctctttttaatgtagacagataataacggtagtggctggaataaaacacacagatatatacatacatacatacatatatataaacacatatatgtacacataaggatgagatgcttgactttaagaaaatgagaacatttattctcaaatatattattcatttttaaatgtatctatatatgtgagcacttgaattttttaaaatataaatatgattttaatcctttatgagccagactgaataacatatttaaaaacaaatttaagattgctgcccattgaagtttgacccaaatagtacagaacattatgaggtttgtagaaccctaaacgactttttttactgaaattactaggtatcataatttatttaggttatatctagtattaaagacccatgtcagagcctacccttttcatagtactttctctggccaccccagtctgcaatgatggattttaggaaaaattcaactcatatcatcttggttatacttagaatctattgtgttacttaagttataaggtattagagttgggaagaaacatggtgatcatgcactttagccctctcatttgtgggccgagaggatagacttagaaagattgagttgtctatggctgtactgaaaaccagggactagacccaggtctcccgactcccagtttagctctttctttttttctttttctttttttttttgagatggaggctcgctctgtcgcccaggatggagtgcagtggctcgatttcggctcactgcaagctccgcctcccaggttcacgccattctccctgcctcagcctcccgagtagctgggactacaggcgcctgccaccacgcctggctaattttttgtatttttggtagagacggggtttcactatattagccaggatgtctcgatctcctgacctcgtgatccacccgcctcggtctcccaaagtgctgggattacaggtgtgagccaccgcacccggccccagtttagctctttctactacagcacaggtggtctgagactggacctgtgtcctcatcactgatatctagggtaataaagttggtagcctatacaacgtgctcagcaatggcagattgccgtttaggatgctggtcttctgaaagagttaaaacaaatctatcttttttagttttcaaaatacaatttgcttatattagagaattaggcctaataatgtcttttgcctagctgtagatttttaaatatatatatattatatatataatatatcatatatgatatatatctatataatattttttatatatattttttttgagatggagtctctgtcgcccaggctggagtgcaatggcgcaatctcggctcactgcaaccttccccctcctaggttcaagagattctcctgcctgagcctcccaagtagctgggattacaggtgcctgccatagtgcctggctaatttttgtattttgactagggacggggtttcaccatgttggccaggctggtctcaaactcctgacctcatgatccacccacctcaacctcccaaagtgctgggattacaggcgtgagccaccgcacctggccagatttttaaatattatctgaatatcagcatcctgttttattcttacaaagtctctcctttagaaattttaatcactaatgtttttgtttactctttacatttctaattgcctgatgaatgtctatacttgggtgctcagcattccacccaaaagtccaatgattaaaactaaactaattattccattaaaactaactttctctaggcttttctaattttgaaaatgaaaccaccattcttttaaattctcaggttcaaacaaaatatctacaaaatatctacgactcttctaaattctatttctttcttttctttttttttttttttcttgagatggagtctcgctctgttgcccaggctggaatacagtggtgcgatcttggctcactgcaacctccacctcctgggtacaagcaattctcctgcctcaaccactcaagtagctgggattacaagcgcgtgccagcacgcccagctacttttttgtattttagtaaagacaaggtttcaccaagttggccaggctggtcttgaactcctgacctcaagtgatctgcctgcctcggcctcccaaagtgctgggattacaggcttgagccactgcgtgcggcctattgatttttgatttattgtatttctaaactgcatttcctccttcccattcctctgagcaccaacctaggttaggcctttatcacctcatactggtcccactgctcttcttcctgcctctcgtctttctctctgatttagctcatttatggccaacatcaattttaaacaccacattgtctatcacttccatgggttcccagggtcttgccacacttcctagtatgtcagctgagatattccgcctccacttcacacaacctatactctaaaaaaaacagttttctggccaggcgtggtggctcacgcctgtaatcccagcactttgggaggccgaggcaggtggatcacctgaggtcaggagtttgagaccatcctggccaacatggtgaaaccccgtctctactaaaagtacaaaaattagttgggcatggtggcaggcgcctgtaatctcagctactcgggaggctgagacagtagaatcgcttgaacccaggaggcggaggttgcagtgagccgaaatcgcgccattgcactccagcctgggcgacaagagcaagacgatgcctaaaaaaaaaaaaaaaaaaaaggtttttggcccgggcgcggtggctcacgcctgtaatctcagcacttcgggaggccgaggcgggcagatcacgaggaggtcaggagatcgagaccatcctggctaacacggtgaaacgccgtctgtactaaaaatacaaaaaattagccgggcgtggtggcaggcgccagtagtcccacctactcgggaggctgaggcaggagaatggcgtgaacccgggaggtggagcttgcagtgagccgagatcgcgccactgcactccatcctgggtgacagagcgagactccgtctcaaaaaaaaatttttttttccccacaatctcttatctatccccatttccattcttgctctccttgttacattcacttgggctgcccttctttctctttatttatctaggtcatacttagtattaaagacctatgttagagcccacccctttcataaaaatttcccctgactgcctcagcttcaatgatagctttactctcttagtcttgagagcagtacattaactgaacagttgatttagtaatttgaaaaaatatattttatccaatgtttttgattgtttaaataaaatttcaagtatagatgttctttcttgcccaactaggtcctaggttgttgagggctaggagcaactttctatgcttttgtttgtattctttatagggacaacatacaatgccctgcacatagcaggtgccccaaaataattaattttatttaacatccgtcacactctgcttcttgtctagatcatacacagagatataaagccagagaatatattagtctcccagtctggcgttgtcaagctatgcgattttggatttgcgcgaacattggcagctcctggggaggtttatactgattatgtggcaacccgatggtacagagctccagaactattggttggtgatgtcaagtatggcaagtaagacatcagtaatggggaggagtagatttttactcttgcttcttgctatagtggaatatgtttatgatatagtaaatgatccctctaatactgaaaggaaggcttgagtttcagggactatataaagtaaattgtaatcatttttggtgcttcccctttaaacattcctgtgaaacaagtatacttattttagaggtggggaaattaagtggtctattttatacagtgggttggaaatagatatatttatcacttgtaaagagaggtgaacattgattggttaaatgtgacattgttggaatggggaagatggagtaagcaagggtggaggcagaaatataattaagtaaaatgtttttaaaacataaattttcttcacaagggaattcttcaaagaagaaagggttgtaacttttactgcttttgattgaaatctttctaaaatattttctacaagttctgttgtcagagcacactaaacattatttattattttcttgattactgagttcttattttgctaccatgttataatttttgtgccattttataattcagcaataaccttaagcattttaaggtagttgttcctatgccaaatgatgcttgcatattctttgagttcttgtaactgatttttaagatagtttcaaaatttttatccctaggctgggtgcagcggctcatgcctgtaatcccagcactttgggaggcccaggcgggaggatcatgaggtcaggagttcaagaccagcctgaccaacatggtgaaaccccatctctactaaaaatacaaaaattagccaggcatggtggcatgcacctgtaatcccagctacttgggaggctggggcaggagaatcacttgaacctgggaggcagaggttgcagtgagctgagattacgcgactgcactccagcctgggcgacagagtgagattctgtctcaaaaaaaaaaaaaaaattatccctatcatccctcagttctcttcattgttactgtatttatccttagcagccacctcctctttctggtatgctgttttcagtgtatgatggcatagcatagattggtcaagcttgctagagttatgcgtaaacaaagaatgaataggctctaaatggagcctgagagttttatttccagaataaagtatacataataactgttttggcttttcagaaggcatttcccttttatgtcacatgattgaagtttctggaaagctcacttatgtaaaattgggagttagaattttaatagggaaaaatcatttcatgggtaatttaaggcttactataggttgagtattccttatcctaaatgcttgggaccagaagtgttgcagatttcagatgggtttttttttttttttggattttgggatatttgcattataccattggagcatgccaaatctgagaatctgaaatctgaaatgctctggttggcatttcctttgagcatcacctcagtgctcaaaaagctttgggttttggagcatattaggatgccagattttacaccacattgcttttctttcagggctgttgatgtgtgggccattggttgtctggtaactgaaatgttcatgggggaacccctatttcctggagattctgatattgatcagctatatcatattatgatgtgtttaggtaaggttacacatctgcattttaaattttagagatttttctgcatatttgtttgtgcctgtgtgtttgtgattttttaagctgttgcattaaagattatatatgttttaagtgaaggtagggagcatataggaaaactctgtgtgtgtgtgtgtgtgtgtgtgttttgagatggagtttcgctctccttgcccaggctagagtgcaatggcgcaatctcggctcactgcaacctctgcctcctgggttcaagcgattctcctgcctcagcctcccgagtagctgggattacaggcatgtgccaccatgcccagctaatttcgtatttttagtagagatggcgtttctccatgttggtcagtctggactcgaactcctgacttcaggtgatctgcccaccttggcctcccaaagtgctaggattacaggcgtgagccaccgcgcccagccacgtgtgtgttttaatttattttttccttcagtctggcattggtctatctgatgcatgttcttttttattttttgagacggagtctcgttctgtcaccaggctggggtgcagtggcaatcttggctcactgcaacctccgactcccaggttcaagcgattctcctgcctcggcctcccaaaatgctgggattgcaggcgtgagccactgtggcccgccctggtgcatgttcttaatcacgctcacatcccctttcccctcaagagagaggaaaagagcagaggttgtgcatttctctgtacttttacataccgttaattacatgtagagaggatgcaatgatcatttattattcttgagtcagtaagcatttggtgtaatgtgactactgtccttactttcacattcaagaggagagacacagagatttccaaggttgatttaatcttggcacagatttggacttctgctattagtgcttttgacagaatttcaaagctggactatcaaaatcttacgtttgttgaaatatcaacttcatgtttgaagatggagcttagaaatggaaataatgggaaaatacttgggggtaatttaactatttgatttgaagttttcagattagaaattaaataagcagtacaatagtttcttacagtggaattttcagatatattctacattcaactagatattaaagttgagaaaaaagattaaagtgctcaaatctgactttaagataagcacaaaatcagttgaccaaatattaaattcttaaaggggagaactgatttatctagattagatcctgtccatatgactattaatatatttgttgttttattcagcactttatgctttctagttagaaacgaagtgctggtacttatatctggaaagttataaaatattttttacctgtccttttcctatgctccttaagactgccatataccaccacagtaacggcattgtctttggtcaattttgcatgttgagagagccccaaactccataagctgtgttccactatttcctctacttcacaccacctgtctcttcaccatttctatcatgttgtataataacagagatatgtgctgttttcacttccaggtaatctaattccaaggcatcaggagctttttaataaaaatcctgtgtttgctggagtaaggttgcctgaaatcaaggaaagagaacctcttgaaagacgctatcctaagctctctgaagtggtgatagatttagcaaaggtaatcatacttattgtttacactttatgacaggggaatttatgcactatcaagaccttttttttttttttttacttgtctagttgatcttttttttttttttttgatggagtcttgctctgtcacacaggctggagtgctgtggcatgatctcggctcactgcaagcttcaccattcttccgcctcaacctctctagtagctgggactacaggcgctcgccaccatgcctggctaattttttgtatttttagtagaaacggggtttcactgtgttagccaggatggtctcaatctcctgacctcgtgatccgcccgcctcggccttccaaagtgctgggattataggtgtgagccaccagccctggcctctagttgatcttttaggtcaacaatttcctctaataattttaatttttgtacatttagaaacaatttaaataatttgatgggggtaacttcagagaaaaaggactgaaaattttacctgttttaacactcattaagaaaccatttattggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaaaagaaaccatttattgttatctagcattttgtaaatgtgaaaacatcctcactgaaaaacacattaaaaacataaaaacactgtatgatttttacgtttaacatttaaaatacacgccttgtttaaatggaaaagaaaataaaagtaggataagaaaataaaaagggtctgggcatggtggctcacacctgtaatcccagcactttgggaggctaaggccggtggatcacttgaagtcaggagttggagaccagcctggccaacatggcaaaaccccatctctattagaaatacaaaaaaattagctgggcatggtggtgcatgtctgtaatcccagctactcgggatgctgagacaggagaatcacttgaacccaggagacagaggttacagtgagctgagatcgcaccactgcactccatcctgggtgacagagtgaaactctctctttaaataaataaataaataaaggatagagaagtaggaaaatattaaaatgtaggacataggatggccgggcatggtggctcatgcctgtaatcccagcagtttgggcggccgaggcacgtggatcatgaggtcaggagttcaagaccatcctggccaagatggtgaaaccccatctctactaaaaatacaaaaattagctgggcgtggtggcacgtgcctgtaacccccgctactcgggaaggtgaggcagagaattgcttgaacctgggaggtggaggtttcagtgagctgagattacgccactgcactccagcctgggcaacagagcgagactccatgtcaaaaaaaacaaacaaacaacaacaacaacaaaaaaaacaaaatgtagggcataggatcatgatctgtatgatattgtcaaaggggtttttgcttagccactgtattggctgcagccagtttacaaatggccaatacttttttgttgtatttgattaaggaagatgttaggttttcattctatcaagtgagaatcaactctaaaatttgacctttttggggaatttttagctcaaaaagttctcatcagttaagattgtttaaatattgataagataggtacctctaaaacactaggctataagatttacccaatttttttgttttttaattctttaactcatgacgtttaataagcttataactaattaaacaagttcttagaataatacatttccagttttttacataatcttctaacagatgcaaatatttttaattggtacaagctttgtgatctatctgtaaggagatataaagggaataaaggtaaaactattgtccaacttgtgtaccttaatcataccttaaggaatcatataaaacttttaaaacattttattatggaaaatttcaaacggaaaagaaaatagaaagaatagttgtttaacaaaccttcatgtacttatcatctagtttccacaattatcaaccttttgataatcttgtttaatttatctacactctttaactttttttggagtattttgaagcaaatcccagacgtattattttacttataagtagcacagttatgcagagaaattttcttgttcatttaaagctacttattgagtcccttctatttttactggcatgttaggggttttaatgaatcagaacaagactttgcaataaaataaaataaaataaaataatctttgtaaagcatctagcatagtgataagcacaggataaatcctttcctttccattctgtaatagccttaagttttaaaaattccaaataatttcttactatcataaaatatctaattgatgtttaaagtttcattaattttcacaaaatttatttcatttcatagtttgaattaggatctaaatgaagactatagattgcaattggtcgatatatttttaaaactttatttataagcttctcttcatctctttcttttttgtttaaatcttgcaatttatttgttgaagaaactaagttgtttgtccttagaattttctacataatgcagtatacatgttcttctgtgtcctgtatttcttataaactcacagtagagctagagctcgatcagaatcaggttgattttttggcaaaactacttcataggaggtttgtgtatttccatatagagacactgaatgtttggtggtctttttgtgatactagcaaccactgacggtcattgtctagatttgtgctttattctttatccttgattattgatgtgtaaaattcattggcgggcaagtgtggtggcttgcgctggtaatcccagcattttgggaagctgaggagggtggatagcttgagctcagagttcgagaccagcctgggcaacatggcgaaacgctgtctctacaaaaaatacaaaaattagctgggtgtggtggtgtgcacctgtggtcccagctactcaggagactgagatggaaggatcacctgagcctagagaggtcaaggctgcggttaagtagtgatcacaccactgcactctagcctgggcaacagagtgagaccctgtcttaaaaaaaaaaatcgttgactataaagaggattttttttctatatttataaatttaaatgtaggtagtttttcttgatatgaactctaagtgttcttaatttttcagaaatgcttacatattgaccccgacaaaagacccttctgtgctgagctcctacaccatgatttctttcaaatggatggatttgctgagaggtatagtacttacccatgtttttcaggccataccaacctagggttaaagtcttccacaatagtcacaaatagcacttctcttatttctgttcccacctactttgcaggatctcagatatctaccactctacccccatattcccttagcaataatgcagttcctaggggtggtctcctacatttactaaattagtgctcttggttttcatgaagcggtcattttatgtcttctttctgtctccctgtggtgacgtctaccagtcagatcattgatttctatgttgctaccaactgtgtgatgccatcatcttagatgctgatgtagttacaaaagtgccatctcctattgctgccaaactcataccacaccaagtcctttgatactgctgacactgctgatgtgttggagaccttgatatgccaaacctgtgggtgccagagttgctggcatggtcttctgtgctgctcaagctgctggcaacagtgcagctgacgaaacaaagaatagtgagatgagtggcagtaacacgtagcttaataaaaggtagctaggttttcctatttgcttttgtactcaattagttgtgatatgttgtttttgtggaagtatatgaagaaactctggcctcacgtaagtagataattgtgggtattctttgattctataccaaaactctgataccatagcaaaacttgacagtggtagtttcttttttttttttttttttttttgctcttgttgcccaggctggagtgcagtggtgcaatcttggctcactgcaacctctacctcctgggttcaagcgattctcttgcctcagcctcccgagtagctgggattacaggcatgtgccaccacaactggctaattttatatttttagtagagatggggtttctctgtgttggtcaggctggtcttgaactcctgacctcaggtgatctgcccacctgggcctcctaaagtgctgggattacaggcatgagccaccgttcctggcccagtggtagtttcttaaaggctggttgcattgtggaatgtgaaaccatatcattgagtctttcttcctttgttaaattaaaatccatttgtctgtcttgcctttttaatggatcttttacccatgcatgcttttgtaatatcatgctttagtcatttggaaaatattagtttgctgagttaagcagatcttaaaaatattgatatatttcttgtacagcatcaaaaattacattctatctcataaaagttttgtgagttttgggaagctgctaagctcacagtggtggatacaagtttaacagaattgtaatttttgcataaaattttgaattttatcattaacacaattatttctgttttccttgaagtgacaagatcactttgtttatttgttaaaagaaaatgtttcccatagacccaaagtcttaataaccatagtttttctgtcagtctttctttcaagtaaaaatatctagtttagtttgtatcacaaataattatgcaagcatttttcttaagacaaccatagtgtttcggtttgtagcagaggtgctttacgtatattctcattttgtcacacagaccataaaaaaaggatgcgtttaagagtttggctttaatgaagtcaatacctttttgctgattcatcagagacattcttaagcaagactgccttttttttttttaaaaaaaaaaagcaactgagaatgtgtggttatcaagaaagtaatgactgctagtacattttggttttgctgcttttcttcttggtaaggtgtcagcagttttatccaccactgctttcatgttaacctggtgagaaagacaaacatctttatgttaaaataatagcattgactttgtgaaccttctgaatgttcttagggatccccaaagatctacacaccaccctttccaaactgctgatctaggccaggatttttctcatttttaataacatagactagtttaacattcaatttttaaaaaataaatatcttgaaagtcaatttttttgtaggtttatccatgtcttacaattttattttattatatttttatgtaggttttcccaagaactacagttaaaagtacagaaagatgccagaaatgtttctttatctaaaaaatcccaaaacagaaagaaggaaaaagaaaaagatgattccttagttgaagaaagaaaaacacttgtggtacaggtaaatgttcatgtttcacattttagatttaatatacttatttttttaaattttttgagaaaaaatatgattttgaaaaaagttttctgagcagtgagcaaattgttaacttttagtttagttgtaaaaatgtatcttctcagtagatattacctgtttagaaaacttaacatatcatgttttgagtacctgttatgtgccagactgtgcaacagtgcttaaatcacattcatccaagaacatctagatatgtgttttcatgaacacatatacacacagacacatggaacaaacaaccctcaccccacttatctttcttaaaggatatgagtgaaaaatattgtctgtagaaatttatatgaagtaaaaatttgaaaagtgagatttggatacttaacttaggtttgcttttcctggtgaactacccaggatctgttcttgataaggtaattcaaatccaccaccaatccacttatatcaagtacaccaaaagaagaaagagttatcagttttgtgttccatgactctgaatatgtaagaacaaaagtggaattcttgattcctcttccatgagtttttccactgatgtgtgtgtatgtgtgtgtgtgtgtgtctgagtgagctgtgtgaattgcatttccattctttttgtattttcccaataactatctgaataagaatctggctttaattttaatcccctaggaagaataaagaaaacagtttcaaaaaggtgatacttatgatattctgctctagttgacaagtactttataagaagaggtaaattttcattctcttcagatcattaaccttattaatatttttgttaatgatcaggataccaatgctgatcccaaaattaaggattataaactatttaaaataaaaggctcaaaaattgatggagaaaaagctgaaaaaggcaatagagcttcaaatgccagctgtctccatgacagtaggacaagccacaacaaaatagtgccttcaacaagcctcaaagactgcagcaatgtcagcgtggaccacacaaggaatccaagcgtggcaattcccccacttacacacaatctttctgcagttgctcccagcattaattctggaatggggactgagactataccaattcagggttacaggtatgaattagtaaaataagatcaaaaaagtgtttaaggacatatttgcaaattgcaagggtttgtcaattcatccacattgtttttattctcagaattctggatgctattcattcttgtcaggtagctgtttcaaaagactttttggctgtgtgatgaagattattagcatttgatcaaaacaattcaccaaagtcctgagaaagtagggttttattgcttaaggtgaagagaatctacagctatatagtctaataatgtgaaagcaggttgtcatactaaaagagataatttttgagtggctgctgctgcatggtgtgactgtgagcctatagtagtataaggaagctccatttgggaattttgctgaaaggagggtaatgtatttggtaggagttgggggctgctgggaggcatgagggtagtgttaaagaatagaatgtttcaccagatttatgtgcattgtatatttgagaatagacattacactctggttaaactgcttgttagttggtgctgtgtcatttagttttgtgcttgaaaaaataattattgctggttctaacttaaaaacatttttttttgtcgttacagagtggatgagaaaactaagaagtgttctattccatttgttaaaccgaacagacattccccatcaggcatttataacattaatgtgaccacattagtaagtaagcagttctcagtagtagaagagcaaacaccagtcagctctagacttttattaaaattaaatatgatagtgaagtattgagaattttgtttggatacacataaagtgaaaccttaattgtgcatatattatcccaacccatcatagtcataaacgtgaaattctgaaagtttaagttttatgagtctaaaaactccttccttcctttcttccttccttccttccttccttccttccttccttccttccttccttctttccttccttccttccttcctctctttctttttcttttcttttttttttcatggagtcttgctctgttgcccaggctacagtgcagtggtgagatcttggctcactgtaacctccacctcctgggttcaagtgattctcctgcctcagcctcctgagtagctgggattacaggtgcctgccaccgcacccagctaattttttatttttagtagagacagggtttcaccatcttggccaggctggtcttgaactcctgacctcgtgatccacctgccttggcctcccaaagtgctgggattacaggtgtgagccatctgtgcctggcttgttttattttttctttagtaacatagtaaattttctcaacttgatgattgctggtcagttcttttttagagtagatgaaaagataaattgtcttatctcacccacaccagatttttggtggctgtattctattggccagggacagtagcacacatctataatcccagcactttgggaggccgaggtgggaggatagtttgagcccaggagtttgagacaagcttgagcaacatagcaagatcctgtctctacaaaaaattttttaaaaagttagctgggtatggtggcacatgactgtagtcctagctacttgggaggctaagatgggtgggttgcttgagcctggaaagttgaggctacagtggtaagctgtggctgtaattgtgccccagcacctgagcctgggtgacagaccaagaccctgtctcaaaaaaaaaaaaaaaaagaagaaagaaacgattctatttatttatataataaatatttatcaatcgttatgtgtgagacactggaaataaataagtcaatctttcttttcaaggacttcatgatctagaggatcagcaaattaaagcatagtatcatattgtatttagacagagcacaggaaggaccattattattctcagcatggcctccagaatgtttctcttttgaagttaggtgaaaccctcatcattcttctgctaaacttcctccattagcttcttatcactgaggaaaggccaaagtccttatagggtctataagtgcctgcaggattgactccaaccaaccctctatcccatctccacctactctttctccatcaatctgttctaccacactgatttccttgttattcctggaacatagtcagacatactcccacctttgggcttttgcacttgctatttcttttgctttggaacattcttcccccagataacccaatggatttgctttttctcttcttagctcacatgaaaccttactgtgaagtcttgtaactcattatgcctccctttatgttcgatgccttctccttgcttatttttttttccattgcatttacctgacatcgtctatatactcttatttatatattgtctgtctcccccagctagaacgtaagattccaaggcagagatttgtgcttttgttttcttcactgtacttttccttcctatgcaagtagaaaaaataattttttttttttttcgagtcagaatctcgctctgtcgcccaggctggagtgcagtggcatgatctcggctcactgcaacctccgcctcccagatttgagcgattctcctgcctcaacctcccgagtagctgggattacaggcacctgccaccacacccagctaatttttgtatttttagtagaggcggggtttctccatgtcggccaggctggtttcgaactcctg

SEQ ID NO: 13826 - DNA, 17842 bp, Human
  misc_feature (1)...(17842): n = A,T,C or G
gagcaagttacttaaccactttatgcttcagttttcttatctgcaaaacggagacaaaaatagtatatacatcataaggataagattaaataatttaatacatatataaagtgttcagaacagttcctggaccatattaaagagctatgtaaatgtttgtcattattaacagaatcatccacattttcatcactcttactaatatcattagttctggtagcaaggcagcataggtcaagatatagaggtagaagcatatgacataatgtgacaaggaactggaggctagcactgatgatgcccatgaggagtagggacaggcagggactgtattataacctgaaatcatgatatgttgggtttttcaactgtttatgatctatttctgcctattaagatgcaagctcctagaagaactctgtgaggaactggtgtggtaaatcattctatgccagatatgcagaatagtcactggtaacatagtcagtgctcaataagttttttttttttttttgagacggagtcttgctctgtcatccaggctggagtgtagtggtactatgttggctcacttcaacctccacctcccgggttcgagcaattctcctgcctcagcctcccgagtagctgggattacaggtgcacaacaccacacctggctactttttgtatttttagtagagacgcggtttcaccatgttggccaggctggtcttgaactcctgaactcaggtgatctgcctgccttggcctcccaaagtgctgggattacaggtgtgagccaccacgcctgtccaacaagtattaattaaatgaataatgggttaaggatttttgaactttgtcctgaaaatgatggtgggtcaatgatgcagggtggaacaatggatgaagggctaggaagcaagtcatcaatttcttgctataaatgatgacaaggactcgaatggtcatccctttgtagatgaaagcaagagacttggtgttgggatgaggatgaggggtggcctccgggtgatggtgccatctgtggagatggaataagtgggaggaggggcagatttaggaaaagatgagtatttccatttgacacatattcaagatttgtaggtctaaagctcagcagagaggctggggttagagagcgaggcctgggaatccctggtgtataaggggtggtagaggccccgggtctggatggtgtgacacaggtggtcgtcaagtgaccatgcactacttgttgttcacaagtcccagggctttgtctccccagcaagactgggtattctttggggatggaaatactttccactacagcactaagtacacagtacacagctcattgctaggaagatagtcaagaacagaacttgtagagcagaaaggaaccttcaaaaccaagttataggagagaactgaggccctacatggttaaatcacatgcctgaggtcactcagctaagcagccacagagctggctgtaggatcaggtctccagactgccagtccggtacccttctgagaaggccgcactgcctcagagctgtgagttgagtgagctgagaaaggtgacagggcttgggctttgggcttacttagcttctatgagcctgcgtttcataatcaacaagattgtcaggggttaactgggaccatgctgcatgtaaagcattgtgtctggaacacaataggtgctcaatatgtgtttactttccattcctttcttccaagaagaccagaatttgcaatgacaaagaaaggatgcaagagtgatggatgcagttggctgctgccacctgaaaggctgcaagactgagaggtgagtgacatgaccccgggcatcacattcctcatcagcagacagaaagtggctattgctttcctccagaaggtgtgcaagtagaagctttgctcctggtgccagagtgagcctgtggctgctttccctcccacactcctcactcctttcttggctccgccctgctgactcagtgacgcagcaggaggaaactgctcgggctgcaagcagtcttccaggctttgcggctgccaaaggaataattgagacgtctgagttgagcaggtaaggcaggcagaaggaggaaagctagaaaacctcgataagtcgatcctgaagaattcttgggctttggagactggagaggccaggggctggaggacttgggaagtgggaggggagctcccagcccttggctgcccggaaggatcttcctccagtgcccttccagagttctgtcagagtccacacgtcatttatccatgtcctcagtttctcaggcatctctttgcgacttactcaggtcgcacagagaaagtgaaattgaaagcaggattgtctgttggagtacttccgcaggctcgtctcttctctactctgatgcgtcactcagggcttccttgatatttcctctccttcccggctcctttgtttataccagcccacctcacatctgattgtaatggggacggtctacacaaacactttggttcaaagatttcattgcctggtgatcgtgtatgtgttgcacaattaattaaacttctaagaggctaatcaattaacctctgaggctttgaaactgtcagagtggtgagattgctgaaaaagggttgcttcgtgaattctatagcagatgcagttatttaaatattcaggtaacagtttcgggctgtctgatgattgaactggatctgtaattctcagatctgattgacagttggacgaaattgatagctgccagttgcctattcgtgtagtagctatatgcacatgtgtagggagaatagaattcactaagcaatttattttttcataacgggatataattagctctaacattcattgagtggctaatatttgcaacactccatactttaatgtactttacacacatgactgtatttatttttgtctccatttcaggaaatagaaaattgagattcaacaatccaaggttacaggaagtaatagtaaaaaattacacagccacaagctcaaacttagatctccctaaggtcagagtacaagctcttttcactactgcagatactccttgacttatgatggggttacatacagataaacccatcctaaattgaaaatattgtaggtcaaaagcacatttaatacacctaatctactgaacgtcatagcttatcctagcttaccttaaatgtgctcagaacacttacattaggctacagttgggcaaaatcatctagctcaaagcttattttataataaagtgttaaatgtctcatgtatttatcgaatgctatgctgaaataaaaaacagaatggttgtatgtgtacttgaagtgtggtttctactgaatgtttattgcttttccaccactgcaaagtcaaaaaatcataaatcaaagtcaaaaaacataagtcagatattgtctgtactttaaataggggcacagggttgtacaaagaggacatgcacagagtcagcaaacacagtgatcaaccttcctggtgacataagaaatgcaaagggaaaaaaagccaagaaatatatttttcttattgaatgagggttcttctttttttattgataaataattgatgtgcatattttcatggtcttttttttttttttttggaagccacctatctctggtaagaatatatttatatgacattgaaagcaatttgttaatataggttaagaatcctaaatacaatcatatcttttgaatagtcattaaattctttgaagtctatcatatgaaatctatcataagatctatcgaaagaaaataaactaaaataagctgaatttgctgcaacatcatttagattttttaaatttttaattttaaaaaaccctttaaaacttatttttgaaaaccactcagtaatagagaaatgaaacaactgtatgatttcatattacatagtcatgaaaaatgttttacaagactttgcaataacacaggaaatgacttatagtatggtattaaatgaaaggaagtaggatacagttacttacagagtataattccaaatgtcttaaaaaatatatagaaatacactaaaatattaacattggctgtttctgggcattgggactagagaaataattttcttattttgaatttacatatatttataatattctgtaatttaaaagttttataagaaataaatatatgtatttagaaaaaatgctaatataattaatttctctgattcaagtgttttctccctattgtaaaattacaaagcacctctcttcgttgccaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaataggtgagtccccaatccccaattctctcttagaaattgtgggatctttgtttatgataggaaaagtttttcattgcagagaggaaaggcctagagtaaatgtggatgattcaatttgtggatcattattacaacaaattcataattacagtgcagtgtctcctgctaccaattataactgggttctgttagtctacatgaaggttggtagatgccaacagaataccaggctagccttagattgccattggcaaaataaacagatgaaggcatgtcatggatcaaagtagctccagaaatctgagaatcctagaggtgagttccttcagacaaggtggcagtaaccatgaaacttactgacaaaattgaggtcaaagttgaggatgtcaggacaagatgtgacgtagtgaagacacagactccaaggcagaacaagtcagaatccactagtccaagccaaacaaagggaaggaaaatagcattttcttttaaatgttaaaagaaaagcaaggctgaccgtaaagtcccaggaagcaatatggtgcgggggagcaagccagggcttcagcgatgattagggtggcttgaagcctagtctcactagtttgtagttttgtaacctcagacaagtcacttgatactgtgagcctcagttcctcacttgaggctgataatgcctccttcgtaagtttgttatgaggtctaagtgcaatgatgaaatagtaagtcatttggtacatcataggtgctcaggaaaggctgttcttgcctgaaaggtctaagcagagtacataccttatccatagacatgcactgagatttaagctcagtgtaagggaacagctcctttacaaatctgtgctttcggcccctggaattgcatgaacgaggagctggttaaatttgtcctcatcccttcctaccccctggcctggaaaaaataaaatgtaagtgctgctcttggcagatacctaacagatcaaatgaaacagtgcacatggcagtgttttgaggggtgaatggcaaatacagatataaggtttattattgccttccacagagatgatgatttttatagcatgttacatatttatataaatcaattgactctcactttatggagaatgagtattttcaatgtgcctctgcaaacttttccttagattctaagaaagctgctcacctggcagattttgataagagcatcaagtgggctggagatccacaggaagtcaagagagatctagaggtaaattctacaatccagtttacctttcttctttctgcttccttattctttcatgtagtagtcagggttctctagagggacagaactagtaggacatatgtatatatgaaagggagtttattaaggagaattgactcacacggtcacaacataaagtcccataataagccatctgcaagttgaggaacaaggaagccagtgatgggtcagtctgagtaccaaaacctcaaaagtagggaagccgacagtgcagccttcagtctgtggccaaaggcctgaaagcccctggcaaaccactggtgtaagtccaaaactccataagctgaagaacttggatactgatgtttgagggcaggaagcatccagcacgggagaaagatgaaggccagaagtcttagcaagttgtctgctctttcattttctgcctgctttattttagccatgctggcagctgattagatggtgcccaccgagactgaatgtgggtctgcctctcccagtccactgactcaaatgttgctctccttcggcaacaccctcacagacacacccagtcacaatactttgtatccttcaactcaatcaagttgacactcaatattaaccgtcacagttcattaccttatttcctatgggcaattggagggcattctattttaaccaggaaaaaaagaatgttcaaggctttccccatcttgctcactgtcctgactcccctgtaggccatggcatttccttgggcttctcccgcagcagagctttcaagatgacaatgggaaggtgcaacagcttgggtcggtgtggagttggctgtcactgtggacccttactgtatctctttgaatctctcttcctccactaccttaataagtaaataaactgagcatgccacatcttctctccaggagagaatttcaaatatctccaatattcattgaggagttatttttctacctaggaacaaagtaagtgaggtttctttcaccacaaactcaaactcgtgggctacactctgcagaaggctggatactaaggttctctgaaaactcctgggaggagtgaggtcaattcccagcttgaaagaacctaagcttggccaaaaagatgaggactctgaaatagctgttgctcctgaggggacatggagattggccgctgtagaccaaagcccccaggctgattctgaccctgtcagggtaggtctttcctggagagttttacagggtgctgcactttcaacccagtgggtgagactctccacccatatgtctggcctcctggtttggtggcatcagatttcagctccctccttgactggtggctagtgcaaagagttccttaggcgaccttcttcttggcctttcctcctggccacggcctaatccctggggtcatcactttgcctctcctggcctggactgacttttttatttgctgcgtgacatagcctcagacccaaagtcccagtttccagccaggctgtcagttctccctgtgtttaaagcattctccctttcctcaatttatctatattctgtccatacatttgaggcccagctcaaatctctcttcctccaagcagtctgccctaacaactgtgacttatatgtatcttttactcttcataaaactaagtggtatgggcgatatactgccttgaagaggtctgtatgcacacatctgtgccttccctccctaacaagcctacaaattccttgagattcctcccatcatcttgtttgctaatagcgtgcaccactccttccagggttacccaaataattagtaagcatctttggcttgatttatggcttttgtgcaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagaggtaagtaaaactttgtgcagatgccacaggcctccaggatggaaagggtaaggtggtgcagacagaagtctgggctgcaaatcaggagacccaggcttttttcttagcttgggatttactggctgtgtgtccttggagagatgacttaacctctctggagtctgcttttcatttctgaagaataaggaggggaaaaaaagagatgcttgcctctcctatcatgcagaatttttgaagacatggttgtattacttttattaaaaaccaaaatctagccaggcgcggtggctcacgcctgtaatcccagcactttgggaggccgaggcgggtggatcatgaggtcaggagttccagaccagcctggtcagcatggtgaaaccccgtctctactaaaaatacaaaagttagccgagtgtggtggcaggtgcctgtaatgtcacctacttgggaagctgaggcaggagaattgcttgaacccgggaggtggaggttgcagtgagccaagattgcgctactgcactccagcttgggggacagagcgagactccatctcaaaaaaaaaaaaaaaaaaaaaaaaaagaaagaaaaaccaagaaagcacaaaaaacaccaaaatctaacggttttctttttctggaaaaggaaagggagggatgggatgatcatgatcatttagatcatttagtcatcttcagccgctataggacgcttcggaatgtgggaaatgaatccgacatcaaaacacgaaaatctgaaagtgagatcctcagactactgcaacctgggccttctgaacattccaaaagttttgacaagtggacgactaaggtatgaacaattcctatagtgcaggggttagtccaggaataagaatttgtgtaatgttttatgttagtttttctatcttattttacaccagtggcaaaccagaggctcaaagaggtgattttgcctcctgccctcccatccctatccccctaggctccccgccggggtgtctacttctactttcagaagctggccctccctctctcccattcagacccatgcccctctgatagactgttattcaggctccccctggatggccttatcccagcccatgagcctttccctcacttagctgataatcctattgccattatggcacgagcagctgactaaatagagcttaatccaagggaagtgcttcaccatgaggtgtttcagtccaggtacagcctggctgcctccactgcctgtaaacagcccagctctcaggatccacacacagacctacattctgcctgaggaaatagactatgaaggaaagatgatctttcaaattgctctctttaagaaaagttccacctaacttgcattaattatagtggaactctacaaaattagtcatcatctcaatctagtcagtactgtcagaactttcattattaattaacaaacatctatacaataccaattatgtgctaggcccatgcaaggccttgagcatacaaagcagaatacaatgtgtccctgtggggctgagaagcccatggaaatgatgctgtgggatgtgtgctgggcatcccagggacatgtgcaaagcactatgggagaacccataatcttcaggtcttggaaaccaacagcttcctatcctagacctgacctgggactctgcttctcctaattcttgttttgctttccttccctcactggtctctagactgcacatcacactcataattactggcttacggtccattttccttgctagactgtaagttccatgaaggcagagactacccattgtcttgtcagttattgtatccctggcatggagtagatgtgccatgactctttactaaatgaatgtctatcaaactttggctaaaattttaacttgtagaaacaaagaaatttgaaagcagctatgatagtgatagctaatgattacgtagtatcattatgattatgtggcagccatagttcttgagactttacatgagttaccacatttaatctttagcacaacttctgagacaatcatctatattttgcagatgagcaagctgaggcacagacaaataatttttccaactacacagaaccagtaaggggtgcaccaggatttgaagctgggaaggatggctgcagaggccatgtgcttaagccacaccactacatgaagctgtgatggcatcaagtctaccaactcatttactcactgaggaaattgaggctcagagaccacactcaaattactcatgctggacagtcagagattggcagacctggaaagaggaacttgttcttttatttcccaatttattggttcttttccctaaattccatgggcttatattgaattttgatagtcttcaggttttaacttcaagttttaccttttaattcccattttacactttgtttttctgttgacttgcccattttcatggtcacacaattaattttgtcagcataggtctggagcccaagttttccagcttgtatgactgtattggttcttgacttgccccatcctgccacacatacgtgcttggcgtttctcacgggtgttctgcacagagtgcacctggccagtctcagcagcatcctcactagcattgctctttcatcagttactcttcctaagtgacccactggattcttgactgttgcatcttgatctcgtagcccaaactctttctaaatatgagagccatctatggctctgtatctatgagggtgacaagcacagacaaagaggatgacattactgtgatatgaaaggagttgccctgggacacctgcaggcaaggagaaacaagtaaccttgtttaaaatataaattttagagggtactagtatagttttgttacatggatatattgtgtagtggtaaagttgggcttttagtgtaaccattacctgaataacgcacattgtacccattaagtaatttctcatccctctccctccaaccctcccacctttccaagtctccaattatattattccactctgtacatccatgtgtacacattattgagctcccacttataagagagaacatgtgatatttgactttctgtttgtaagtcatttcacttaaaataatggcctccagttccgtccatgtggccacaaaagacatgatttcattcttcttttttatggctgaaatggcccagacacattttctttatccaatcatctgttgatggacacttaggtggattccatatctttgctattgtgaatagtgctgtagtaaacatatgagtgccggtatctttttgatataagatttcttgggctgagtgcagtggctcacacctgtaatcccagcactttgggaggccgagatgggtggatcatttgaggtcaggagtttaagaccagcctggccaacatggcaaaaccctgtctctactaaaaatacaaaacttagccaagcattgtggcacacgtctgtaatcccagctacttgggcggctgaggcatgagaattgcttcagcctgtgaagcagaggttacagctttattttggcagatactcagtacattcttttctctgcatcctcatcaacatctgttactttttgactttttaatagtagcccctagtataagatgatatctcattggttttaatttgcatttctctgatgattagtgatgttaagcattttttcatatgctttttggcaatttgtacgtcttcttttgagaaatgtctattcttgtcatttgcccactttttaatggtgttattattttttattgttaagttgtttgagttccttgtaaattctggatatcaatcctctgttggatgcatagtttgcaaatattttttttcccatgctgcaggttgtttgttcactctgtttatttcttttgctgcgcagaagtttttagtttaattaaaccccatctgtttctttattttcattgcttgtgcttttggggtcttagtcatgaattctttgcctagaccaatgtccagaagagtttttcctaggttttcttttagtatttttatagtttcaggtcttacatttaagtctttaatccatcttgagttgatttttgtatacactgagagagagaggtctagttttaatcttctacatatggcagtctaattttcccagcaccacttactgaatagggtgtctttttcccagtgtatgtttttgccgactttgtctaagatcagttggttgtagatatgtggctttatttgtggcttctgtattctgttccattgatctatgtgtctatttttataccagtactgtgctgttttggttatcttagccttgcacaataattggaggtatatcataatgtgatgcctccaactttgtttttttttccttaagatgcctgtggctatttgggctcttttttggtttcatgtgaattttaggattttttctctaattctgtgaaaaatgatgttggtattttgatagggattgcattgaatctgtagattgctttgggcggggtgatcactttaacaatattagttattccttttggaaatatacctaaaaaaacaaaaacaaacaaacaaaaccgttcactttggccatggttgccaggcccagtttcagtctgaatagcccttttaaagaaagacatgtaatcaagtacgaatttgaaagggtggccacaggataaaaatattgtatagtataatgaacgactttcctagtatagtagtcaaagattttttaaccatattttaatatatttaatttcttatgaaaacaatttacttggaaaatacagacacacatttgaacatacttataatctcacatccagacacaattatatatatagttttaattttaaaatttttttaatttttttgccaggtgtggcggctcacacctgtaatcccagcactttgggggccaaggtgggtgaatcacgaggtcaggagtttgagaccagcctggccaacatggtgaaaccctgtctctactaaaaatacaaaaaaaaaaaaattagctgggcatagtggcgggtgcctgtaatcccagctactcgggaggctgaggcaggagaatcgcttgaacccgggaggcggaggttgcagtgagccaagatcgcaccactgtactccagccctggtgacagagtgagactccgtcttgaaaaaaaaaaaattatttttttgagatggagttttgctctgttactgnnnnnnnnnnnnnnnnnnnntgcaacctccacctcccaggttcaagtgactctcctgcctcagtctcccaagtagctgggattacaggcagcgccaccacgcctggctaattttttagcagaaacttttagtagaaacgaggtttcactgtgttggccaggctggtctcaatctcctgacctcaggtgatccgcccatttcggcctctgaaagtgctgggactacagatgtgagccaccccacccagcccagacacaattatagttagcattttggtatacagcatttacttccatttttaaattattttgctttattaattagttggtaattatagaatatatgaatatattcaaatttatattttgccttttggtatgaatatttcatcaggatttattttgtgttgctaccacatttttgtgttattttttgtttttttagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagtaagtattgttttcattcctacaaattatatgtgaaatgagaacaatttaaaaaatccaattctaagtttatatctacgatggaaaaaagaaaatttattttgatgaaagaaaagtaattccttccctctgtgtgtaaaagggctatcactgttgccttacaattaatgagggacatgtccagcaggctttcatcttccttgtcatttttttgttggataaatggtaaaacaaattgaacaggagctagtgactcccttctgtgaagtaacacaggagactggacagctagataaagtgaaggtagagttatatacgtctaaaaatagcccacattagttagatcagcttttgctgacaaagatgttagttgcaaactcacaaaaaagccttgcagttcagggctcttctggattttggaattgtaggtagaggattgtggcattgcactatttccattttatgaaagaacaatctaaagttcagaaagattgtggccaaaggttgcacaattagttgaagagtcaggggaggagtcttgctctgtcagattccaaagtccttattcattctgcaatagaaatcaagcgagcaaagagatcttcagggccatatgctgtgaagcggggaagaataatttggggcaagcatgctgaacaatttgtgttttatttcaggatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctgatggactgatttgctggagttcagggaactacttattagctgtagagtccttggcaaatcacaacattctgggccttttaactcaccaggttgcttgtgagggatgagttgcatagctgatatgtcagtccctggcatcgtgtattccatatgtctataacaaaagcaatatatacccagactacactagtccataagctttacccactaactgggaggacattctgctaagattccttttgtcaattgcaccaaaagaatgagtgccttgacccctaatgctgcatatgttacaattctctcacttaattttcccaatgatcttgcaaaacagggattatcatccccatttaagaactgaggaacctgagactcagagagtgtgagctactggcccaagattattcaatttatacctagcactttataaatttatgtggtgttattggtacctctcatttgggcaccttaaaacttaactatccttccagggctcttccagatgaggcccaaaacatatataggggttccaggaatctcattcattcattcagtatttattgagcatctagtataagtctgggcactggatgcatgaattccactccttccagaaccaactgcattggttttccatgaccttaaggcagtagttctcaactggggggcaattttgcactgaagagagcatttggcagagtctgaagaagtttttggtgtcacagctttgtggggagcatgctatggcatttagtgggtaaagaccagggatgctgccaaacctgccttgcacaggacagcccctgcaacaaagaattatccagacaaaaatatcaatggtgctgaggttgagaaaacctgacttaaggggctgggatgcttttgaactagcttaaggcccaggactgtggagtgtgtggaccaccccacagaggagggactcagatttatttactcttgctggatctgtagtgatggagttccttctggtgtcagccccacaggaggctcccaggcctccctcacttcccatacccagtctaggagctccttctggctcccaagcacccagagctttcctccgccttttagttttggttcctccactggaatgtaggctcctcacgggcgatggctgtcttttcttgactttgtatcttcactgccaagcaaaaagtctgccaagtgggaatgtttaataaatattcattgaataatgaatgaaccatcttcgtacatgaataataatactgtcttacgtttttctggtgctttataatgtatacattacatctgagtattttattttatttaattttcaaaacaatcctttaaggtcaacattgttatccttattttgctgatgaggaaactaaggttagaaacattttgatttcctctaggacgtatagctaggaagtgttactatcttgatttgaacaaattttctggtgctaagtctgatgttctttccatgaatcattgtggtggttgagatggagctttgtaatgggaataaaacagtaccttaggttctttctgaaaaggaggtatctagcaatggataaatagataccactgaatgaaattaaatgttgattaggaacaaatttaaggcttaaaaaatactttatgagcagcaagattgctttaacttttaaaatgaagctttggttctctgatttgtaatgagcacctggatatgtcaattaaaatgcccatttgtgaagcttactcaataaaactttaaattgtcttatttagtctgattttctttaagtgacatttccactttaaggagtgggtgatatctacaatagaaaatattcactaagtaattcctggataagttttaagaaaggtcatcctgctgtctgaaaatgggaaaaggagttatttttgactttctagtaattctggaataatgtgggcctagtatgtagtgagagaagggaggaaatgatcatttttccgtctgcttgaattctctgagagttt

SEQ ID NO: 13827 - DNA, 12981 bp, Human
aaatatcacttttctcctcctttgctccccttcctcgaccatttaaactcaaacctttacagaaagagatgaagacagctcactgtgttaccaaggttaagtccagtttgatataatgaatggtaaagcattacactgagtcagaaaagttgtattcaaaagtcgctatggggaaagaaagaatccaatcacctcagattatagaacttggcctatgataattataattgctgttttctaaacatttacgatgcaccaaggactactcaatctcttctgcatgtgctatcacaattaatccttttatgaggtaaaaatgattatccctcttttattatagacaaagaaacaggcttcatgtggctaagtgatttggccaacacaaagctggtatgaagggaaagcccagatttgaacctaggtttacctgacttgcagccgtgcctttagccaccacaatgtaatgcttcaaggggcagcactgaaatttaacaaggaatttgtaaggcaccttacccaatccaaaatgtcaccagtctgaaacatcccaaaaaaccctgtttgagatgaatgctgcatctgtcatgtaaaagcactacagtgttatacactcttaaaggaaagggatgttgaccaaagaagccaagttatgtgtgtgtggtcgcaggcaacatttcttttccacatttgcggtacaaaacataaccagaacaaacttcttcccttcctcttccaaaggcactggaagcataaattcttgctctttaaactgaaagaagcaataaaatctggacaccatcaggtagatttcaggcactaaaaatagaatgatcgagtaatagtacggatagcagtatctacctacctacctacctacctacctatgttgtgtctctaggtacatttcaatattgtgttcacatacacattttcccaaccatcacggcaagctgagaggagaggtatgtattcccattttccagattaacaagaagccgcacttgataaagcaaaatcagggagaattcgttaaaggaatttcttgacaatccctggacttcaaagggggcaagtgaacacctcgatttcctttcagctgctccgggggcagtttgcacacagaatttcaaatctagtgggcggctccacaggtcattttcgatgaccactttattttgcagatgaggaaacttgggccctgaaagacctgcctagggtctggccagcagtataagacaggtctccagacttagtttctaccgccctccagaatcctctctgtaaaattagataaacagcacgttgatttcaaatgtgaaatggcagagttctgtttatttccccagacccaagagagccggagcgggcggctcttccaggccttgggaaccccggcctgtccccaggcccgcgcggcacccgccctagcccaggcccgcccaaggttccctcgggtcccgcgccccgcgctccctctcaagctaacccctgcccgcaggaagcggggctcggaggctccctcgcaacaaaaggctaaattcggtttccctggttccgcatttccccagggagctctcctcgtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggccctgcagagtcgagagtgggagaagagcggagcgtgtgagcagtactgcggcctcctctcctctcctaacctcgctctcgcggcctacctttacccgcccgcctgctcggcgaccaggtaagcccccggacggcccggtgtcacgcaagcgaggcgcgccgcccctgctaccccgcgaggcgcgccgcccagcctcttttttcggctgcctgcccctccagtcccagccctacgctgcggcctctccggcccatgcctgagatccggcatgagtgctcctcccgcgtgcttccgccgccggtggcttggacccgtcggggctggcgctggtggggcgcgcccttggccaggctctgggaagggcggggtgagttgttttgatcttcttttcactacttgcggccgaagcgccgcccctggaggccgttgggccggcctgcgccctggggctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggttctggcgatggttgagacgcctcgattgcggcgtataacggtgagcgttgtttgggcggccggctcccgcctcggggtcccgggggccttccaatgtgaccgaacaatggagagcccgggcctcggagcagtcagtggagaagccgggccgggcggaggcagcagcagcgcgcagtccctccggcctgcgcccccaccctcccccggaccccccaacccctcggcggcagggtatggccacctccgtgaggccctgagattcggacgggggcccgaggggcagggcgcccactttagggacatttcagtgggaaggggctgctctcaaagtggataattataactccctcgggggcgggaagcggggatcctcccccagccgcaagtccacgaagaaagcaacgaatgaaaattatgaagacaacgagaagtcagactcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccagaaagctccggtgcttggaccagctagagtctgagaaagaggagaggcgcgaacgccactccaaaaagagaagggttaaagagggcaaccctaacgatacgcttgactttctgtggctggggtgagtgagggggcagggaggacgaccccggagttggtgggagctgcagaaacggctgaaaacttcagaatccatttcccccacgtaaacttggcaccgcagcagcagcagttgatagagtggcactaggctgctggcatgcaactcggctcacggaaaagagcaagagatccgaaactgaggcttaggacaaagtgtgcatgatattggtggtgtaacatgttggagaggacagccgagaaattgggttgtaggttttttttttttgttttccgacagagtctctatctgttacccaggttggagtgcagtggtgcaatctcccggctcactgcaacctctgcctctggggttcaggcgattctcctgtgtcagcctcccgagtagctgggattacaggcgtgcacaaccacgcccggctaatttttgtatttttagtagagacgggagtttcatcgtgttggccaggctggtctcgaactttgtacctcaggtgatctgcccgcttcggtgggttgtagcttttagcgggagctaaagggttctgggatggaggtgggaagtaggatttggccggctgagtcttctagaggcaatattggggtgttggtcttccccaaggggaagggtggtgaggctgagggagaagcagttatgttttcagctgggcaaacatggacggttgcccgtagaaactttgccactgtacttcagaacgttgccctagtcgttggaggagaacaatgtgttccctttctagccaccctggtccacggagggaggagggagagagagaatgtttcctcttcggctgttgtggcttgagagtttctcttctttcggaggttttgtggtagtggctggcagttattagtatgcctcatggcttttaaatttccagatctttttgatttagaagtggaaatttcctaattacttgaagtcttgtagaattccataatgttgtgattcttgcccactatcttaagtgagactttgcatgagacctatggaaattatggcagcattccccttagaatctggcttgaatcagcttttgtgtaggaaactgctagccttctaaatatattgtaaccttgtttcatcctcaaatctaaatgtgtaatgagttttcttttggtggggaggggcggtgggtttgagttaagaccacagctaggatgaaaggcaaagagaaaaacaaactgtggaagccaagcctgttctgtggctggattttacttatattggaagaagttctatgttttgtaaatttgtgtattggttttgatttgtttcctctgatagtttagtatttggatagtttagtgttaacctcagctacactgaaggaatagaccttagtcctcacaagtataagttctagcttggaagcctgggttctgcagtagctgtggaacttaagcctctgagctcagggatgcagaggcattgagttactaccaagggcctgatcttttctttagcaggcatctgtgttaattgtttcaaaaggtggtgatcagttttacagcctattataaaggagatttttgcctactataaaactaatccccctgaaagagtgagtaaacataactttttgtgtgttgacttccacaagggaaggagttggcacttacactctgacttttgattcagtcgtccttcttgagccatttttgcaggggatcagtttggagtgggcgttaacaatgttattctttttttcttctccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaaggtgagacagcaatgtggagtggagcacatgctgggtgggatctgcagaggggtgggcagcagcctttgactcagcctctggattaggcctctttcttctgtttgtaaaggttttctaaggcagggcttttcagactttattcagtcaacattaagctcctacactgcctcaaagcagagcgacgatggaaccctttatttcaatggaattgtgcacgtaggccagtgtattgaagaaaaactaagtctggtttatggagagttggcatggggcttagaggttgccgacctggacatccccacttagctggctctaaggcaccctcagaaaaccactgctctaacctgagaatgccatctagtttacaaactcttagaaaactgtgtttaatactcatatcactggcttctagatgtgaagcaaatgctctacaatggtttttaaataggactaatttttagttgatgccacttttggaaattcttaaactaattgcgtatccctctaggagctacagttagattatagttgtgaccttcatttttcagtctagaacaagccatagtcttccctcttctggaaaggggccagaggaaagtatcatatcctacctagtttagggtagtttacttttcctttttgagtaagtgaatgatcataatacaaagcctatattgtgtacttgctatgtggcagatgatagtgcacagacactgaagatacaaagtgagagtctcgtctctgccttcagagaactcagtcagctagagagaccaagcagccttcaaaacagtgggaaaggtggataggtgataagggagcatcctagagtaagtcatcctgctagtcgtctgttccctcatctataaaataaggacataacttgccagaatacactgggggcataagaaggatgcaacacattacctaatggaagaatcagaatccttcactatctcaatattttaagtgattgataggatggtagtgataacagaatgcttcagcttgtctcctggaagacatttgggaagggagtatctgatatatttcttttaaggaattggtacaatggtcttacttggaactcaaataggaagggctataagatcaggtacaggtgccagggtatacatattaatgatggcatttataccttaatgaattcctggaaaagagatatttagagatgggaaggtgagtgaagggctggctgtatttgcattgcttggaaagctcctgtatgttttaaatgtaattttccctctttttgccccagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcaggtgtgttatagcacagctatggatacccctcctcaatctgtgaatgctgtgaaggggagggagaagacattctgaaatcagcattgggaagactaggcaatttcagcactattttaagaatctgagtgattcttttccctgaacttctgctttgaggaagagataatatggcccatctttctatggtcttctctgttggttgcataaaatagcattggatttgtccagatctgtttgccggtcttggagtccccagtaacagccttcctgcctggaatgtaggccaggacaaatgtaaaccaatggacaaatgtttctcaaaaattatagaatggctccaagtgcctgagaaatgaagaataaatctgacaaccagaagcagctgtcttgtgaatagagggttaagtgcctggcatttggtgcttgggaggtggccagaatgcagataaggtgaaagttgccctgttctaaatccactcccatgtgacttggttgtaactgagtttagttaaaactgaagtctttcagagtcttcctacagatgtacaattaacagcttctctcatttttctgactcggtgatcccaagaaggcctatactgggtcagttcataccatagtgcacacctcagttgtatagaatccaaggactattctcccatcagcatcggtattcagcatctatgtctttagatccctgatggcgtattattgactcttttttctagagaccaatttgaggcacacctgtaaacggataatggacatggtgagcaaccagcacccctggtttggcatggagcaggagtataccctcatggggacagatgggcacccctttggttggccttccaacggcttcccagggccccagggtaagtctccttgggttagaggtgaaattcccagaagtgtctaactgtgcaggaatgccccttcccagggatgggaatgactttcagaatcaagaagcaaaataatacagtaaaggcgaaacagccctcacatcaccaaagtccaaaaatggatatgaatatataaagtaaggttttagggggaacgtttggccccactgaagctgtggtgaagaggaactcccctattgcccctcccctgccccgcacctgcagatgaaggcaaggatagtgattcaagagggcaaggcttaagggccttctgatctctgactttgggattctctggatttcttgactcttagtgttttgtcctgatgcttctgtaggtccatattactgtggtgtgggagcagacagagcctatggcagggacatcgtggaggcccattaccgggcctgcttgtatgctggagtcaagattgcggggactaatgccgaggtcatgcctgcccaggtaagtatagctccaatccatcaatgaagaagggtaggtaggtgtacataggacttttgctagtaagggctgctgatacaccactcactaacccaaaacctaagaacgggttggagtacaggtgagaagagaacaggtttaggagattctgagttggagtgagcagttagctttgttttaatggccaagcttctcgtt[450 bp omitted]ataatttatataatatatattagtcatatatcattatataaatatatatcgatatatatatttgtgacatatgtcatggtgacagggaaaagttgacaaattcatgcatttgaaaatcttttagaactaaattagtaacaatacaggcatgtggataagcttaatgcttatgagggggagaaagtttcaaatgattagtcttttcaacaaacagtaactttgtactgcttgtcgggcactgttctcaccactgagacacacaggtaagaagatgcagccactgccctcatgaagtatttgttctactggtatcatattttggtgcacttcattcttggctccatacctggagacaaggttggactgccatcttttctgtttactctaggtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgattcatttaagtaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcctggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttagccacccttacaccctcttggatggtgtatcctacagtgtaagcactaaactgaagaggcagtgacctgagcactttggattttgttcattgtaatcaattccatgacaaaatgattgcatgagaaggaattttaaattcataggatcagaatttaggtgaaaacaaccagcatatttgtttcttcaccctctcacctagaattagctttgacctacaggtcacagtgcaatccccttgtatttctaaggtgttttttatagttcatttgcagacaatgggttatgtgataacttttatcagtgatagattaaacagaataatgaccaagctttcaaccttaaggagtcaggccagtatttacaaaaggaggtctccatgaactccttaaatatgagttcccctaatatcatcttgccaggtactaaataacaactgatagcacaagctatagggaatttgaaagaattccatggatgggtgttgtctagggccttttgttgtttttgagacggggtctgactctcacccaggctggagtatagtgtggcgcaatcttggctcactgcaacttctgcctcccagattcaagcgattctcctgcctcagcctcccaagtagctgagactacaggtgtgcaccaccatgctcagctaatttttgtatttttagtacagatggggtttcaccatgttggccaggctggtcttgaactcctgatctcccaaagtgaggtcttgaactggtcttgaactcctccacctcccaaagtgctgggattacaggcgtgagccactgcacctggcctagggccatgtaaaaagccagatctgtgctgctgtctgtgtagaagggtagacaagtggatgagaagttcctgaactattcttggcccttttaccactaagtgaaagtaacttgctgccccaaagaaagatgtctcatcattcgacaggactttctagttga

SEQ ID NO: 13828 - DNA, 87323 bp, Human
gggcggatcacaaggtcaggagatcgagaccatccaggctaacatggtgaaaccccatctctactaaaaatacaaaaacaaaattagccaggcgtggtggcgggcgcctgtagtcccagctacttgggaggctaaggcaggagaatggcgtgaacccaggaggtggagcttgcagtgagccgagattgcgccactgcactccagcctgggcgacagagcaagactccatctcaaaaaaaaaattaaataaaaattaaaaaaaaattaaaattaaaaaataaaaatagaaaataaacataattatttaatgtttgccttctcccattagaatgcatgttccatgaggacattaatgtatctatgttgttcatggctatatcttcagtgccttgccaatgctcaacacatagtcaaatcttaataagtagttgctgcttaacctacagaatgggagaaaacttttgcaatctatccatctggcaaagggctaatattcagaatctacaaagaacttaatcaaatttacaagaagaaaacaaataaccccatcaagaagtgggcaaaggatatgaacagacaattctcaaaagaagacatttacgcagccaagaaacatgaaaaaaagctcatcatcactggtcattagagaaacgcaaatcaaaatcacaatgagataccatctcatgccagttagaatggcaatcattaaaaaagtcaggaaacaacagatgctggagaggatgtggagaaatagaaacgcttctaccctgttggtgggagtgtaaattagtccaactattgtgaaagacagtgtggcaattcctcaaggatctaaaaccagaaataccatttgacccagcaatcctatcactgggtatatacccaaaggattataaatcactctactataaagacacatgcacacatatgtttattgcagcactgttcacaatagtaaagacttggaaccaacccaaatgcccatcaataatagactggataaagaaaatgtggcacatatacaccatagaatactatgcagccataaaaaggatgagtgcatgtcctttgcagggacatggatgaagctggaaaccatcattctcagcaaactaacacaagaacagaaaaccaaataccgcatgttctcacttgtaagtgggagttgaacaatgagaacacatggacacagggaggggaaaatcatacaccagggcctgttggggggtggggggctaggggagggatagcattaggagaaatgcctaacgtagatggcgggttgatgggtgcagcaaaccaccatggcatgtgcatacctacgtaacaaacctgcacgttctgcacatgtatcccagaacttaaagtatatatatatatacactttatatatatatatatatatatatatatatatacactttatatatatatatatatatatatatatatacactttatatatatatatatatatatatatatacactttatatatatatatatatatactttatatatatatataaagttaaggatttcgtttcaatgtgcagctaaaacttaagcactaatagtcaattgtagctgtgttttcctaaagccctttgacctttattttccacttcacaaagtttgttacatatatgatgtattgccctctttctcttttccctcttcccagtgatgcatcacaaattattgcatttttattgggtgaggcccagctaatctctctgtttatagctctgacctttctgggtgcaaacacaaagtgaactttggtttatctcctgccataatgtagctgctaattactggcaagcaggctgtgttccacggcccatgtgaccagttgggcatgaccagagagaagcgtggggaagagtgggctgagggactccactagaggctgtccatctggattccctgcctccctaggagcccaacagagcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggtaagaaaatgttaatagaatcttcctccactctgttactacctctggggacaaaatgttgctaagcaaagaccttgtgttctttgatcacacaactttctctaaggactgtccctaaacccctttctatttcatgacagtagctccttagagagaagaatttgaaccctattatgctgtgctcactcacacttcaccttgctctgggactagccctgactcaggaaatgtaaagtgttcacggcagtgaaacgtcccagttaaaactgggtttaggccagatgtggtggctcacgtctgtaatctcagcaatttaggaggccaaggaaggagggacactgagcccgggagttcaagaccagcctgggcaacatagcaagactccatctcttcaaaaagaaaataaataaaaataaactcagtttattgcccggttccaggaaggcattatgtttccttctgtactcagaggtaagatttggtctagacctaagatttcacagggatactaatcaagaagatgaattaagacagtcaatttcacatagacaccaaatctttctctgggccttttatccagagaaagacatttgtctctggcctgttcactcttttttttttttttttttttgagatggagtctcactctgtcacccaggctggagtgcagtggcacgatctcggctcactgcaagctctgcctcccaggttcacgccattctcctgcctcagccccccgagtagctgggactacaggtgcccaccaccatgcctggctaattttttgtatttttagtagagagggggtggtctgttcactctttacatttcctgtggctgtgattactagacatagttaatataaaacatttgcaatcaaattcattgttgcagttcttcattgtaccttttagttataaaaataaattttataacattacatgaaatgtgtaaaataaagggggaaaaaaagcagccatgattcccagccacctggatgtttccagtctgttttcatgtgcttcttagcttcctgtttttaagaacgtggttggtgatcactatggcatagaaacagttttggatccttctggttcacttcacattattgcacaagtgactttcctagagcgtcatggcctttctagtcatcatgtgaattgatatataatatccgccagatattataatatccagtatgtattatatccactggatataaattacctaatttgggggatatatatgataagatatatataaaataattctctgatgtaggatatttcatttgttttaaatttctcattactattttcataatacttcaatgaacattttcattttctgcattccctgagattagattaccagaaatagacttattgagtcaatgagtatttaatgcatcttaatggttatttgtggttttaaggatggtatgtcttaattttctctatttaaaattctgtggaagtagggcagctgttcagatatgaataataagttacttctgtgcacacacaacatctctccaattctgaaactagattcacacataagtgaacggatttgatctagagccataatggaacaaggaggttatttagtgaaatccccttatttaccgaggcagtgtggtacaatggaaagaacacttgatttgtcctttgaggacctggactgggatccctgccccaaagttttctctctctgtgatcctgggttagtctccctgagccttggtttcttcagttactaagtacctatcatggggtagctaagttctaggtacttcaattacatcacctctttaatcaccacagctctgtgaggttagcatggttgacactggtttcacagcaggggtttaacaactttgctaaggtcatataggttgtctgtttgcgggtcactctttggaatccattgtaatatctttacccagtgtgaactaagtttctaattaaaacaaggcagtggaacattatggttagaagcagatatttggaacctgacagatcttgatttattttccagccagaccattcacaacaggtatgaccttaagcagctagttaaattttcggaacctcagttcccacacctataaattagaataagtggtagttacccgatatgaatagcatgtggattcaatcagaaaactcatataaagtacctccttcactgactgaaacatagtaagaactcaataaatggtagttgttgctgttgttgttattgacattaatgtagttgttcttattgtttctgtgctgttgctactgctagaacacattaccaagcacctaaaataattaaatagtatgttagttagagccttggtccctgatgcatacaatctgaatttgaattcctgctccattatttacagttgagtgacattaggtgagttatttatcatctccgagtttcactcaagtcatttgtaaaatagttattagtgggcaggttgttaaatggatcatttaagtggagagctctatggagatgaaggaataagctgtgatgcccagacttttacatttgttagtgcattttgttggatgaatatgcatgcatagtaaacacaaaaggtacaggtttttggggaagagatagctcatgttctaaacatgttgagcatcattatttgggaaaaattataagacaatatatctcagggttacattgaggaaaagtaaaagttcaagcgttatatgtgatgttcaaagggaaatgatcaatattttttttaggaatcaggaaagctttgagggtcttgaagaacattcaggatctagtgggaaagaacatgaaaaaaagagattccttcgacttcatgacatcacctccctgaggctgtatggttccaaggctaatcacatgacccataccctgtgtgtgctcccttgtgctgagctggtcccactcctagaccctagcaccaaggttttagcttcatgttggtccacgttggtccaaccccatccttaaacccttagataggaagagagagttctgagctcgccccatattgttcagctttccatccatcctcccaggaatgagatatcattgtggggtagagagtgccggtaggaaaggatgaaaagtagcatgggggaaatggcttattttaaaagtaaacctttgatttgaagttatgtcattgtctgaaaaatgtttagtattttctagaaaaatcacttgagttctggagtgataaaagggaagacattacccccaccaaattaaaaataagagaaagcagtacacataaaagtaaaatattgagaggcagcatattatactatgctccatagaagccattctcaaatattttggtattaggacctctttatttatttatttattcgggacagagtatcgttcttgttgcccaggctggagtgcaatggcatgatctcagttcaccacaacctccgcctcccaggttcaagcgattctcctgcctcagcctcccaagtagctgggattacaggtatgcatcaccacatccagctaatgttttgtatttttagtagagacggggtttcttcatgttggtcaggctgatctcgaactcctgacctcaggtgatctgcccgcctcggcctcccaaagtgctgggattataggcgtgagccaccgcacctggcctaggacctctttaaactctttaaaattaatgagggtgctgaagagttatgtttatgtggctacatatatcagtattgattgtattgaaaactaaactgagaaacattttaaacattttttataaattcatcaaaaaaaataaatatctgttagcataaataatatttttattaaagaaaacctatatttctcaagccaaaaaagaaaaaaaacaaagcgagtgagaagactggtttacacttttgcaaatgtctttaatgtcaagcttaatggaagatagctatattctcatattggcttctacattcaatctgttgcaagaatatatgtgatatagcctctggagaacttatcatatgctcatgagagaaggagagtagaaaaaaataaggaatgtcttagtataattataaaaatgactttgacctcatggatcccctgaaagggactaaagggtacctcagtggctcatactttgagaactgctgttctacagcatatcaaagttctagaattagacttccctaggttcaaatccctgcgctactacttgcaagctgtgtagccttaaacaagttaatctacctctccagacctccattttctcatgtttaaatgaggatgacaaaatattaccttgaaggattcagagaggattaagtgaaataatacctgtaaaaaatcacagcccaaagctaggcatatagtgaaagagatcaactggctctattctattaacaagtggatgaggaactggggcccagtagggaagtcacttgtctgaggtcacactcaacagatgttggttccctttttcccaggcactgtgccagggtttctacttgagtttagctgtatcagtcatgggctgccaggagcactggatttttaagtgtcattttcactgtccctcatggtggtaggacagaacaaagccctcatagaggcaggaggtcaagagagaggagctgcaagtgtggccatcttcatgtgactgtgtgctaccctccacgtcactttctgactcctcttgcagtgttccaagaccctctctaaccctattttctacagttcctcacatgccctctctcattcccccaggtccactgtagcctcattcattctgttctcctggtttcaaattctctatatcctttctattgtcatgaaaattaaataaaaggcatatggggcttagtactgaagctgactcgcggttacactcaattaagtgtgaactgctattaaacccatcactccccacttctcttccattagatatctctgactggtctaattacattgaagtctcctatttggctagtcctaccaaagtactgacatctctcaatcagctatcttactgaataaagtatcagtgttttcgaacttaaaaaagcaaagttggtagacatctctcaagtggctgtagaagtgcaaagactcctccattctttgaaagaacaagtctctacctttaaaaacattcttatttgttcagaagaacaacttctattatagacatgctttgctcttttaaaggtgctattaaaaattatcccattttacaaacttggttttaacctcattttacatgcgagaaactaagtgagagaaattaaaatggcttgtacaagaacacataagaaatcactcataatgccggactgtggactgaggtttccagactccctctagacttggcaaacttaagaacatccctgcagctgggcacagtggctcacgcctgtaatcccagcactttgggaggccgaggcgggcggatcatgaggtcaggagatcgagaccatcctggctaacacgatgaaaccctgtctctactaaaactacaaaaaattagccgggtgtggtggtgggcacctgtagtcccagctactcaggaggctgaggcaggagaatggcatgaacatgggaggtggagcttgcagtaagcagagatcgcgccactgcactccagccagagcaacagtgcagactctgtctcaaagaagaaaaagaaaaagaaaaaaaaagaacatccctgcttaggaatcagacatttgtcctgattattttttactggaaggaaccaaaatttaatagattgtggtcaaatggttctgctattcccttctaaaacgtggtgcctagcagtccccagggatatcgccagcaagacccttgctttcatctaaatatgggagttctccattatacaaagacctcaagccaggatgaacataattcactttggctttgggagtagcccatagaggaaatgcctaacaccaggagtggtgttctggtcagtaaggccagccatccttgtgaccaaacagatattttgaagagaaacttgttttcaattcttgtattgctttctaagaggagaaatgtgtgagtcagagtgaaatccaaacaaaactctcatctaatttaggacactaatgaacacatttttgttttctttatccttgattagaaacattttaaagtaagaggatgtattttaaagacaaaggggttttctggcaattttgtaatgttacacaatctccttccctgtctactaagaaagaaaacagaattctgcagcaccttctttaggaaaaatagatgataattaactgttaaccattttcatttcatgtgagaagtgtgggtacagctgcagggaacttcctgagggtatgcaggtatttttctcatagactatttactcagtatcttgaatgctccaggagagacagggtctaaaaattgtaatacagcaagattcattgagaacaaacaatcatacccattgataaattttggatttaacattttggtgcatcactaagctggtaaaaggccattccctcatgcgtgagttttcatttgagatatcaaaaatgtacaattggtttgggatgagataatcacggcttccatttcagatcccactatttactgcatatgggactctggtaagacaaactcaataaagcttttgtctcaggctttgatttctagaaaactgaccaagacaccccttttgagcaagaatgataaatctgagccacagatgtgacagctttttatcaataagaatgattgcattaataactatttctgatgggtgtatttcaactgcttagtgtcctctctatctagaagtgtgacaggcatctcacacctgacatgtccacctccatcaccacacacaccacattagcaaacctgctccacccacactctttctcatcttggtcaataggagttcccttcacccacttgctcaggccaaaaatattggcgttattctgagtcctcttttctcatacttcatattgcatttatcaatttcctaccttcaaaatacatcctaaatgcaaccatttttctctacttttgctccaactactgtagtccaatctaacctaggttatgaatcgtgtcttcactagtctccctgcatttgtttctgttccccacaatctattctctgcatcaggatccagagatatcctttaaaaataatagtcagacaatatcatttctctgctcaaagtcctccaaaacatcttatcctggaataaattgaaagcacttactaacgtccacatggtcatgcacggtgtggcctcactctgacctcacatctcacccatactacctctcacttactctgtcaggactacgctggcctccctgttctttctgaaatgccaagaagggtcctgcctgggatttttgcccttgctgttccctctgaccagagaaaccatgtgtcgcatggctaagtcttcacgcaggtcccagctccccctagggcttccatgaccaccctatcagaaatgcattattctgtgtgacacacaaagaaaatgtaagcctattgaaagggggaacttttgttcaatgctgtatcatgagcgcaaagaagagcgcctggcacatagcaggaacttaataactgtttgttgactggatagataaagatcagagaccaaggaagactgcagcctcctgcaagttggcaacaaatagcacctggggaccatgaaagaacaggttatcataatgtttatgtctttgcttcccaacactctccagtccatacaggagacctgctgcatctagggttgtgaaaagatgaagaggtcagtgaacacaatgaaaatgttctaaaactggaccatgtggatggttgcacaactatatatatatttactaaaagtcattgaatcgtaaactcaacatggatgatttttatgatagataaattatacctcaataaaactgttgagagagagagagagaaacagagatgaaaagatacagagagacagagacacacagaggaaaaaagtgaccaggagtaaaacaagggctcaggatgtaaatattcctaggcctgaaaatggatatccattttttcccagaatcaatctcatggctgatataaattactgaaaaataacactagtgttctattttccctcatctctgggcgacaggcctaaatgtgactgtgaacgctactttcatgtattcggatggtctgattcataactcaggcgactgccggagtagcacctgtgaaggcctcgacctactcaggaaaatttcagtaagtatttgcttttgtggatgcagctcatggcctctgggcacaggataatcccagtgtgaaatgtaggcacatgaccatgaagcagctctcccatcatctctagccacatagctgaatgagtggccgagtaccaggcaggagactctggctttacccctacagattacctaaatgacaggggccctccatgaatccagaaaagtgaggaaagccttggctatgtactgtgtgtacactttcatttgtaaggagaggaattcttttgctttaaattgttttaaaaattttgttttgttttgtttcttgggtgtttgtttgtttgttttttgagacagggtctccctctgttgcccaggctggagtgcagtggcataatcatggctcactgcaggttgagctcctgggctcaggtgattgtcccatctcagcctcccaagtagctgggactacaggcatgtgctaccatgctcagcaaatttcttatattatttgtagagacagggtttcaccacgttgctcaggctggtctcaaactcctgagcttaagtgatctgcccccattggcctcccaaagtgctggaattacaggcatgagccactgcgcccagccagtttttaagtttctttatttaaatgttagtataaactggtttgcctttgtatccctcaagaaatacctgagaaatcatgtttaaaaacatatttcaaggccccacaccagaaatctctgtttcaagtcatcaccatatatcaggtcatagttaattgcttaagcgttgaatctgccacctaacttaaagtagtaacttcaatgtcaaaggatgaaaatgggaagagggagattcttgcctagttcctcctcctaatccccaaaccccaatcccaaccagagctttaaggaaataaagagggttaaaagctctctagagacaagcagatgtgcaatgcacccccttaatacagaaactaaagaaaaggctgtcttagcagcagagcactgggagtagagccacggctctaaactttaatcaataacatcacaccaaccaggcaggccacactcccatcaggaacaatggctaccacagcagtgattctcaatcttgggaaggtaaggtgtgcacaagcatagttcaataaactccacatcacaatttcagaaatatatgctgcttttctctgcctctacagagagaggtataacctggttctccaaaaccagggatgagatggtcccaaccagattccccttaagaaataggagaaaataagatcaataatcacccaatcaattgcatagcattttactcacttcagccctgttttatagttctctctacaactgaaacttgccctctcccttcaaagcacctccaaatctcatctcaccactatctggcctacagacactactaatgctacagcctcccagtccctcttctgcctcttcccatcctgcattgagaaggaagccaggttcacctccagtcagctcacctttgtaaaatacctttcctccctgtagtgtgttttccctctcgaacctctccatgcctcagttgatccttgtccagaccaaggcaccctatgttgctctgagtttgagcattttgggaggcccaactttctaaacctctgggagccttccccttgctacttctttcctgtccactgagtatttttcttagttctaggaattcattgttgttttctctcctacagaatgcacaacggatgggctgtgtcctcatagggccctcatgtacatactccaccttccagatgtagtaagtaatactactgtgaactgaagtcaggacatgatattgcaacttaaaggactcatcaaacaacagtctagtcaagccaacacaatcagaggtgttgaggtctagtattttgccatctccccataactgtcattctcttatccaggtaacttcccttgctcagcatggagtgaatgtctgtagccattcaggttgagtcattaacatctgaccttgagagaaaacatggtatgggtaaaaagtcagagttttgagagaaagcaggaaagacagtgaaattggataatttgaggcgtttaataaataaaatattcacaaaagtatgggtagagggttgggaaacacaaaagaaagtgcaacaccccagggtactagtagggttctgttctatcctgtaggtctggtaaaagtggggaaaataacaatatatttagttcatgttatttgagaattatataaatgacatgttaaagtcctttgtacagtgcccttactatcttagaacaaagctctcagtatattctagaatgaatatatttttctggctctgggaaaatcaccctcatctcttccattcattttacacaatgtaattatcaccaaaaaatactttgttctgctaattacaccttccctaatcaaaatcctgctcaagttccttttttgtacctgttcaatctgaccctgaatcaagaatcacgcttcatcgacacagagaaaactgtgcagaatatcacttgcaatggattttggagagtaaacattagacctctgaaaattctgttgcaaagtttgcttttgtcacctcacacccaccattacaaacagcctcagatgctcaggttcactgagcactttttcagcttctcttccataccaaaatgcggacagatccagaatcttactcttccttgtatttgttcccaactgtcatctaacctgatcacttactaatattgctacagagtatgctcaaaaggaaaggaggattggaaaaattgattcaccatttatgaagaccttctacgtgcaaagcattttagctgtggcagagtagagagaattaagtaaaacacagcccctgtccacccaaatagagaaggtgacaaggactctcctgaccaatacaaggcacagtgagatcaatgccatcagggaaatggaaacaggaaactgcagagggcagggatcagtggcaccagcctgtaatgccagggctttgggaggccgaagcaggaggatcccttgagcccaggagtttgagactagcctaggcaacatagtgagactctgctctccagaaagtttaaaaataaaaaaattagccaggtgtagtcatgcacgcctgtagtcccagcaatgtgggaggccaagatgggaggatcacttgaaccgaggaggtcaaggctccagtgatccaggatcacaccactgcactccagcctgagtgtcagagtgagatcctattaaaaagagagaaagagagaaagaaaaggaaggaaaggaaaggaaaggaaaggaaaggaaaggaaaggaaaggaaaggaaaggaaaggaaaggaaggaaggaaggaaggaaggaagggaaagaaagaaagagagagaggagaaaaagaaagaggaagggagagagaagagaaaagaaaagagaagctatagagtgcacagaagggaagggtcacctctgcttgaggggactaagcttcaatggaggaaaaaaatcttatgaaggagatgcgattgtttgcatgttgaagaatgggtaaaattttaatgagtagagagatgaggagatgagctttctagccaggcagagggaaagaagtacatgtaaaagcaaacaagcagggaaatgaagaactctgtattaaccagagttcaggaaatgtataggggaataatagagataagactaggaaaattaagtaggaccatatttggaagttcatgggaggaaagtccaggtgaaggaagttgcatttaatgagactcacatcagaaatcactaaggttttaagcttgggaatgccatgagaagcagccaactttcagaagaatgattgaccacagtgtataggaaagacacaggcagactgatgacaggaaagtcagcagagaaggagggcctggattaggaagaaggaagtggacatagaaagggaggataactgcaaagatatttgaaggtagaatcaatcaatggtatgatgctggggtgagagatggaaagtagtcaaagaagcctttgcaatctcaaaacactaaaataaatgaaaaaatctcaaaacactaaaataaatgaaaaacagtttggaggaacagaaatgaaagagaattctgactgtgaacattgtagtttgagatgcaagcaggaagcccactaaaaccttttgatggagcactgaagatgtaaggggatgctgttttccttccttcgttaaatacatactaagcatctacatacaagcctagatgactggagataccgaggtgaacaagctggggagaaggcaatgcatggcaaagtgtagatggaatctttttggctttacaacaactatggtggctgtggtggtccatcctttttcttagcccgacttcccctgtatcccagcccagatatcatgatgactcactttagaataaatcgaagtaaccaagccacatattcacaaaattgcttagagtgtgcttagaacatagcatgtgctcaataaatgtttttaaacttagctgtatgagaaagacacctatatacatgagaaacctgctttaatgatccgatttcattcttaccatttatacatacatgctgaaacaggttaaagagggatcttatttgtgctacttaagttaatactgataatggcttttttcctcaacctcttgacatagccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaagcaggatcattaatatttcactagcacttgccatggagagaagccataggatcatgcaggccacctagttattaccagatgcaccttccactggtaacagcattgggtatagacatcagttcattttctcacacataaataaaagcaaaggggaccaagtaaatatagagttgtaaaaataatcagtatagtttgcatctgcaacactctttactgttttgaaagtacgttcacatcagttttattgatttcctgcagtacgttatctgaagaaaataaaacaagtaataggatccctattttatagacaaggaaaatgaaagccaggagttaatgttttcacattcctgtgtaagaaacaataccagagaacatgtatcttgcctatacctacaattagttagaaaaaatgatctcacacttcttcagagaaacaagaggtaggggagaaacaggaataatgggtattgtattaataatagtttgttttcatactgctataaagaactgctcgagactgggtaacttataaaggaaagaggtttaattgactcacagtttcgcatagctggggaggccccaggaaacttacaatcatggcagaaggcgaaggacaagcaaggcactttcttcaaaaggtggcaggaaggaaaagtgctaagcaaaaagggaagagccccttataaaaccatcagatctcatgagaacttactcactaccatgagaacagcatgggggaaaccacccccatggttcaattacctccacctggtctctcccttgacacgtggggattattgggattatggggataacaattcaagatgatatttgggtggggacacaaagcctaaccatatcaggtatcattactaaaataaaatggaaagattcattcaactccaacaaaggtggtagaagaaatcttctggctgggttgctgcctgtacttccaggatgctgcttaattctgcattctttctccatctaagtaagcaaaagactaagatgggataccaccagggatgcacgtctagagacccacaggaatcaacccacagtatctaatgtgaggtttaaacagaagcagaaaattattcctatcaactctgaatttttgtactgtagattcaagggtttcaacttatctataatgggactagtttatagagcagagcagaaccctcttcctgcaagcagccagaaaccatcacaaatgactcaccaaatgtcagatatcatgacaactcactttaaatcaaagtaaccaagctacatattcacaaaattgcttagagtgtgtttagaacatacactgtgattatggggataacaatttacatgtacacatgaagatccctaaaagttcccccatcctttcacgaatttagatcttacaatctaaactagtggtatcatggtgtgtgctgtctattgtgttaatagcagaaatgaattttagatgaacaaatcccaggatagatctgcaaataagaagtgaaaggcatgaaaggccatgagggaagtaagctgttttagtttctattttcctattccaggtaccttaatgctctggaggctagcgtttcctatttctcccacgaactcggctttaaggtggtgttaagacaagataaggagtttcaggatatcttaatggaccacaacaggaaaagcaatggtaagaagacatgaagataattgttttttgctaacttcttctttatgactaccacctccttataagtcatttcaacaaatcctccactgcagagctatcatccttactcatacatattttgtatattttgggagatctataattgcatgcaacttcattatattgttcctttcattgactaaaaaccttatcctctgagagaaaatacctaagtattattgagtaattatattaacataataacgataatgctaaaatccggcttttataaacccaaatgatattatgacccaccctcagcagactgtttttttaaattcacctcaatccaacatattattggatttgtgaccaatcttcacacattctgagccccagtcctcctggtgaccaagaggatgaatttattgattacatagcttcatgcaaaattacaacgtaagcaaagattatctcactttcctattccttctgtatctcacctgcccagtgatctaccagctagagaccaagtaggaaagcctaattggatataaaattatcctcagataaatgaccacacattgggtacagcgtacactgcctaggagatgggtgcaccaaaattttagaaatcaccactaaagaacttattcatgtaaccaaacaccacctgttcccgcaaaaatctattcaaataaaaagaagtcatcctcactaagatattaggggatttgttgcactttccacagaattctcttgacaaacaagaatgtatcaggggcaaaggaatccattgtgagaattttctacaaggaaagatacttgcttggtggatttcctgatattcaaatcatcatttattgccattatcaagcatttgttatattaatggcctaccagttgcaaaaacattaaccaagatatggtgggaaagaaatatataagtatctatgtccctaaagagtttacaattcaacagggcagcataatggcacagcatctaaaaagatctaatgaagtctcccccaactcctctcactcataaaactgcattcaggatagctagcagaaattagtggtagacttcagactggactctggcattggagttactaagatgaagttttgagttaagaggctacagataaagcccaagttgcttagggagactttataaattcttctcagttctcacttttataatatctttttcaaccacttttacaaatggtgaggtatacttcacttatctatacaatatattctgtaattactccagcctggcataatggaataagcactgaacttgactgtcagagctgtctttgtcatctactagttctttgaccctttgacatcttggcttcagcctccttaaatctataaaattaaaagaatgatggacgagatgatttttttaaaaaagatcccattcagctctattctgactctataattgtaaatgaaaaaaaaaaggaaggaggaatttaaggaattggagtttatctttaaaaaatttaacattaacatactggattcaaattcaggcaactggttccctgcctgtttgtctgtagactgtcatatatttctctccttgtcttaccttctcctccagtgattattatgtgtggtggtccagagttcctctacaagctgaagggtgaccgagcagtggctgaagacattgtcattattctagtggatcttttcaagtaggtataacatttggaaaaaccctcctcctttcaaaaaggaagtattccaaggatttccagaaggcacattctcttttctcttgctttgtacaaccccttatggggttaagtatgatgataatatttgaactctgtcacactgtcattcttatttagctaattgtggctttagcagagatgcattcctttgacaccttcaccatttgtaaatataaaaggtttattatagccccattgaacccacatgtccatttatgactgaggcctgctcagtcaacatagaatcctggctgtctatggtcactcacacctgtaatcccagcattttgggagacccaggcaagaggattgcttgagtccaggagtttcagactagcctgggcaacacagtgagaccccatctctattaaaagaaaaaaagaaagaaaggaaaaacatacgatcctgatctctagcctgattttaaagtctttgtccagaaaatgataaatcaactaaagactcaataatactgttcctggtaatgtcagccccatttttctccttcagttgctaatggcctttggtcctagattacttttccttcaaccacctctgataagcttgaagtttcacttgtatgagtctgatatacacaattattcctcaccctctgtggcgtagtcactaggtggtgatcttttcctccacatttctctgagccaaagagaaaaaatgctggagcgtagagagcacctttgttcacatcccatcttttttttaatcgctaattatctgaaatggttggagaccccactgacaagctgtgccaaagtaatatttgagtcaagttaggcttgaagaaggtgtcactgccatgcccatgccccttgcccccagaagccagatcacgtgacttcacttatctgactgggccattaatcattacctgtctgtattcagacaagaggctgctactgtctagatctttcccatatttgcctgatcatttcacccacactaacgatacttctcacagcatgaatggaaatgaagtataggaactgcaggcctgtttgatggctacacgttcatgaaggtaatttaattaaccaactagactctaaactacagaagtacaggaaagagggcagagttactgatatttcactccaagaacctcattgatttcaatagctgctttacccctggaaggagtccttactgtagccaggttggtataattttactttcagaaatcctcaataaaccaccaaagtgctggcattcctttgtcactattcccaaaggacacctggctatgttttggaaagctaatgagactaaattagacataatgtgttcacattctaattctgacacttctggttgttttgactcttggatttttttagcattttaagattaaatcttctcatttgtaaaatgagaattaaaatgtcctcttcataagggtacttctaggattaatgtgataataggagtaaaatatccaatacagttctcagcacatagtagatgtgttcaaatattaaatatgctgggcacagcagtgcatgcctgttgtcccagctgctcgggaagctgaggcgggaggatagcttgaatctaggagttcaagaccagcctaggtaatgtagcaagaccttgtctcctaaaaaaagtttttaaataaaaacattaaataatggtcagcctaattgcagcagttcaaacataccagattcttttcaaatctccaaataataggaagcttagaaaccacagcatttgaggctgggtgtggtggctcacacctgtaatcccagcactttgggaggccaagacaggcggatcacctgaggtcaggagttcaagacctgcctggccaacatgctgaaaacccgtctctactaaaaatacaaaaaaaaaaaaaaaaatagctgggcgtggtggtgggcgcctgtaatcccagctactcaggaggctgaggcaggagaattgcttgaacctgggaggcggaggttgcagtgagccgagatcatgccattgtactccagcctgggaaatgagagtgaaactctgtctaaaaataaaataaaacaaaataaaaataaaagtaaaaataaaaataaaccatagcatttgcagagcaatcttagacagtactgagagtctacaatgtgccaggcattgtctaggagttgaggatacaagaatcaataagctaatgttccatatatcaagaagcttaccatgttagagaagacgtttagtctttttatgcttatgtttcaccatctaaaacataagtttagtgataaaatttctctctaccatgtctcaatatctctaaattgttaaaagcacttaaagaaagtttctacctataaaccaagccttaaaagcaagcatgagctcacatgtccatagcacccccaaatctcaaagaaatcaagaaatatctgtattctgattttcttttccttttgtgtatgttaaccacaattgcttaaattctcttatttaacctaacaagcacagaagaaaacaattctatctggggaaagtagaaagttttgcagattaatgaaaaaaaatgttttaaactattttcaatgatgatggtatagtttgtgtgaactatagaagatgcatctctatttttcctaattttcatgaggaacctgtgctttttattacagtgaccagtacttggaggacaatgtcacagcccctgactatatgaaaaatgtccttgttctgacgctgtctcctgggaattcccttctaaatagctctttctccaggaatctatcaccagtaagctattattttatgttatagtataaattatatattattattttatttgtcaagggtaagataatttttctccatttaggacccaaattctaaaatgagcaattatttttacttgctctaattcattcaacaaatgttaactgaaaccaactacatgtacagcattttgaaacagcaggatccctatcaaagctcttaactataggtcactctgctagactatagaacagtacaacagtggacacatccgccacattggcatgaaagtaacaatatggaaagacaggaagaagccctgctattgagggtcaatcttacacttaaaagaggtagaaattaaataatgtaaaataaagcaagggttactggaaagttccctacgtcctaaagcaaaattttcctgtcactgatattaaaatcctacctttagaaatgtatattcctaggttaagacattgtcttccattataattaagttgaccattgtccaaatttgcccaggagagttttggtgtattcctgttattccattatgccatctggtttagcatttgtgcaggaaaaagagcctccatttggacactaaatcatggccaccttattataatgcagggctcctgattctaatagtatattgggctttgtcagtccctgtactttcatatgattaaatctattagatgcattcttcccacagagacaaaccattgagagcaggctgggatgggaggaggaggaagaggcaatgctgatgaccttaaacaactttgggatggcaagtcaagggccaggcccaaaaagctgcaaacaaagatggatacctctggggtgtcacagtttttcccagctagaagttctaagtcctctcatttacgaccgtgccaaaattagggactgcatcctcttttggagctgggtcttaactggattctttttacctcatgaaatgttttcagcaaaagaaactgaaaccaatgaaagttttatttttccagcaaatataattctgagtgtaatatctggatattacttgaccatcttcatggttctagcaaaaatacgattctttgcaaatgggcagtccaacatgccggaggtaatagaacccacttggtctcagttcagcaagggcttttaattcatcactcagccctgtgaaggtcaccattctccagctgctgaggcacagcagttctgaccctctccattatttttcccaggacaggcatttggggcatgaagtaatatccaatcagaactctattcaaagcaatttcagtggcatcatccaatcaaaactgctcatgttccactcagaatacttaaacgcagggattgtttttggtttttgatttttgggtttctcttttgcactttaataaaaacaatcaactagaaactaacattatttctatataaaatcttataagaattatgaaaatgcttcatgttgcctttcctggttgcatttgtatgtttttcatcatgggaatgaagtataactgcttatagttgcttccctcattttattgattccaagagaagacagaattgtgacatgggatcataaagaacactgacccaaggaagagttttttttttttctttctttctttttttcttttttttttttttttttttttgagatggagtttcactctgtcacccaggctggagtgcagtggaatcttggctcactgcaacctccacctcctgggttcaagtgattctcctgcctcagcctcctgagtagctggaattacaggcatgtgccaccacagcaggctaatttttttgtatttttatagagatggggtttctgcatgttggacaggctggtctcaaactcctgaactcaggtgctccgccctcctcagcctcccaaaatgctgggtttacagacatgatccacctcacccggcctccaaggaagagttttctaaaagtctcctttaataacatcccttcaattcccctgatatccctttaactttccagtaaccctgctgatcccaacaaccttttgttctaggctcaagacaagattcttttttgaaggacccgttttaatattttccttttttatttagacaaaacgagactttgctcttgcctatttgaatggaatcctgctctttggacatatgctgaagatatttcttgaaaatggagaaaatattaccacccccaaatttgctcatgctttcaggaatctcacttttgaaggtactggtctactaagagcaaataaccccaaggtgaagaaatgtaggctttctgagtggatttggggcaacaaagaaggtttagcaatagattccacagctaaatccctttgaactcaactggatgcaaacatcattacataaactttgagggtgctgttattgataactgaactccggtttatgtttcagtcttttagaatctttggatgtcacagaaaagggcaggtagcgcaggttctgtacttatgaacaagctcatcataaggcattttgagcagtaatgtcctgactgtgcttggagactaacaagaggataaatatttgcagtttgatttgggtccttccatatctccttttctatccttcaaggatctgggaccctgtgttaaaacctttagctatcaaaactccacaaaataataccctccaaaacaacacaaacctcctgagctgcatggatcaatgttgccctttcctacaagcccctagtgaaactcccgtctttcatttcccagatctcatcctgagactatgaagaaattttcctctaaatgtaatgtatactaagtcaaagataaatgacagtggccttttctaacttgcctcagagtcttactctatgaaacctttgttttactgcagtgtaagtgactttctctgtaggcttcggagggcagcaggtgcccagcattaggactgagggctgcaccaggggctatggtgtatgacaatggcaggaagagatcacttctgcttcactgaagatgcagggagggagacacagtaatttgttggtcatcccatgtgtcccaagttctaccaggcactttatatgcactcttaatttcctcacttccatgaccacggttgagcattttaatggattagcacaggcttaacatttggcttaacatttaactaggaaacaaacaaatgtttgttcccgccacctaccagccgtacgacccttaatatctctgactaaataaattatttctcaccaatataacggagataataatagtttctatatcatgatatttcaggaagaataatatgataatgcatataaatcacttagcacagagcctggtatattgtaaacaggaaataaatgttcattgttatgtcgaaacatgtgaagttactaatttgatcacttttttttacctaaatagttttatcttatattgctatttaatagatgacaaaactgaaactcagaaaacttaagtaattttattcaatgtcttcagcaaatgagtgacagtgaaaaaattttgatcttcctacaatctatgttaagattgtgcagtgaccctatacactatgctaggagttcaggaaatattcttagcaaaaatgtatcactaataatcgagggacttattgactcattacatttagtgccaccctaaatgcaatgaaaaggttttttgctttttctaaataaatacatctcccataaaaatgccctccagagatctctgggctaagaagccaatccaggtgccatctgattagactattaatgtcaacaatgttttcagtaaatttgaaacagagctatttgaacccattttacactctctgtcatgatccaacttatctgtcaggcaaaaatcaagaatggcctctaacatactctgatcttgccctagggtatgacggtccagtgaccttggatgactggggggatgttgacagtaccatggtgcttctgtatacctctgtggacaccaagaaagtatgtctcactgcttatcagaaaattcagggtgctgtgactgggtgaggaggggtaacttggaagaggagcactagcaaaagaattagagaaattatgtttaggatctgaagacagttcatttcaacttcacaattacgccccacttagggtagtattccttaagcattttgacccataaaacttcttactcagaatatccactgtatttactattaatatatctatacctctatatcaatatccatatagataggtatagatattttaaatatccacccagaataaattacataatataacaaaaagactattgatgggataccaatgagaggatcacaagtctttcctaagaattgtttactcattttcacaactaaagatttcaatgaaatattccctgttatctccatttgaactctcaggaaaatcattaaatgtgtaaacctgagccccacataaacagccctgtaatgctatgcttttattcatattatattcacttttttttcctcacccaatagtaggttctttaaagaaaataagtggtctactcacctctccatcttttcagtgcatagcttcttatctggcacaccattgacggctggtcagcatttaatcacaaacaaacaaaaacaaaacaaaaaaaacacctgtcttcatgtcatccaatgttgtatccatccaaactataaaagccactgttccagccaaccaagtggtcagtaaaaaggtttatataggaggtcaggtcctgacataacataaaatttattcattttttttttcattttccaatgtgagtgttatgacagtctaagtcatatactaaatgtgtacatcaacccagctttgtaaaagatatctgcaatggaaaatgtgaaaagctagagaaaagatgtccacgttgagaaagctaaaccagaaatttgctagcagcattccataaatgtaattcgtagtttctagatactatattgaaccttcaatataatgttatgtttcgcatacattccgtaagaataccttaacataagatcccatcaatacttcagttactaatagcgattacaaaggtacatgcattcctctctgagttatttgcatctgggatgatgcccatgatcttcacagagagaggcagaaacgtgtgagatctaatgtcagtctcataactatacttcaaaatggaaaatgttgctttgtgcatttattctctctataagcaaattcgggtgaatttttcaataatgtagtaccatcggttgtgctatataacatgtatatttgggaaaatcagagatcttctcaaaatgtaaggttaaagggatgataatctatatccaggataggtctcaacagagattcaatatgccacatcctaacataaaggaaaaagaaagaaagagtaaagttatgaaaatgtaacattgggctgggtgcagtggctcacccctgtattcccagcacttttggaggccgaggcaggcggatcacttgaggtcaagagtttgagaccagcctggccaacgcggtaaaaccctgtctctactaaaaatacaaaaattagccgggcatggtggtgcatgcctgtaattccagctacttgggaggctgagacaggagagtcatttgaacctgggaggcagaggttgcagaaagaaaatataactttgctgtccagaacattttgagggtacactggtaaatttaaaaggatggtcactgatatagtttggctgtgtccccaccgaaatctcaacttgaattgtatctcccagaattcccacgtgttgtgggagggaccaggggaggtaattgaatcacgggggctggtctttcccatgctagtctcgtgatagtgaataagtatcacgagatcttacgggtttatcaggggtttccacttttgcttctttctcattctctcttgctgccaccatgtaagaagtgcctttcaccctccaccatgattatgagacctccccagtcatgtggaactgtaagtcaaattaaacctccttttcttccccaaaaaaaagagaaaaaaaaattttttttcagaggtttcatggactccccagcgaggctggggaggcctcgcaatcatggtggaaggtgaaaggcacatcttacatggtagcaggcaagagagaatgagagccaagtgaaaggggaaacctcttataaaaccatcagatctcgtgagacttattcactaccacgagaatagcaggggaaagaccggtcccatgattcaattacctctcctgggtccctcctacaacacgtgggaagtctgggagatacaattcaagttgagattttggtggggacacagccaaaccatatcagtcatctttcagatctcccttacaaaattgactcaatatatgcagcagtaatttaaggatatattaatatttccattggcaaatgacttgaaaatgaaatcttttattttagaaactaattaatgtcatgtacaagaaaagcatattagagccaaggaatagaagagattagaaaattaagtaatggatagaagttaagaaatgtagttatttcagggccccttgatatgtatcaaaatgacataatggattttagctctgctgcattttcttgagagcttttttcaaaagcaacttaatattgtggaaaacactagtctttcatttatcatgtgacttggagctagccatttaatatttcttagcctctagtttaacatttgaaaaatgaaatacttgaactgattcactaaaggcccacagaatctgtgctggacagacaggagttaatggtgtagtgtatgagcataaagaaataggaaactaatcggtccatctgaagttatatctgtgttcatgctgggaatcaataaatgatcctaactagctggttaacagttgccttttttcactgagaattgttatggaaatcaagtgtcattgtgtagaatcattaatctcaccataatttgttctataatgttttactgttcatcctttttcttttttgtgccctgacacagtacaaggttcttttgacctatgatacccacgtaaataagacctatcctgtggatatgagccccacattcacttggaagaactctaaacttcctaatgatattacaggccggggtaagatatccctaatgaattttctctccctgacactgttttcctggtaagaaaagtaaagtctattgtttatgtaattagcctgtgctttttgctgtgttttgtctgctgtcccagtttgatttcctgctgtccagtttgtaaatgtggtccttacttccctgcacaatgaatgatattatagttctgattcaacagtgatttctggccaggcatggtggcttatgcctgtaatcccagcactttgggaggccaaggcaggaagactgcttaagcctagaagtttcagaccagcctgggcaacatggtgaaactctgtctctaccaaaaatactaaaaaaaaaaaaaaattacccaggcatagtggcacacagccgtgttcccagctacttgggaggctgaggtaggaggaccagttgagcccaggaagttgaggctgcaatgagctatctttgttctactgcactccagctgggcaacagagtgagatcctgtctcaaaaaaaaaaaaagaaaaagaaaaaaaaggaaagaaagaaaacattcttattctaatttagctatacctatctttaaaatatgtcctaccatttgacataaattattccacagaaaaccgggtttgacaactggcaaaaatgagcacagagacatatattcttactccatttacattttactgcaataagctaaaaggttgtgtatttcagcaagaaatacttgacatatcaggctgaggggtgaccagtgatcctggcctttacagtctcccctgttcccatactggacacatatttgggttgcaatgatagttacccacctacttaagattaggtcctatcatgtcatgaatagccctaacatgatttggccagctttcacccgtgcaagctgcatactcaccatcagcagcaggcagggccactcaggatctcctgggcaacgaggcctcaggacaatctgtccatgactggcttggccagggcttgccataatgagtggtaattccatgtgactaggaaaaatctttaagaaaaagtcttaaatctggacagatatttagcccaaagatttaaaaaaaaaaaaaaagtagaaataccatcaataaaattatttagagccaagcgtggtggctcatgcctgtaatcccagcactttgggagactgaggtgggaggattgcttgaggccagaagttcaagatagcctgggcaacacagtgagatcccatctctacaaacatttataaattaaggctgggagtggtggctcacgcctgtaatcccagcactttgggaggctgaagtgggtggataacgaggtcaggagttcgagaccagcctgaccaacatggtgaaactccgtttctactaaaaatacaaaaattagctgggcatgatggtgcgtgcctataatcctagctactcaggaggctgaggcaggagaatcgcttgaacccaggaggcagaggttgttgtaagccaagatcacgccactgcactccagcctggggaacagagcaagactccgtctcaaaaatatatatatataaattagtggacatagaggtgcatacctgtggtcccagctactcaggaggctgaggtgggaggatcacttgagcccagtaagttggggctgcagtgagccatgattgtgccactgcactccagcctggatgacagagcaagaccctgcctcaaaaaaaaaaaaaaaaaaaaagaaaattattatatattcacaaatggagcatcaggcaaccaattaaaaataattatttatgaagaatgttaaatgacatgggaaaacttatgatgtaaagtaatagaaaagtacagcttcttatttaatgagattctaactttgtaaaacaatgcatagaaataagactggaaagaaatatgttaaactgttaagagtggtgtcctctgactgatgggatcctgcaagattttttttgctttattctatttttctgaattttccaaaatttccacaatgactctgtattagtttcttattttcaaaaagtattaaaaattataagctacaaatatttttataccagccccgctctacagccagaaactctgaaaatttgatctgatataaagggaacatttctggtttgaagggcttgcttgtgtcagagctatacctgcgtttctagttttctttcactccatgagtcaaattaagtccaaaatgattcctgtacttttatccaacaggtattagcagctgattaacgaaatgagggaggggggaatgaagatggcattcttctagacaataagcaatcctgagctgacttcagatttattgctatgattgctttttaaagtcgagttttatttaataagcttttaaaactttctggaaccatcttcaagctttctagttttaaaccaagcttgacttctgaaatatatctcttttctcatgggcttctgcaactctcaacttcttttgtaactttttgagttcaaattattttttctttcttcttaattataactgtcagtgacaaagttaggtttgtgtttttaatgtatttccttcaagttttttggtattttggttattcaataggtctgtgatttctaaagtgctgaacttctcaaaaagtactttttgagagagttctctttacttaaagagaactgacttcctcaatggttgaactagtttacagtcccaccaacagtgtaaaagtgttcctaaagtgaacattaaatattcatactatatcctacagggacgttatattatcctgagcaactttacttcagcctcagttaactaacaacctcagttagccagagcttttcaatacttaactgttacttactacatttagctctaaactttaccaatgaagcaataatataggagttaaaaagaaattatttaggcaggtagcgagggtacaggagtcctcagtaaggctttttcttttcttttcttactcttttttttttttttggagacattgtctggctgtatcacccaggctggagtacagtggtgcaatcttggctcactgcaacctctgcctcccggattcaagcgattctcctgcctcagcctcccgagtagctggaattacaggtgtttgccgccacgcccggctaatttttgtatttttagtagagacggggtttcgccatgttgggctggctggtctggaactcctgacctcacgtgatccgcctgcctcggcctcccaaagttctgagattacaggcatgagccacggcgcccagccaggcattttcttttaattgaaaacagtctccaaaccatttcttttctagcaaaaagcagcctgaaaagctgaactgcaagcataaataagcaagctggaagcttgcgtagatgaatgcccgcagctgtactaaaagccaggtccacccaatatagcgatttcccctcccttttctttgtagccatgtgtgggggtgtcattgtgccggccgggtaaagccacatgtgtgggtgtcatggcgccagccaggtagaggccgcatttgcataataaaagattagggtgagagggccagtttcttcagggctatgtaaatggcacactggtcaaaccaatcccctgggccctatataaatcagacaccgcctcctgaagcctccctatataacctactgcttcccaccacaagcatggttttttcccttcagagccctcctacctctctaccggtgagctgttctcttctttcctgcctattaaactttccgctacttgacccgctccgtgtttgcgtctgtgtccttaatcttctcgtcacgcgatgacgaaccttgggtatgtccccagacaatgaagccgcttcagcaactcaacctttgaaatagtatagaaatacgatatgcatgactggaacttgcatctgtgtgtacacagctactaagtaacaaaacatttcaccaagagattacaccatccctgttctttcatttatttaacaaagatatttatttaatgccagacaatgttctgagcacctgggaaatagcaatggacaatgcagatttggtgcccgtcctcatccaagtcctcagcatctgcttcctgtatcacaaaaatgacgtcaaactgacttcctgcattagtcctgcccacttccatccaacccatcctgctatcagaaagaaagcacaagtccaatcatgtcactgcactgttgctaacatgtcaattggcaactctgctttacctacagaatacagtccaagttacttaatacagcacaaagtgcccgtaatctccctacttatcttttactcacctatcccttccccatgctctcagcttcctccctacttccttaaagcgtcatgcaaatttatgccgctgtgtccttatttatgctactccctcggaatagaatttatcacttctccatagaggtgggaaacatctactcatcctcaagatttaaccggaatctcaactttccttagctttttttttttttttttttcctgagacggagcctcgcagtgttgcccggcctggagtgcagtggcccaatctcggctcactgcaacttccgcctcccaggttcaagagattctcctgcctcagccttccaagtagctggaactgattacaggcacctgccaccgcggccggctaatttttatgtttttagtggagacggggtttcaccatgttggccaggctggtctcgaactcctgacctcgtgatccacccgccttggcttcccaaagtgctgggattacaggtgtgagccaccgcgccccctcagggcttattcttattcatatttccttgccccaacacagtgccttggaatgaataaatgaatgaatgaatgaatgaatgaatgacaacatgagataactgaatatatttctactctggactccagcactcatctatactctgttaatttcagtcaatttatttctcttttctaagtgtgagtttcttcccctgttaaatcaagaagtttatcaggttccttccaaccgtaatatcatatgaccttgaggttataaactctcattcattgtgagatgagttaaatagaatgtgataactacagcagccaccagaaggcagcagaagcttaaccttggaatttagaacttgatactgcgtttatctaaaaggcaaaactgaaaagcatgtttaattaaaaatgactacatttaaatagtatatttaaatactatatataaatattataattatatctaatacagtgagatgttcatactgtaggaggcagagaattgaggtgggctgaggagtccccatattccctccagtttatactctagtctaggggatgtgcaattttgatagaccagtgagtgggattatctacactgttgaaaatgtatttcttgtactcactttcgttttctggggtttagggcgtgagaatggtgggagtggcaatagtggtgatagtgatggaagtggtgattgtagtaacaaacagaattcaccagttaaatgtgcccataatgcaagttcaactccaaagtatgaatttatttctgccccgatgagagtagaaatccaaagttcacattttcaccattgaaaatttcccatgaacacaaaacaaggtaatagaggcaaagtcacatgtctgcaaagcataaacccttcaaattcagcccttatacaaaggagctgtagtgtttaccccaagctaaaccatctacttcagaaggacataatatgattaaacaaaaacagttttaaaatacatatgacatgagacccctaatggcacaggagtctttctatatgaatttatttatgtattttaatgtccaagcaccttctccttgcctcttctcaggcaataagatgatcagggccaggtttttcttctattattttttattagccatttttattgatactttaccaggtcttgtgctgggtgccaaaggtgtaaggatgaacaggaatgaataagtaggacatggactgtgcccccaggagtttagattatggtgtcatgatagagaatacagtgtgaaggtttaggattctgctttcataaagaagtcctaaaacctcatttttggggcacctacatcaattatattttagcacagaaaaattcacacatggctgggcacagtggctcacgcctgtaatcccagcactttgggagaccaaggtgggctgatcacctgaggtcaggagttcgagaccagcctggccaacgtgatgaaaccccacctctactaaaaatacaaaaaattagctggacatggtggcgtgcgcctgtaatcccagatacttgggaggctgaggcaggagaatctttgaacctggagggtggaggttgcggtgagccgagatcgtgccattgcatgccagcctgggcaaaaagagcaaaactctgtctcagaaaaataaaaagaaaaattcacacacatgattttaaaatccagtagcagatgtgttcataatggaaagtgaatgcacctgatcccacctctgtgcatctctgctctctcagtcacttctgcttttactgttttgcatatctaaataatatgcttctatttcttgatttataagctttagcagttatctattaattttttgtattgatacatgaagatttagctcatcttcgctagccctctttctcacttcttcccatatagttatatcttttttgtcggtacaattattgaacacctttttcattttaattaatatgcatgagcttctagtgttgtcctatcaattgtatataaaatatcttgcctcccactttgtaagatgaagatgttagtgccacaattctttcttctacctccttcccatctccaaaattctcctatatttttctttgccagggttgataatatttatttggtaaccaaaataaagacctctgttctttacctataacttgattctataagttgaaaacaaggaaacattttcattatgtgaatattatttatataaagctaaattgtataccgtgataacatctttctttttttttttttttttttgagacggagtctcattgtgtcgcccaggctggagagcagtggtgcaatcttggctcactacaacctccacctcccgggttcaagcgattctcctgcttcagcctcccgaatagctgggattacaggcacccaccaccacggccagataattttttgtatttttagtagagatggggttttgccatgttggctaggctggtcttgatctcctgacctcaggtgatcggcccctcagcccccccaaagtgctgggattacaggtatgagccaccgcacccggccaacatctttctatatagccccaatgtctcccttttgtaccacaaaggaaaattgattttctctccttttttaatacctaattctcaaagtcagggcacattttactttgtttcatttttggattatgccttccttgaacattttttccttagaattcctgattggatttctcttttctttccttgctgtataaagaaacatgtcttcttcaccatactcctatcacttcccagcttcttacacattctgtctattgcttggaatctattccattttttcttcttgaacctactgacttcctaatagggaattcattgcggcatatatgaaccacgactttcccgtgcagtcttcttgttgctgtccttctctgtgtaggagtattcctttgtatactcagacactgcttcagtgcttccttgggttggatccacattttcctggattccacttactcttctgagagtctttccacttactccatctatacaactccacccacccactagtgttctagtaaataaaatcccattcttcattgacttccctcactaacccaggagagcttggaaagaaccagcatgcaacactgtcacttaatattctatactgacttacttttcttccggcatgtgctctgtatttaaaaacaagttgtcttagttgggtatggtggctcatgcctgtaatcccagcactttgggagactgaggcgggcggatcgcttgaggccgggagttcatggccagcaacatggcgaaaccccatttctacaaaaaatacaaaaattatccgggcatggtggcgcacacctgtaatcccagcttctcgggaggctaaagcaggagaatcacttgaaccagggaggcagaggttgcagtgagccaagactgcgccactgcactccagcctggatgacagagtgaaactctgtctcaaaaagaaaaaaaaatacatgtctcatcctctatgaacccttcttaggtatattggtttcaaggacaccaggtagacttctaccaccaacttttttgtacgtgctctaaactattttatgtttgtgtaacatttggtgattcttattagaaagaatagagatgtatatgctgtcagaatagccaaaattaagccactttccctgggtacaatgccagacaaggctgtcagagagtagggacacaggacttatattaccagagagaaattaataaaaaataaatttttttaaagggttctcttttcccttccccaaattacattgtacagctagaatcttggaaatgcttttgctctcttgtctaaggtccttcctaacgcattttccgccacaggccctcagatcctgatgattgcagtcttcaccctcactggagctgtggtgctgctcctgctcgtcgctctcctgatgctcaggtacagccgcctctatcatgcctgtgttcggtatccagagaggcaggaagggaaagtgggagaggtctgttgtctgttgatgatgatgaatattcacaaagaagcctgcagactgacctaagataatgaagacattctgcatcaaagactaactgaagggcagaatattattgagtgaatagattagggctttgaagccaaagatgcctgaactcaaatcccagttctttgagttactagttctgtggtcttaagcgtgttacttagcaacttaaacaggtaacttagcttcagtttcttcatctgagctgttgtaaggattagaaatggaacatgtatacaaactaccatataataagcatatatagataaaatagttatttttattatgctgttatattgtgggagacatcaaactcattaaattacatatttagactgggagaggttttagaaacaatttattccaaatctcctattttagcctgaggaaagagaacccagaaagtcaaatggcttctctagagtcttatcaccaggtagtgggtggggccagaactagaactcaagccttctcaccatcagttccatgatttttctgctcaacttgggtctgccaaatgcctagccagagacattgtgtgtactaagaaatatttattgaatacataaatgagtgagtaaataccacactacatcctaatctgcatatgttaaatgccaaacttataatactgtattatattaccaggttcacttgcacttcctagctaaacaagacaacagttttatctgtgtattacacactttggtctgtgtgtcattatactttctcatgtgaatgtccagcctgccatatactggttgatgttttctccagaaaaggaagtagactattttcttcaatctgacaacaccgcttggctcctgtaactgtgttgctcagaaatacaggtgatggtctacaatgtgtggtgaccatttagtgaagagtgagaagaaaccaaaattttcccccaaaagcaaatctaaatgggaatcactttaagatagggtaaatcacaagatcaaagataataacaggtgtttctcattgtctctaaacatggcaggcagagatggggcttcctaatgaccagtgcaatgctatgcccatgagggggcctggcagacaggtggtacacatgcagtttgccattacaacagcctatgcaagaaaactagcaaaccatttaagaaatcccctaattcagtatgaatgacagttggctctgctgggtcccaagagtctcctggggtacagagctgagaacccaagagcctttaaggtcttgatattcatcctacttgcctccaggtcttagggtcagtaatatgctattttacatgcatttacttgaagaatactcagacttagatggaagcatacaaagagaataatcatttctgcttaggggacattaaggaaggcatggccttgagaaggtgagaatgagtttgtcaaataaccaaaaagcaaaggcaaacagggacaaaacaggtcaatagaaaagaatatcagttccagaatcagatacaagcaagaacttataatatgacaaagatgacagtatgtgacagctaagaaataatgttggtggccgaacacggtggctcacacctgtaatcccagcactttggaaggccgaggtggctgaatcatgaggtcaggagttcaagaccagcctggccaacatggtgaaactccatctctactaaaaatacaaaaaattagctgggcatggtggcaggtgcctgtaatcccagctactcaggaggctgaggcaggaagatcttgaacccgggaggcggaggttgcagtgagcagagatcgcaccactgcactccagcctgggcaacagagcaagactccgtctcaaaaaaaaaaaaagaaagaaatgatgttggtaaggtaggctttccacatgtaaaaaacaaaattaaaacaggtaacttagcttcaatttcttcatctgagctgttgtagggattagaaatggaacatgcacacaaactaccatatactaagcattatataaatgaaaatagttatttttattattatattgtattatgttgtattttattattattatatatctaaaataatacacaaagacatagtttactctgtggagttttaaatgttaatgcatagtttatgtggagttttaaatgttttaaatgtttgattatgtgaaaatcaagcttcaaaacttagaataaattaataaaaatgactttttaaaattatttttatttttttgagaccgagtctcactctgtcactcaggctggagtgcagtggcgccatcttggctcactgcaacctccacctcctgggttcaagcaattctcgtgccttggcctcactagtaggtacaattacaggcgtgtaccaccacacctggctaacttttgtatttttagtagagatagggtttcgccacgttggccagcctggtctcaactcctgacctctagtgatccacccaccttggcctcccaatgtactgggattataggtgtgagccactgtgcctgtccaataaaaatgactttatgatctcagtttaggaaagtagttctcagtcaagataaaaaaggaaaagtcaaagaaaaaatacataaatatgacgataataaaatcaaaactttctgtaaaacaaagttaaaggaagtcataaactaggaaaaggtatttgaaaactaaagggacaaaggatttatttctcaaaatatattaagaacttatgtaagttaacaaggataagaaaaatatacacactaggaaaaaatgagcaaaattataaatacataattctatataattctgagtctatatactctattaaatagctagaaaatatttgaaaggataatatcacttgtaatcaagaaaatgcaaagtaatgcaataatgaaacactgtttcaccttcatcataaaggttaaaaaaaagtttatcaataccaaatgttgacaagaatatagaaaatgggaattctcaagataagaaggtaaattaattgataactactgctttgggaagcaatttggtgatatctgcaaagtcgaaagtgtacatcgtctatagcccaagaattctgcttcatctataccagcagtccccgaccttttgacaccagggactggtttcatggaaaacaatttttgggggtggggagagttttgagatgaaactgttccacctcagatcatcaggcattagttagattctcataaggataaggagtgcacaacctggatccctcacatgtgcagttctcaatagggttcgcggtcctgtgagaatctaacgccaccactgatgtgacaggaggtggagctcaggtggtaatactgacctctcacctcctgctgtgcagcttggttcctaacaggctacggaccagtaccagtccatggcccaggggttgggggcctaatccccaacctacactatctggggaccgatactatctgaaggaaactatacatttttaacattttgtagttgagataggtgttgttacattttctctgtacttttccattttctttaaacatattttttgaaaaggcacagatgggtaagaggaactggcttatttagggatctggtgtattctctctggattaaaaattaacatttttgcctctcaatgtcaccaactttacatttttttcctgtattttttcctcactccttctatgtcatcagtttaaatcctttagtattgtgaaggactgccttagtgaaaaacctaggaaagtgaagtgaaaagaaaagaaagactaggaaacaggggtccccaaaccccagtccatggcctgttaggaaccaaccgcacagcaggaggtgagcagcgggtgagcgagcggtaccgcctgagctccccctgctgtcggatcagtcagggcattagattgtcataggagcgtgaaccctactgtgaactgcgcatgcaggggatctatgttgcacactccttatgagaatctaatgcctgatctgaggtggaacagtttcatcctgaaaccactccctgccacctccatggaaacattgtcttccaggaaaccagtccgtggtgtcaaaaacgttgagggccaccgctataaaagcccatcagaaatccttgcaggtccactggcagtaagcgcttttcagtttggaggacatggtgttctgtcattgggctaccttccctcacacatatctacctgagcataccagggttctaaacttcacccagtcttcagaagctgaatgacatggatattaataaaaacctattgaccagttttattcctttcacagaaaatatagaaaagattatgaacttcgtcagaaaaaatggtcccacattcctcctgaaaatatctttcctctggagaccaatgagaccaatcatgttagcctcaaggtaaagcctaccttacctgttgaagaatgggttcaatttggcaggtatttgacaagacttaagtagcattgcaggatatgtgccaagtagggatagttgttctagaaagcaagacttagatgctttctaattttcagctctctcccttccccttgattctccattctcctacatgtcaactagttaatccaatgagcacttccctggaggctgagatatggtgtgttctcgttctttgcatcttatccagaatagaaatacacatattgggaatttgccatggaagggatgtaggaatgggcagagcatttgagttcccctaaaccttggatgctaatctatccatactaagggcctatgacttgtcttactcattcctgaagaaagaggcctctgcttatatttgctcacatttaccttcaaccaggaaatagcagcagccaataataacttactccatttaccacagtcaatgcaggacctatgctgtctcatctattcctcacaggaacccaaaattaagctttattatcataattttgctgatgaggaaactgaaggacaaaagattaagaaacagtgcagggacacatacaactaatgagtaagataactataagtaataatagctaacacttactgagcacttataatgcaccacatgcattaacccatttcatcttctcctgagcactgtgaagtagcagggtggaaattccaggaacacagctacaatttaaacccagtctgtctaactgtaaagccagagattgtaacaccttccatacaccatataattatcctagtttttataccaaagcgtattaagagaatatggagacccaagacctccacagatgggaattcgtggactccttcagagtagggccaaactgatagtgtagtgtgatttgagatgcttccttgcttaaaatcagcaggaataaaattgcatttggcttaagtttgtctctggaacctctctaccagctcttgaccctcctccccaagtcctgtgtgctgccctctaatggctccaatcccctcatgtctatccaaagaccaggtcttcccttctttcagaaatatgacatgctccaatgtgaccctcctggtgcattctgaacctcaacagaaaaattctattcacaaagaccaatctgtctcagctaagtgtcaggatgaaatcaatttaacagtaattcacagtcaggtgtaaatgaccttaaggctactgaatttccaaagagagaatttgttgacctaaatgacaaactggaagtacctagtgttaaaagaaaaacactggacagacaaaatagaatttatttgagcaaaaagtgattcatgaattgtgaagcactcaaaaccaaaagaggttcagaaagctccactctgcagcatgggcagtgagctttcataggttgtacaaggaagtaaagtacacaaataacttgattggttacagctaggcatttgctttatttgggcatggtctgttcagttagcttcctgtgattggctgaaacccagccatttgttacaaaaatagactcctaaattagttttcagtttgtctgtatactaagttaggttgcagtttataggaactcataatacaaagacagcctcatgccaatggtctcctgcttatttaatataacactaggaagaggagaggggactttcagaaggagcgtgtgcacctctgtctctcatcttctcccagatgggctcccacacgctccacctctgcacaagtccagccttggtgtcattcctcaagcacctccccactgcctcaaaaccccatatttcatattttctcttttggagtaagcccaaaacatgtgtcaccgtatgttttcttaaaatataaatattcctagaagtataattcatccatttcttgtcagtttctttacaaaatttttatgagtacagattagttcatcggaatgaatgagtcacctgaccaaggaaataggtctttgggacagtaaactcaaaggagggaagttcaaaattattttgatcatgtgatcattgttactctgagttttagacaggctgggaagcaggtggatcagaaattggctgtacagagagctcatcaggtgctaagagtcaggtagacatggagaaaacccaaggtcacccgaagtcagcaagggtggaaaatacctacaaccagacaggtagtggttcaagtttggatactcactgaatgcagaaataaggaagcaagactaagagatgagataatagagagtcaaacatcccactgctagaacaggaagggtcagaatatcagaccaaagattccagacaaaagaaatcaggaaagtcaaagggatagagtaacacagaaaaaaataatcaagatgatcattcatttgagggtaaaaagagaagtattttagctagcaagagaatttcacaaaccttgtctcatttaacccccagctatttctatgagttggaattgtgcagtaaggaactgaggtccaaatagtttaaatgatgtcatcaaggtctgaaataataaaaagagcattaggcaagaagacaagcgtaggttctgccattctctttttatgtgacatttaatgttatttaacccttctatacttaatttgttaaatgagaagaaaatgaaatgatgataactgacatttgttagtctgcaatgtgccaggcatcatgcttggaccttcagagagtcatttcactcgcatttcaaaatggccttgtaaggtacattttaacaaagataataacacatctcaggtttttatgagaatcacatcaaaagatgcaattgttcccaaccttttctctgtctttggaccagaagtcattaactggaaggccaagagccatatgtggcctgcagttgtgagtgcctatgtgtgtgcgtgtgttttgttcaatatttgacattttaaaaattaattgccaacatacaaatgtcatgagatagcatataagaattcttattaccagctccttttgataaataagatgatttagcaacttcgggctgaacccagagctgacagtactgcttcccttagacacctggcccagttttatcatttgcattgctacttgggcctttaggcatgagtgtgcaactcaaatgtacagcatccttccccaagagcatctatctgtagctacaggcaataattcccacaaaaacagggttggggtgaagggagcaaaggaaatccctggttgaagtagggccacaagaggaagggaggaaacccatagctaagcatgagcgcagtagatacctggaaacacgttgctggagtccaattagtgagagggagcaagtcaattacaacagtttttctggaagcctgcttgcccagcatgttattgaggaaacagatgcagcccacctggaagagcctctcagcctttgacaggcagtgagtaggatgagatatggagcttctggaataattagccttttcttgtgccagatcgatgatgacaaaagacgagatacaatccagagactacgacagtgcaaatacgacaaaaaggtgacctctcccacttctctgaactctccactggggtatgctctgggccttttgacccctcattgccctggcccctgatgtcagtatcacaatggtgggagtccccagtctgttcctaggggctattcttagagcttcacagggatgggcagggccctgcttcaagggttacaaaactcacaatcctggggaaaatggaagacaaatagaatgttggggaagggtggagtgtaggaagaaaaattaaatatcaaagatattcagagtagtccagggcaaccctagtattatattttggctcattgctgagaaatacaacgatctcatatgagagctttgcatcttatttccatccttctttcttccctccctcccttctgcctgccttccttccatttagtcattcttaaagaaacattcgagactgaacttaccatatgccaggtactaggcaccagggatataaacatcagtcaaggctgggcacaatggctcatgtctgtaatcccaggactttgggaggctgaggcgggtggatcatttgaggccagaagtttgagaccaggccggccaacatggcaaaaccccgtttctcctaaaaatacaaaaattagccgggcatggtggtgcatgcctgtagtcccagctactggggaggctgaggcaggagaattgcttgaacccaggaggcagagattgaagtgagctgagattgcaccactgcactccagcctgggcaacagagcaaggctctgtctttaaaaaataaataaataaataaataaataaataaatataaaaaatcaatcaaatactgtcactgctctcaaaagtttatagtctagtgagacacacaaacaaactgttataatatgcatgtaaagagttacaccacaacagtgtctcctaaatttcattgatttttgcagcgagtgattctcaaagatctcaagcacaatgatggtaatttcactgaaaaacagaagatagaattgaacaaggtatgtagcccttacttcaaacccttgagaaataacttcacttcatttcctctaatcactgaggttgctggtggagtaagaggctgacagaaaagccctcaggccaagaaatggtgactatatttcttgttgaaaattctaccaagagatattggaaagtgaggttgacggtgtaaaaaattctggaaatctactagtctttcctggaaagtggacctgatattatttgaaagtaaagtttatattcaaggcctcttactgacaaaggaaagtttgttgaatgagattgatataatgtgtgataagcaatgggtactgacattcaatttgttaagacaacacatcttctcaaagatctgaaacaaaacacattttattggcatattaatttttactttggcaccccattctgcctaatttgctttgtaaacaaacacgttcttctagttgcttcagattgactattacaacctgaccaagttctacggcacagtgaaacttgataccatgatcttcggggtgatagaatactgtgagagaggatccctccgggtaagaaaccatggtcatttccaattttctaatcatataaaaatattcagcaggccttttaaaatatttaccgagtaaaataatattagagaaaatcagggaaagttggtggggtcacatgctttccaaactagatccccgagattttttcagtcttattatgtttttataaacaagcaaaaaaaatttcaggaaaaagataatagatttggggaggggagtaaacagagaatggaagtggaaaaatgagtgattacctccaaatacattttattttccatgaatacttgcttttgtattaaaagagaaatggataatcattatgatagcgccaaataagcattagaagacttggtcatcattcttggttctgctgctgtccaaattattactccactcttggactgaggatcatctgggagttgccagatgaggtcaggtatttggactgagcaagtccaaagcaaacagaggaactaagaaaaaaagcaagaatattagctttcatactatgcggtataaactcaaatctaccctccaagaaaaaaacatagccctatatgttactatctcttttaaaagttatttcatgcttgttattctaacatctgagggctctttctttggattaatccctatgaaattcaacagtggtacaaggaaaaagtgacacattaagccattaactatatttaacactttgagaattcatttgctgtattgcagaagggaaagcaagcccgtgagggactaatgtaatggaatgtggtagagaaatcttgagcagggggctggccaggagaattaagatcacagaggaaaatggtgctaaggtaaaagttcttaaaaaataataaacaaggctgggcacggtggctcacgcctgtaatgccagcactttgggaggccgaggcaggcggatcatgaggtcaggagatcgagaccatcttggccaacatggtgaaaccccatctctactaaaattacaaaaattagctgggcatggtggtgcatgcctgtaattccagctacttgggaggctgaggcaggagaatcctttgaaccagggagtcagaggttgcagtgagccgagatcacgccactgcactccaacctggcaacagagcgagactccgtctcaaaaataaataaatgaataataataataataaacaattgaagtatctaatgcaaactttagaagaataactataacataaggaaaggaaactattaaatatcaatcattttaaatcaaataaaataggatagaattttaaaatgcacttgctacttaaaaaacaaaattattaaagcatacaagcctttcacttctagttattatttttaaaacaaacatgcaaatacacgaaattgggaataaaaaagcagtgaaaagatgttttaattgtgaaagaatacttcatgactattaaattgtaatctttaaaaagggaaagtttcagaagcaatataatcatgaaatctgtttcaaaaaaataaatatttaattaggccaattctgaatcagtttcagggaataataagccatgtgaaaccctttgactaggctctattaattggtattctaaaatttctgtctcattgaaattaaatgaggtctagacctcatgtgaaaaacgtttctaattttgaaagacctgaaatagttattattattcctagaaatttgtatttattttatcagtatcaattaaaatgatcactttaatcatccattaaaatgctcatgtggtttttctcctatgaccttttgatttggtacattataataatattgttccattcatagaattaaccatatccaattatttgtgttatgctttttgtgtatacaactggcttagcatttctagtattttagtacgtttcttcatctatattcacaactatagattttagtttcaatcctatgctgactttgttcaatgttaaatgaatttggagtatgttcatgtttttgtttaagtttaaaatagtttttatatagataatgagaactactgttactaaacttcaacgttagaagaattaagctgaatctggtattctttctatgggaattataatttcttctattgttactaatgtaatattatgatatagtaagaaatatattttgtcttcattcttggctcctaaaacacctgtttttactgggtggtgggggtgagaaaagctcttttgttatttatagtaaccccctttcaaacatacctgagtcatgctacttaagatatgatagccatggaagacttctctggcaagatgacattagagtaagacccacatgaaatgaagctgtgaaaccatagctcagggaagaggaaaccaggtttagtatttgcaacctgttctcaacaaggaaaacagcaattaaagggtgatatgtcagagaagtctcagacctcatttcagaaatattcctaggctcccccataataacaactcttgtagagttaaaaataaaacaatacttccttaacattgcaaagactgtctatcataaaataacaactgacttcatctgtattaatgcaaagactccctagtcccacccctgtactactattagttaacttctgaaagttctaaccaaagcactaatgcgtgaaacagaaataagatatacagttattggaaggtatcaacataaataacaaatagagagtggctctctgaaagaaagatatttattcggaaaagaacattgtaatgggaatacatatgccatcgtaaattatgtgcacattcagagagataaaggaagacaaaggattttaaggggaaaaaaaacaaagaggattacataattgttgtgttacaaagatcagtagcaaggatgatgccagtcagaggttggacaggcagttgttgggcagatgtccttgtataagtactttttgtgtgtgaggttgtgatggcctttgtggaaggttgaggtttctgtagagtcttttctgatagtttttgtaatgaaggaaggatacaagcatgacaaccctctttttcatggccttttctggctgtatgtgtcaggattttttcaacatttgtgactccattctgattttgacaactttcacaaaaggaatagattttttttttttttaatttaaagatgaggctaggtgcggtggctcatgcctgtaatcccatcactttgggaggcagaggcgggtgggacacgaggtcaggagttcgagaccagcctggccaacatagtgaaaccccgtctctaataaaaatacaaaaaattagccgggcatgatggcgggcacctgtaatcccagctacttgggaggctgaggtgggagaattgcttgaacccgggaggtggaggttgcaatgagctgagatcccgccattgcacttcagcccgggcaacaatgcgagtcttcatctcaaaataaataaataaataaataaataaataagtaaaaagatgatatgattgttttcctagaaaatgcaaaagcctcaaatactaaaaattataagaaatttgtatgatgactagaaacaaaataagtgtatagaaaataatttacatatataatgtatatatcatatatattagccaaattggtcagaaaatacaactcaaaaaatcctccttaatatttttaacaaaaatatttatttgaaaatactcaacgtgaaatgcaaagaatcagttaagaacactgaaagttttctaagacattaaataaatcttaacagaacttagtcaagttcttagataggaatcaatgatgtgctggaactggctggtactagctcagagctgattgttaagttattcaagaatttgccagccagtcagtgttaaacttttggaagctgaaatcattcagggtggaaatatttcacatcgtactcagcaagcatattataaatcagggctgttgctaacagagagccgatttaccgacaccctataccgacaaattcacattgaaaatgtataaattcttctgaaaaccacaaacttgcaatcaaaggcaaagactttgcttaattaacagagatcatcaggaaaaacatatacatacacacatatatatatgagcaataataactaaaacagttttgaaaaagagaatgaagaggccacttgtcagaaagttattataatcaaggcggtgtagtgacagctcatgaacaagcagatgatttatggaagaaaaacacatgggctaagaataccattaagtatatgacaaatatgactaaagaagggtaattttaaaaatggtgctcagataataggaccttttcattctctcttccacaaaaggttcttttcccatgctgttccctcttcccaaaactcttgcctcccttcatttgatctcagctcaacagccatttcctgaaggaagccatctttaatcttcataacaaaccccagattttaggggtcaaatccccagattgtaggcaatttttcttcgtacttatcacagttataatcttatgtttatttgtctgattattttatgagtgtcagtttccttcaccagactgtgcaccctataacaggtcccttataatcccagcactaacacagtccctgctctagagataagactcaataattttaaagaataaatatgcaggtcacctattaaaattgctcagaaaaaaacatataaatctgcatatacattatgatcccacttttataatatttattacatatactttccatatctacattaaagaagactaaaagaaaataccagaatgagaataaattagatggtgcaattagcaataattttatattcttcttttttatattgtgcaattttttcacattttttatagtaaacttgtattccttttatcatcaaaacagaataatatgctttttacaatttggcagatgagaacagggtaggatgggtgaatggtgcgctaaagggagagaaggcatagaaaagaattagtctgtctgcccataactcccctctgtcaacttggcctggtacccacagcccaaccagccttatctgaaatgattaaggactttagacccctccttggaaattcttggtacagtgcctgagttaaaactaaaaatcaaactgggctttttcctaaaataagaaactattgttatcagttagagtcctgtttagagttctaccgtgaagaacagttatgtattagcttaattaaaatcctgcaacttggtagaaccatcatcatattaaaatagtgacttgaaaattccagatataggcggggcgcggtggcttgtgcctgtaatcccagcactttgggaggctgaggcgggcagattgcttgaggccaggagttcgagatcagcctggccaacgtagcgaaaccccgtctctagtaaaaatacaaaagttagctgggcatagtggcatgcgcctgtaatcccagctactcagcaggctgaggcaggagaatggctggaaccccggaggcacaggttgcaatgagctgagattgtgccactgcatgccagcctgggcaacagagcaagattctgtctcaaaaacaaaacaaaaaaaaaaaaaacaaagaaaattccaggtcatacaattcacaaaaaaatccaagatctctcttattgacagaggacttagtaaactcaaaaaaaaaagagcaattaagctaatttatataactgattatgtgagtaaaaacacaagcctaatgaaggaattttcttatagcaattgcctgttttaaaacatgggtccaatttagatgagacagaacatgcagggcagtcacttgttaagcagtctccccacctgctgcttattcctctacacctgtctgatggaagaactgaaatttgggatgctatgggtacctcctgctcatatccaggtggcaaaaaccacccaatgcttcttatgcagaaaaggaaaaaacacaggttcatgaaatcccagacaatggaattccaatttgttcctgatcctaaggtttcataatttgaagatcattatttgtttcataatagtctctccacaatatcctttcttgcaacaacttttcttcttcttcttttttcctattcaggaagttttaaatgacacaatttcctaccctgatggcacattcatggattgggagtttaagatctctgtcttgtatgacattgctaaggtaagagaaacacacacacagaaaatatgaaaattaaatataagaaaacagatctaacaagttattcaaccttctgtgcattggtttcttcatctgtaaaatgataataatagctatgtcatagggttgtaggattttaggttatgaggattttgtgaaataatgcacgtgcttataacaagaccaggtacaagtacatgttcaatatatatctatcagttattattattttattatattctttgtagtctgggtgtgaggcatgcagtttcacagattttccagaaatcaaaatcatataaaactacaagaaagacaactgggctgggcgcagtggctcaagcctgtaatcccagcactttcggaggctgaggcaggagaattgcttgaacccacgagatggaggttgctgtgagccgagattgagccattgcactccagcctgggtgacagagtgagactccattaaaaaaaaaaaaaaaaaaaaagacaactgaatcctcaactttacaagagaaaatcttaagtacaggaaaccatcttgcaggaatcaataataaatgtggacatgcatattttgagacgtgataggaaaacagagtggacaccagtaaccagggcctcattcaagaatgaagacaagttggttgtgagagggagctgtttgatacagtcttaactcacctgaaagttatatgggttcagaatcagtttgaaaaatgtgttatgaaaatcgatttgccacacacgtcactcctgtgatccaggctgaaaatcagcttcagctgagacaccctctaaccacaagagagaagcacatcagccaaaaacaggcttcctctttttttatttttttattttttgagacggagtctcactgtgtcacccaggctggagtacagtggcgcgatctcagctcactgcaacctcggccttccaaattcaagcgattatcctgcctcagcttcctgagtagctcggcctcccaaagtgctgggattacaggcatgagccatcacggggaggcttccccttttgaaacagaatgaatgaaacattgcttcaaaataggatgaaaccacttccactttaggaaataatctagcctggcaccctgcccctttggaaaagcaaggcactattattcatatttttattttaaattcatgtaaaacaggaccagagacctacccagggtcacagaccaaataagtggtaagcagaaacacttaaaaaaaatcaaccctttgcctcatattatacacaactacttaagcagatattttagacaattcccttttactctgtcatttaaacagactttgaaactagatataaagtgtaggcaaatattagggcttcagtaatattgttaaggtaaaaatagtgggactaaaattaaaatctgatggtgtgaccatctgctgaaatggtttccaaatgtcacttttttctttaaaataatcaagcagctgaagtgtgtcacatttctgtttttctatcatctaaaaaattacagggaatgtcatatctgcactccagtaagacagaagtccatggtcgtctgaaatctaccaactgcgtagtggacagtagaatggtggtgaagatcactgattttggctgcaattccattttacctccaaaaaagggtctgtaatgaatgaaatgttcactagtttcctaactgatttttttttcaaacccatgtagcgtggtcaggaaattgtaatactgatcagaagataagcacttaaagccacaagagacaacagctggctcattctccagaacttcacacttgtcagtcaacgagtatttcctgagttaaacaaatgtcctctgtggatttccttcatccatgcgtcccttgctacactgagaaatcatgaataacttaatggcttgtgggagcagaactagctgaaaaaaatatagaaggttagagcaggaagagaccttagacatcgtctaatttaagctttttcctttatagaggacagcactgagactcagatttgtccaagaaggtagagtacaaaccagaagacccatttcccattcaagacatcattcatttatgtgtggtaataagaaatgttaaggaaaaaactctaaccagtaaaatatattcttacctctttcaggattgtggtgagagtcaaaaaagataacataaagaaaacggatttgtaaagtataaagggcttttcgtgttgaacatttaccctttcttgactatgactcacagttaaacagactcagatatctagaactcatgttgccttaaaatactacctagagccaaacaccaaattatatttctaattcaactttgcaatcctttcgtttttccttaataaaaggaaaattgcaattctgtccctacatccacagccatttcaagcataatatgatattgaactcaatctaataatttcttattgaagacctgtgccaagcctggttcatgacatagtagtacaaatcgtcatcagataacctagcatgacacaaatcagataaattacaggtcaaatcctatcatcttaaacagcactcgcttatacctacctacctatggcatcagttacctaaaattttagcataagtagatttacttaccttttctacaacccctaacctttatgatcaactatgcatgaatcacaattcacaaaaattcacaagacacaaattcaaaaaggtgatgtacatttggacagagaaccaaataaggaaagtgtgcatcatcataaacatattattgcacctaacaacatgaatctatacatgtttcattgaaactggtgaaggtaagtcttaaaaagtttataaggagctaggtgatcctgaaaaacttacgaagcatgttgaagaaaaattaattgcatgcccgttattactaaataaggtgtgtaataaggattcaaaactcgagtatctataggagctaaatacagcattgcactcatgtgaagtgagtgaactagatgtaagcactagggagtggcagggacaggagtaaactgtgagtaaattacatgcgatacttttttaagaatactgtgggaaccagcaaaaacaccactgtggaccctagctgagttgcaggctgccagtatgttatgccttgaaaatatcagccatagtctctttgtcttaatgtactgtctttatcttcttttggtaaatttatatttaaatatgcatatacacattaactaataaattataataatttaaataaaataaatttagtacacataaaatttgtatttttttttttgagatggagtctcgctctgtcacccaggctggagtgcagtggtgtgatctcgtctcactgcaacctccacctcccaggttcaagcaattctcctgcctcagcctcctgagaagctgggactacaggcgcccaccaccacgcctggctaatttttgtatttttagtagagacagggtttcaccatattggccaggctggtctcaatctcctgaccttgtgatccacctgccttggcctcccaaagtactgggattaccagcgtaagccactacgcctggccaaaatttgtattttgaaggctttcataggttcattccatatgtcccataaactactaaattcctcagcctctcatattctactgtattcattcaacatatatttactgagcatttaccacaatcagaccccattccaggtaaactttgagagttttcaagactatgatcctagcagttttaaataacatattgccatatgacctcacccaaatcctaacatttcatagttagtctaaaaggtgtgtgttctacctttgatcaccaggattagcaaaaatttttcaaaaatttggaatcatatcaattcaaggccacttataagctatcacccatatttagagtggatggtgtagggaattagagagcaaaagcaggttggaggcctatgaaccactcacccccctcaactttgtaatctcaatgtctacatttacagacctgtggacagctccagagcacctccgccaagccaacatctctcagaaaggagatgtgtacagctatgggatcatcgcacaggagatcattctgcggaaagaaaccttctacactttgagctgtcgggaccggaatggtacatctaaacccattcatgtgtcccctctgggagtgagccaacctgctttctaggcttactgagaccctaatctgtctgtaaccacatcacaattccttcaaatgcaaaattaatgatttcccatctgcattatgcattttataagaatataaggaagattcaatattagggtgcactgaaaagcataagacaacatacactgccaggtgttattattgtcagtatcattgttaacaatcttcgtttacaattgtcctctttccttttgattccaataagagaatgtacctgcttaacatctaaactagatcactctaacaggatgacatacatattttagttcttactaagggtagatgtatagtttttggccacacgtcctctcaagggaaaatgcttcattccattcattcaatcctcacttactgagcatttattacgtgctaaccgttaactgtttggtggggagtagggtgactaagggacgtggagagggtgggtcaaagtatggacagaagaagcctactgaaggcagtggtgcctgagctgagttttacagcgacagtagcattttttctttttttcttttcttttctttctttttttttttttttgagacagtgtcttgctctgtcacccccaggctggagtaagtacagtggtgtgatcttggctcattgcaacctctgcctcccgggctgaagcaatcctcatggctcagccttccaagtagctgggacgacaggtgcacaccaccacacctggctaatttttgtactttatgtagagacggggtttcaccatgttgcccagactgagctcctgagctcgagtgatcccccaacctcagcctcccgaagtgctgggattacagctttgaggcactgtgccccacccggtagcctatccttaaggtaaccttctggttataagtgggatgagaccctttcactgggtgcctcattgaatcaacacctgtctactgagtgctggtctaggctctgcagcactctcactgagctaagagccatccaggggagtgaatcaactggatttctgttgaaattccttccatttcttcatgctgtattcttctttgtaatttatatttttctcacccaaccagagaagattttcagagtggaaaattccaatggaatgaaacccttccgcccagatttattcttggaaacagcagaggaaaaagagctagaagtgagtatatcttcccgtattcatttccttggcctgctataaaattaccataaatgtaatggattaaaacaacaaaaatttattcacttacggttctggagactagaagtctgaaatcaagtgttcagcaaggccacacttcctccagaagagctaaggggctaatccattccttacttcttccagaagcttctgatggctgttgacatttcttatcttatggccacacaattcaatctctgcctcttgatcacagtttctcttctgtctattctccctctgtcacctttctattaggacatatgtgattgcatttgggtccacccagaaaatacagaataatcacctcatctcaagaattgtaacttaattatatctgcaaaggctctttttccaaataaggtagcattcataggttccaggtattaggacgcagcatgtctttgggagccagcctcagcctaccgcattctccgtgcctttccaccactccccaactcaggaatgagctggcttctaaagcacacatctcattctctatttttttttttttttttttttgagacggagtcttgctctgtcactctgtcactagagtgcagtggcaggatcttggctcactgcaactccggcctcccgtcttcaagcaattctcctgcctcggcctcctgagtagctgggactacaggcgcctgccaccacacccagctaatttttgtatttttagtagagatggggtttcaccatgttggccaggctggtctcgatctcctgacctcaagcgatcccacctgccttggcctcccaaagcgctgggattacataataggtgtaagccaccgcgcctggcctcattctctatttttaaattgatatttgtacatatttgtggggtgtatgtgatattttgtcatatgcgcagaatgtgtaatgatcaagtcatgtatttaggggatccatcaccttaagtagttatcatttctatgtgttgggaacatttcaagtcctctcttctagctgctttgaaatgtacaatacattgttgttaactgtagtcaccctactctgctatcaaacattataacttattccttctaactgtatgtttgtacccattaacctacctctcttcattcatcccctgccctacctacacccttcccagtctctggctatcattattctctccacctccatgagatcaactttttcagcccctgcatgagtgagaacatgtgatatttgtctttctgtgcctttcactttacatagtgacctccagttccatatgtgttgctgcaaatgacatgatttcattatttttatggctaaatggtattctattgtgtacacatcctgcattttatttttccattcatccactgatggacatttaagttgattctgtatctttgctattgtgaatagtgttgcaataaatgtaagtgtgcaggcatcctttgatacactgatttctcttcctttggataaatactcagcagggggattggtggatcatatggtagttctatttttagtgtcttgagaaatctctatcctattttccatagtggctatactaatttacattcccatcaacagtgtgtaagggttcccttttctctgcatccttgccagcatctgttattatttggctttttagtaatagccattctaactggggtaagatgatagctcattgtggttttgacttgcatttccctgatgattagttatgttgagcattttttcatattcctgttagccatttataaatcttcttttgagaaatgtttattcatgagttttgcccactttttaatggaatttttttaattgctgagttgtttgagctccttgtatattctggaatatcatccttgtcagattaatagtttgcaaatactttctcccattcaacaggttgtctcttcactctgttgtttcccttgctgtgcagaagccttttagtctaatatagtcccatttgtctatttttggtttggttgcctgtgcttttgaggtcttagccataaaatctttgcctaaaccaatgtcctaaagtcttttctctatgttttcttctaatagtttcatagtttcaggtcctctgtttaagtcttaaatctatcttgagttgatttttgtatatgggaagagatggggtgtcctttccccattgtatgttcttggagccgttgttgaaaatcagttgtctgtaagtgtgtggatttatttctgggttctctattctgttccatttgtttatgtgtctgttcctgtgccagtaacaggttgttttggttactgcaactttatagaacattttgaaatcaggtaatgttatgcctccagctttgttctttttgcttgggattgctttggctatttgggctcttttttggtttcgtatggattttaggattgttttttccatttctgtgggaaaatgacagtggtattttgataggattacattgaatctatagattgctttgggcagtataatcattttagtgatattaactcttccaatccatgagcatgggatatcattccatttgtttttgtcctcttcattttcatcagtgtttgtagttttccttatagaggtcttttaccttctttgttaaatatattcctaggtggttttttttttttttttggtagctattgtaaatgggattgtcttcttgatttctttcctgctgagtttattattggtggtatataaaaacactaccgatttttgtatgttaatttttttttgagacagagtctcactgtgttgcccaggctggagtgcagtggagtgatctcggctcactgcaacctccacctcccaggttcaagcaattctcctgcctcagcctcccaagtagcagggattacaggcagctgccaccaagcccagctaattttttttttatattttagtagagacggggtttcaccatgttgcccaggcttgtctcgaactcctgagctcaggcaatccaccgtccttggcctcccaaagtgctaggattacaggtgtgagtcaccgcacccagcctgtatgttaattttatatccttcaactgtactgaatttatcatatctaagagctttttggtgaagctttaggttttctagacgtaagatcatatcatctgcaaagagggacaatttgactccctgttttccaatttggatgccttttatttttcttgcctaattgctctggctagtactttcagtactatgttgaataggagaggtgaaattgggcatccttgtctagttccagttcttagagggaaagctttcagcttttcctcattctgtgtgatattggcaggtttgtagtatatggcttttattattttgtgggtgtgtgatatatggctggcctttattatgttgagatatattccttctatggctagttttttgagagtttttatcaagaagagatgttgaatattatcaaatgctttttctgcatcgattgagatgatcatatggcttttgttcttcattctgttgacgtaatgtatcatgtttattgatttgcatatgttaaatcatccttgcttcctggggataaatcccacttgatcatggcgtattatctttttgatgtactgttagattcagtttgctagtattttttttcttggaggatttttgcatctatgttcctcagggatattgacccatagttttccttttttgttgtatccttgtctggttttggtatgagggtactgctggccttgtagaatgaaggagaattccctattcaatttttttgaatagtttgaagagaattagtgttagttcttctttggaagtttggcataattcagcagtaaagtcatccagttctggacttttctttgttgggagactagtgattcagtctcattactcattgttggtctgttcatgtattctatggtattctatttttttctgattcaatctatgtagattgcatttatccagtaatttctccacttcctctatatttttcagtttgctggtatatagttgttcataatagtctctgataatctttcacatttttgtgcaattggtttttatgtctttttctaatttctgattttgtttatttggatcttctctcatttttttcttggttagtctagctaatggtttattgactttgtttaccttttcataaaaacaactttttatttcaatgatcctttgtattattttttcaacctctattttgtctagttctactctgacctttattatttctttccctctacgaactttgggtttggtttattcttgcttttctaattccttgaggtgccttgttagatttgaattttttctgattttttgatgcaggcatttattcctataaactactctcttagcagtactttcgctgtatcccataagttgtggtatgctgtgtttaaattttcatttgttttaattttttataatttctcctaatttctttattgactcaatggttattcagaagcatgttgtttagtttttatgtatttgtgtagtttccaaagttcctcctggtattgagttctacttttattccattgtggcctgagaagatatttgatataattctggttctttataaatatgttgagactggttttgtgtcgtaacatatggtctatcctggagaatgttccatgtgctgatcacaggaatgtttattctttagctattgaatgaaatgttctgtaaatgttaggttcacttgttctaacgtgcagtttaaatccaatgtttcttggttaattttctgtctttatgatctgtttaatgctgagagtggagtgttgaagtccccaactattattagattggaatctacttcttcctttagatctaatagtatttgctttaaatgtctgtatgcttcaatgttgggtgtgtatatgtttagaattgttatatcctcttgctgaattgagtcctttatcattatataatgacctatgacctttgtctctttttacagttttttacttaaagtctgttttacctaatataagtatagctactcttgcttgcttttggttttcatttgcatggaatatctttccatccctttactttcagtctacatatttctttacagataagatgagtttcttgtaggcagcctatagttgggtcatttttaaaaatccattgaaccagtctatatcttttaagtgaaaaattttgatccatttacattcaaagttattattatgtaagggcttattcctttcatttgattaattgatttctggttgtttatacatcctttgttcctttctttcccttgtttttcattatggtttgtggttttctgcagtggtaacctttgagacccttctcttccctctttgtgtgattgctttactagtgggtttcatactttcatgtgttttcatggtggtagatgacatcctttcacttccaggcgtaggacgccctgaagcatttcttgtaggggaggtctaggggtgatgaatttccctagcattcacttgcctgggacagcctttatttcttcttcatttatgaaagataagtttgctggatatagtatccttaactggaatttggtttttctttcagcactttgactacctcatcccttttctcctggcctgtaatgtttctgctgagaaattcactgttaatctgatgggggtttccttataagtaaccagatgcttttttcttgctatttttagaattttctctttaacttttgacaatttgactataatgtgccacggagaagatcttttttaattatatgtatttggggatctctgagtttcctgtatctgaatgtctaaatctcttgctattattttgttaaatgggttttgtattccttttgttttctcttcgccttttgggacaccaaaaattttaagtatttagccactttatggtgtctatatcatgtaggctttgctcattcatttttgttcttttttctttatttttgtcttattggattatttcaaaagacctgtcttcaagttctgaaattcttctgcttgatctagcatattgttgaagctttccaatgtatcttgtgttttattgaatgacttcttcagttccagagtttgttttattcttttttatggtatctatttctttggtaaatttctcattcatatcctgaatttttttttatttctttgtattatttttctgtattctcccatatctcactgagctcctttaatattatttttaattatttttccagaattttattaatttccttttcattggaaattgttgctgcagaactactgtgtttctttggaggtatcatatttccttgctttttcatgcttcttgtgtctttatgttgatacctgtgcatctggtgtaacaattacttcttccaaattttaacatttgctttcataggggaggacttttttcctgaagatgtatctatagtattggttgggtgaggcactttggctttgattctgggtgcatgcagtagtgtagtctctacataatttactcatctgtgagtgggtctgttatttccctaatgggttaggatgtcattgttagtggaggcagtagtgacgttttgttgaagactggaatgccaggtgggctggtcctcagggccccttggaggcactggtgccagcataagctgtccttgggccccaggacagcttatctggtaccagtgttagtgggtctaggcagatcaattctttggcctccaagtaacttcctcaggtgccagcagtagcagcagtggcctaggctggtgggtggattcccgggttcctgggcagcaggcatggcatgagtagtggaagtagccatgataggacaagcttctggttcccaagcagtctgcactggtgttggtagtggctgtgacaggctgggcaggccagtctgcaggtccacaagtggtatatgctggtgggtaccagctgtggtggtagcagcaggttatgtggcccccagaagatgtactcaggtgccaacagtggtggactgggctaggagatctctagggcccctacacggtaggctgaagcactgggagggtgcaagtgagccaggtggacctgtcctgagacctgtcttcagtccccaccctgtggtgtgtacaggcactggcttcagtaggcaggggtcattctcaatttttataagctcaatgaacaaggtgtccatgcggtatacttactagacttataaataccatctaatgatttaaaaggaaatatgccaacatctaaaaagaatagagaaatgtacttccactcattttatccttcctctgaaggaaatggagcaaaagctctttacatttgcttttgtaattgtccctcaaaaaggccttgaagccctgtgaaaaatttctaattatttttccttttagcattttacctgagccttaataatccaagaagatagtgagtaaagtattttaagatatttatgatctttacctaaaaccataaaaaccctagaagaaaacctaggcattaccattcaggacataggcatgggcaaggacttcatgtctaaaacaccaaaagcaacggcaacaaaagccaaaattgacaaatgggatctaattaaactaaagagcttctgcacagcaaaagaaactaccatcagagtgaacaggcaacctacaaaatgggagaaaattttcgcaacctactcatctgagaaagggctaatatccagaatctacaatgacctcaaacaaatttacaagaaaaaaacaaccctgtcaaaaagtgggtgaaggacataaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagctcgtgtcctttgtagggacatggatgaaattggaaatcatcattctcagtaaactattgcaaggacaaaaaaccaaacaccgcatgttctcattcataggtggaattgaacaatgagaacacatggacacaggaaggggaacatcacactctggggactgttgtggggtagggggaggggggagggatagcattaggagatatacctaatgctaaatgacgagttaattggtgcagcacaccagcatggcacatgtatacatatgtaactaacctgcacattgtgcacatgtaccctaaaacttaaagtataataaaaataaaaaaaattttaaaaaagacatttataatctttaaacaaaaacatcttttgttccttgtgggataaaaatagaaacattttccttccatttacaaagacactgccagatgagttttatggccagactctgcagggcatgagtgggtcatttttacctctccccttccctttctttttcaatagtaatagtatgttgaaatacagctttccgaagtacagctgctcctagccctgccttctcctcattcctttctttcgtcctgcttttctgaattccaggattcctccacacaatcagcatatcctttctcaagccctttttttctaatctgagtatatccaaatagtaaaaccttattcactaaaacagcagcatctttaattcatttgtgtagttggacagttctggaattagaaatgaggaataaaatttcatgtcaagtaactgattccaacagaatacagagtcgaaactagatcactcagcaatgccccagaaacacccagtagagtcgtctctccatccatagggaattggtcccaggaacccctgtggataccaaaatccacagcggctcaaggatctgatataaaatggcatatcatgtgcatataacctgcatacattatcctatgtactttaaattatctctagattgcttataatccctaacatgatgtaaatactatgtaaatatttgtggtactgtattgtttagggaataatgacaagaaaaaaaaggtcggtacatgttcaacacagacaaaaccatgctgttttttccaaacattttccattcccatttggttgaatccacgaatgcagaacccatggagacagagggctgacagtatttcactctgtggcacaggatcggcccagtttgctgtttctgcctattctgctctaaggtagtcagcagatgacttaccaaggcaggagcatcatctagtggtgaatattggcaccacaggctataccgcggctctagttccttcccagggaattgttcagacaaagtacagggacagggattgcatctagtatcacttatgatcttgtttttagccggagtgaaaaacaaagtttatttaaaacaaatggttttcaccacacattttgatttaaaaaaaaaaaagctgcaaacaggtggtagcagatgagcagttgggcttcctcctgtctccctacctcttcctccatacctcccttttttccatgtcacttctctactgcagctgtgcattataatcaccaaagagcttaaaaatctaccactgccctttgcccatacaatatttgcgacatacttatactaaggaattacttattgtttatctgaaatccaagtttaacttgatgtcctttatttttcttgctaaatctgggaaccctactaagaccacttcaaaatatattaaatcagaatgacttagggtggtgcctgggcataagaaattgtgcagatgctccccaggtgatactattgtttgctataagttagaaccatggacagtacggcttttattccatttggagccatttgcctcatattcactgagcctttgttcccccaccaaactgagggttgggctgatatttctcgtggcccaataacaagatgcagatgaactgaggaggaagagagtttttatttctgtaaccagttacagggagaaggcctgaaaattacattttttttcagagcttatataccttcgaagctatatgtctacatgtaagtatgcattcatttaaagacatacgtgattaacttcttttaatctacaactaaggtctgagtcctgaagaccttctcctggagcctcagtaagtttacttaatcgaagtgagtccaggtgctggagtgattacccttatcttgtctcctgctaaattacagaggtttagggagttccttcagacccccaataaacttctttgtggaggcctggggagtttcttcagaccgccaataaaacttgtttaatcctaaatgggtccggttaagaagaattccttcgttattttgtcatgttttaaggcccaggaaaggcctaggcaaaactcttggtgggcttttgttacattccagcctttgtataagggcactggcttttaatatttaacttaaccactcagtcagtactaaaacggttgttatggaggcctgccacaccttcactatttttttctctctccaacgtaaaacttgcaagctcttgtaaattcacttagtctcccgtatcaacccggcctcatctaaattggtatcacatatttcattaatttcacccaagggaataactggataagataatgcaggtggtcatgcctgagacagaaaccagagagctggggatctcttgtccgcactgagttgaagatatttttaaactattccttgccttaatcactcccatcaatgagaataagaattctctcttgatttagtttactatccccttagctaatttgcccgttttttttttcttccaggtgtacctacttgtaaaaaactgttgggaggaagatccagaaaagagaccagatttcaaaaaaattgagactacacttgccaagatatttgggtattgctgaaatgtttacttttattcactaattgcagggttttaaaaaaattatagttgacattcagtggcacctaagaatgagaatgtctattccagtgaaaaatcccaggtggcaaccaacaactgcctcataacattaaaatgatatggagactattagaccgttttcccagggaaataatcacttgaaaagttacatactcaaggtcaaaacttttctgattaaaaaacaaactttagctgattataaatttgtctgttaaaaatagagcttctgggtccttctgtgggtaattaggatttagaagtgtagcgtgagtcctgagaatctgtaaagctcctagacaattattaacatcagcatgttcttaggatcttaaagtcttaaaatctccagctttggccctaggtacttaagacatgtcatgaatcagagcataattcaagttgggggagaaaagtacacaattatttggttgagattaatttctagataccccatgttttcagttaatacactgcagaatgagaaaaataacactgaattaagagttaggaaatccaatttctagactaagatctgataagagtttgctgtggggcattgggcaaaacacttaccctcactgggtatcaattttcttgttagaaaaattggattgaacaagatgattcttatgattttttccaggtctttctgtagttctcattaggtcaaaagactcagatacttaatgagactaaaagtctagagctggaggagatgaggtggagtgaagttaatgaacgtgtggtcattaattagtagaactaagctgtcagttgtgggaatggagcaggaaataataattaattctagccctttttttttctcctcgctgtcctgtccggatgagactttatatgtgactgataaaatgtatgctcatgaagaaactgggtccttgatactcagcctttaatgtgtgtgatggttctcaaacttggctgcagcttggaatcacctgaggaactttaaaaatactgatactggggttttaccctagagaggctgaggtaattggtctggggtacatacaggtgtcaggatttttaatagctcccaggtgattaaaatatgcagtcaaaggtgagcaactgttttaattgaatcaattcatcctagagtaagattatccaacttcatctcttacacctgctcccacatccattctacccaactagactctgtactggcagtttcaagtaaaaattccctggggaacttgttaaacgattctgtttcttcattccaagcctagcaattttcagtcacataggtctcgggtagggcacaaaaatgtactggatttttaacaaacatctctccccatcccaggggatgatgatgcaggccatcttctcctgagaccagaagtgattgttattcttgtaatagtaaaatgactgtgatttattcagcaccttcaattgtgccttagatgttatgaacattatctctgatcctcacaatgctaggagaactcaatgtgtctcctccctgacctctgcaccaaggcttgtcatacctcccagtgtcacacaaagctgtcatctcactaagtctccttgatctgacaaaataatccagagttaggaccctggctctctgtaatgaggagataatttaaggctcagcttggcttttctcagtccttctcctttcatttatcactttcttgaccagcttttaaaagattttccttcattgcaaattgtttcttttgtattttagaaaatacaaataagaaagcaagaaagtaaaacgtcacctgtttcccaataggtgaccaccagtcttcaaaaaataaaattgagattataatttttgctattttataaactgactttttcgcttaataatacagagggagtgtctttctgagtattcaactatactaatttgtattttatgatacaaattagaatgttaatgttccattgtcccatcatattttaaccacacttttgttatacatttagattattttcaaatgtttgctgttgtaaagaatactgtgactttttctgttgttaactctaaacacattcatgattgtttccttaggataattctcagaagtagagttataagctgattggtatatgcattcttaaagcttgtgacatatttttaccaaattgctcttcaggaaggttttgtactatatgtatttcctccttctcctacgttgattaccatcattttaacatttgttttcccttttttaatcttattcttgtcctgaggttaagttgggctttttgtttgtttgtttgtttaagacagagtctcactctgtcacccaggctggagtgcagtggcatgatctcgactcactgcaacctccacctcccagtcaagcaattctcctgcctcggcctctggagtagttccaccatgcccggctaatttctgtatttctagtagagaaagggtttcaccatgttggtcaggctggtctcaaactcctgacctcaagtgatcctcccgcctcggactcccaaagttctgggattacaggcatgagccactgtgcccggatgaggttgagtttttttgttatgtttgttggcttttatttttctttgtttaattatctgttcatcatatttgtccattgttttattggatgttcatgttttcttaataatatataagagctctttatctattactacctacagactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggtaaggcaagccttgctgatgtggaggctgaaatccctctagcattgcttttcattgtatctatataggatttgtttccttttatatattcttcagtagattattggttttaaaatgcacgtactgccaggcacggaggctcacgcctgtaatcctagcactttgagaggctgaggcaggtggatcatgaggtcaggagatcaagaccatcctggctaacatggtgaaaccccacctctactaaaaataataataaaaaaaattagccaggtgtggtggcgcgcacctttagtcccagctactcgggaggctgaggcaggagaatggagtgaacccaagatgcggaggttgcagtgagccaagatcgcgccactgcactccagcctgggcgacagagcaagactccgtctcaaaaaaaaaaaaaaaatgcatgtactttgctaagccttgttccagtttgtactctactaagtaatgttctgaaggtcacccagtgaatggcagagctgggattctacccaagaagcccgagctggagcccctgatctcctttagtaactctgacctcaaaatctcaaacctctgaaagtcaaatcacctgcaagaaaactaggaggcggatcacagcttgggggaaaggagttggaacacatttggcaagtggtgtcttgcaaccttgtgatagaagggcagaacccatgagccctcagagtgcctgggaacagtagggaacccttcatattcacttcaaggatgataatttctatcacagctccataaatattaggtacataatgcataactccttgcctgatctttaatgctgagttgtgacaaaaacaatatcctggttatctggctgccttcccagggtttcattggcggtggttttaaccattaatgtcactcaagtggtttgaatcagctggctcaccatttcagcttttttcctagccttagttcaatatgccacttggactactagttggtagatgtttttattggatttccaaaggttatatcacacaagtctcttgaagagctacaatacaccatggcttcagcacaactcactttggttatttatgtaaaaattttatgcgcaagataaaactaaaacatgcatgagcaataactagaagaatcaaaaagaaatatgtgtagcaaagggcaaataaacttaagattgcatgtaggaaccagatatcacttagacatttatttgaatagtaccccttggggtaaatacattaaaatagaagtttcttcttttttatttttattttatttaattaattaatttatttatttttgagatggagtttcactcttgttgcccaggctggagtgcaacgacatgagctcagctcactgcaacctctgcctcctgggttcaagcaattctcctgcctcagcctcccaagtagctgggattacaggcgcctgccaccacacccagctaatttttgcatttttagtagagagggggtttcaccatgttggccagactggtctcgaactcctgacctcaggtgattcacccacctcggcctcccaaagtgctgggattacaggtgtgagccactgtgcctggccagaagttttttcttctgggaagactttctaagagatctactctgtatactaattttatctatgtcagcaacaacctgttatcaaagctcatcatgttaactcccagcccttccttcgtttatttacaacatgagtttctctctctggataacacactattttccaagtgtaatagtccattctcaccctattataaagaactacccgagactaggtaatttatgaggaaaggaggtttaaataactcacagttccacagggtgttcaagaagcatggctggggaggcctcaggaaatgtacaaccatggtggaagagtgaaggggaagcaagcaccttcttcgcatggcaggaagagagagagagagcaaagggggaggtgccacacacgttcaaacaactagatctcatgagaactcactaacacaggaacagcaatggggaaatctgcacccatgatcccatcacctcccaccaggtccctcccttaacattggggattacaattcagcatgagatttgggtggggacatggagccaaaccatatcaccaaactcatgtgacttttcagatataagcagtacaatgaattgcaaatatggcagaatatccaattttgtcattgcatctatgcagcctccaaaatactatgcactttatacagggcatgtcaagaacaaccactccagtcgtgtacctaggaatccaagccacaccaaaggaatgtttttcaaaggttccaagttttgtcattgcaccaattaaaaaggtttctccggatgctctggaggttctccaaatgagtgttagaaatctttgtggttgattggttgttttctttccgggagagcccacctcctttgttgcagtcagcatacctccaaatcttccccatcttcctgaatatccaaggcctgggttgtgcagggagtgtaatgcaaaaaaagactgatgggtgggactgaaggcttcctgaattctagccctggctctgtccctaatcggctgtgggaacttagggaagtcatacttttttagacctcaactttctcatctgtaaaaataaagatttcttttcaatgacttccgtggaacctcccagcttccagtttctgattctagtggttccatactgagggccactacaaagtgatgccaaggacagacagggaccatcccacttcatgtcagccctcacttccttttctcaatgaagaggtaacttggcacaccaagtatggagtcccttcttctggttctcttccttcaatcttgaatctgatatgctgctcctcattcagcaaagatattctaaaagttgctttaatttgacttctacagttttagcatgatttaatttatttacaagattgattctgctttacaaaggacccaaatctggttcaaaatatcaaatgaactctggttcagaatatatcaaaatttatatttaaatgcatcattatttcatagtaatattaagcaatgccatattacatatgccaggaaagtaaaactatcaactttgttgagaaattcagatctgatacctgtggtgatttaagtaataccacactctcctcagcttctgcatgtagagccacatctgtaagaggttgattatcaatagagaagcaaaaagtggacaagtatgtatatgtatgagagttttgaggatattaaagttatctatttatgtgtattaggattaataatcaaacactaagttaatgttgaacctgcttgtattcatctgtgttcacaacatgcattatatgtgtatttgtgtaatatgttcatgtatatgatatacacaacctctgtttccgattcactcaattcactggaagtctcaaattctagaattcttggtagacagtcactactacctgaaagatttatgtgaaacaagaagaaatttgctgaagttgaaggcattttttttcccttcgttcatctaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtaaccacatcacctaacaggctgaaaccattaattgtacaactcaaggtcatcagagcctgaattggttgtttctgttactactcttgtccgctctagtttcacatttagtgaattggtggttgaatctgagctaaaagtgaagagaagtagaaggattagaggagtgagaagtcaaaattaccattcaactttaagaagcagcaaaaaagatacaacaggaagttcagcaggaattaatttgaagtattaaatttagacaaaatggcatactcttaaatcacctccaaaaaatgggcagtgtttaggctgactgcaaatgaagcagagaagacactggggttataataaatagaaaatcatactacaagaatgtatacaattacatattacaaagtacaatattctgttaaatagtatgttgacatttgctaaaggattaattttcaggaaactaagggtgttcctcaaattacataaaaccattcagattatttatttgaacatttctagaactgtcaccacatctggacaatttatataattatgaagtacttttaaatggctaaattcctttatagctattttatcacccattaactggactataaaaaccctgaagaaatcagcatagaactgatccaactggccccagaaaaagtgtaaagggctatgctcatactgtgttcgcaaatcactttttgtgtttgacatgtgattaactgcttctgtttactttctatacttttcaaaggggcagaggcactcatgagaaactgtttccacaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtatggagttgagcatcttagcaaattgggaaccatatgtactgctgtgcaccaactaaatcagaaaggataaaaggtcttcaagtgtgatcgacctcacataatttttactcttaattctttttgccaaatgtgaggtcccactatgcatcctgagatatttagacccagttcctagagaactctaagaacaagacctttgagggcaccactgactgctgacatgataaacaccaaacatgtacgaaaacaagaagctttggactcctatttaaatcaccatacctatgatttcatttatttcctccccattccctttctccccacccccaacttcaatatattttcccactaaaatattatagtatcttaagtggattagattatctacaaggggaaataaagaacagatggtgaaatttctataatatttataccccctcccttccctgccactgcagttatacagaaagtacatgagtcactttcaaagaccatgaaagttacatagccttgttaaaagaaaagcttatgcatattaaatttaacacagtttgattgagcaaagaataattttcaaatcagatggcccttaaaaccagaagaggttcagagagcttcaatgggcaaggtgggcgggcaatgtttatagacagaaaacagaagtgagggacagaaacaacttgattggtcaaacctctgtgttcccctgatttggtcaaagtcccatcagttgacagcctgtgactggctgaagctcagctactgcgattggctgagactcagctatctataacgtaagtataccctagttaggcttttagtttgtttatgtaccaagctaggttgcagtttgttttgtagggacccctaagaggcagcctcaggccaaacttagtttaattcaacagccttgaacatcaaggtttgagatgagttacaggtgttatagaaaaaacacctgtaagagaggaactcagaagtcatctagatgaatctttagccaggcattgcttaaaactcagctttgcagtttttgagttaatctttaacttctgaaactgttaacaccttgcactcagtcattctatgcaaatacatgactgaataacccttatttcctacctaatatgccacagcgcatagtctagcctgggcttttgttctgcttgttggaacctccttgtgccacaggcttccccatccagctgcattcgcctggtccatgaaatgcttacggaaagttatgcctttgtcttgtcttctgtcttccattgtcatggcaccaatcccagaaatgccaccttaaaataaaaataaaacaaacttgagccattgaagcttcaaatctacagtgccctccagcagtgtgaaattcagggttgtgtggtttggcacagtaagcaagcagtggggctcatcttcatccttcctgagagccttctatttaaaatcacctttgtgatctggatctctgaatgccttcctatttgctacaaatgtcgttttctttgcgagagcaaaatactttatgatcgcatgcattgaataatgatgcttcattggattcatccatttaaaccaaaagtcccagctcacatttcacatcctcagctacttctccatgacaggaagtattcaggattgtgaccatacagagaggcttacctgtcttcactctactctgcaatttctattgcctccacttcctgctttctgtccttcatttcaggtccctgtgctgctggagttgtgggaatcaagatgcctcgttattgtctatttggagatacggtcaacacagcctctaggatggaatccactggcctccgtaagaagggagactgtttttctcagaggacaaagatgctgttttccagcagagggcaactgtgagataaaatgcacaataaggagatacaaagtgccagtgagatgtagaataattcttcacattagctgaacacaaacccgtgtcaatccaccttttgctacatttgctttcattgttgtttactgataattattttattcttccacttttgctcagttttagactatttctatatttttggctcatatactatgaatctggggatattctacttagaatagtcctggcatttaccatagattcatgaaagttaaaaaaaaatcagtaggcaaggtaagaactacacactctggttcacattcctgtttccctcttatttggttttgcttttttgttgttgttttttagagacaggctctcgttctgtcacccaggctggagtgcagtgacacgatcatagctccctgtaaacttgaactcctgggctcaagtgatcctcccacctcatcctcccaagtacctgggactacagggaacataccagcacatccagataatttttaaatttttaatagagactgggtctcactatgttgcccaggctggtctcaaactcctgacctcaaggagtccttccaccttggcctcccaaagcatattcgttttttctggaaattgatttttgtttatttgtttgagatggggtctcactctgtcgcctaggctttggcacagtggcacaatcacagctcactgcatccttgaactcctcagctctagtgatcctcccacctcagcctcctaagtagctgggactacaggcatgccaccatgcacagctaattttttaattttttctgtagaggtgtggtctctctatgttgtctaggctggtcacagattcctgggctcaagcaagtctcctgccttggtcccccaaagccccaaagtgttggaattacaggcaagagccatcatacccaaccaagaattgattttagtaaagaaaaatctaagcatttgttatatacgaaggaatatattgcatttgcttggcaaggtagaggcacaatgtgctgcatgaagtagatgctcaataaatattgatgacagtggtagcagtagaaatatatagaagagagaaaataagcactgggagacatggctggggcttacgaaaccacaggaggcaggatggtattttggtagtgtactgacaatgtgatactagtttgtcctggcaaatcatgctggcaaggaaaaggataaggttggggtcagacagacttgggttacaattgaaattatgttaatcattctcagtataagttgagtagaaagctacctgatccttctagccctcagaaagataaagatacaaattgaaaatggaataccaaccgtgccaagagggtttctgaaataatttgggatgatgtcatgttaagcgtttagcaatcatggtacatggtaggtatacaatttgggattgtcattattcttactgtgtaattgtttgtggtattgctattaggcccctatattgggaaaggtgatacacatcaatggacttgtgaatgggcgtgccctcaccacttcttttgtcaaaggataacaatgttccagaagaaggaaatttgagaaaatcaagacccctcaactctcccgaatcttcaccttgcccacaaggctttagctatttattggaacttttccacagggacccaaaaccaaactccaacacccaagcttggcactacaagccaaatctaaaactaggtcccgcaggctactactctgagctggaatgagaatctatggagaaaaacctagggatccccatcacatcacgcagggccctgaaaactgatgccaggccttctttcttcccacgtgagattatatttcttgtgtgagggcattcttgcattgctataaagaaaaacctgagactgggttatttataagaaaagaggtttaattggctcatggttctgcaggctgtaagggaagaatagcacctgcatctgcttctggggaggcctcaggaagctttcactcatggcagaagacaaagcaggagcaggcacttcatacagcaaaagcaggagtaagaaagagagtggcaggggcaggtgccacacctttttaaatgaccagatcttgtgacaactcagtatcgcaaagacagcaccaagccatgagggatccacccctgtgacccagacacctggtggggggccaggactccagcactggggattaaaattcaacatgagatttgggtggggacaaatatccaaactataccatttcttatctctctgatgttatttttaagtgttctttcattaaaatagccacaattgtttcttcttgatttaggattcttgtctcaggtgttgttgatatcctgaatcaacgggaaacaaataggctgtgtactagctgggatttttatttgtcaatttgcatttccagctttgagaattcacgtgagtggctccaccatagccatcctgaagagaactgagtgccagttcctttatgaagtgagaggagaaacatacttaaaggtaaggagtccacagagacaatgcataggaaaagctctcagacacgcttgggccacctcctttgagacttggccaggaaagttgagcatgctaatccttttctgtactcatcacgatgagcaccctccatcctctgcaagagaaatgaccaccaaaaaatgtgaactcaaaacttgcctttactccaaagagcccttttgagattttgaactctgccagcatttcctctgccatatccaggttttgtatccagttcctcctccaaacacaagagctacatacagtctggtccaggacttatttaatttgaatcaaaacccttgtccccccacttacttccctactcttactacacactgctgctatgatctgaggtcacctctcttgccagttgctttactattcggaagctctagaatcacaaggagtgaatgacaaggtgtggccccattctcctcctcttcctcatctggaagcttgttaaaatgcagatgtgtggacactctaccaggcctactatgcaagattctctgtgggcgtagatcagaaatctatatttttaacaagataatgtgtttgtgaccacactaatatttgagaatcgctattccagattcttcatgcagttcctcacatttaaaacagctgccctccatagccatcagttgtctccaaatgcttctcaggctgcttttccaaagttattggaatcttttcacaactggcaaagccagctattaactgtaagttacctgtctccggtagccataatgcttctggcctttacatttggattgcaccttggaaaagtctccttttacgtaaaagtgtcctaacatcacacttgctttttgagtcctccataagtacattttttacaaagaacacttaccccaaaatagaaccagtttatggattgctatggtccaaacacagccagtgaaccactacttttttaaatgagtttaacaatatatatcaattatatatatatatatatcaatcactcatttttaaattattgatatatattatagatatatattattaaactcattttttaaaaatagtggttcactggctgtgtttgggccatatgtattttgtatctctttttcaaataccagctttagcaaaaacagggtttccagtattccagtaaatttccatacattccgtagcctccagatgggccccagaaatgccacttaatgagttcttaattgtgatgtacatgtgtttgtaataagatagggaaactgtagcaaaagttttgtagcaaaactttattgcaaaaagggctagaaggaaatatggacaatgacaaccagttggatttgttgacgtagcagaattgtagatgaattttcttcctttttaagttagagttcttgtgatgttgctagagtgatattttaaaatgtcttttggggaaaaaaaagaaaactctactttgagaaaaggatgtctgctgaatgagaaacttatttttaaaaaggcacttggaaataaaaatctgtctagagataatgcaaatcataacaggaatgtgtgatgtgcttaaatattggcactgatgagaaatgcggaagtgaaacatgtcacagaaacagatcattatggaaacagtggtctacaactgaactgactccttggactccgtggtacgtaactcttttgtcttaccagggaagaggaaatgagactacctactggctgactgggatgaaggaccagaaattcaacctgccaacccctcctactgtgtaagcttctgggtgtggcagggacagggaggaaattagagatcttggctttgttagttacagccaatttaaattggcaaatgccttacaagtggcatatattgcataagaagtaagggactatacatgagaaggtttagaaacctcccttcctagactgcaagaaggggattatcctgaaaccctgcattttcctgagacctcaatgaaacagaaaagtatttagccttggcttccctgtctggaacacagacttgcttccctgaatcagatgtgggggctcagtataaaactacctttttttttttccactgtggatcctttatcccaagagggagcttccacctggaaaagaggaagaatgaacagactatttagaacttgaggagattttgttatttcatttatttcattttatttactggctctgtattcatgatatttttaactgtcaaaattatgttttaaatgccttatctgcattaaagtatacttaacttatagtttatgcagaaaatatactatatattagacaagaatgagttaaaagtttcctgagtctgggtatgagcttctacctattctgtccactttcttagactgtaccagtcatcatcttgttcttgctgaaaaactgactatattgccctgcaataaagcatggcaaagctagcgttgtgttccaggcttgctcgggagaacagaagacactttagagttcacttcatgcatgtcttgttctgacaagagtggagcatactgggggcaaagaggctctctgcattccactcctgtcttcatctttctgttgagttgcctgatgaaaacaggacctgccccaaccccaagactgcgtttctgggtcttaacatgaagtctgtgttctccctgagatgaggaagacaaagtttcagggttaactgacaggtttcacttctcctaaaggtgactcaagctgtcacccagttgcctgtcaatacatgttactgcagccatatggccatttccttggcttttgctatggttgagaaactctgtcttgcagaggcctagatgtcagacccagagagatggcaaccttctagaaaagccaaaacaacccaaatcttccctggggcatgagaaacctggctccttacttggagtgttccaggtccattctaaactcgtggtcccctccaccattctaagccttccccaaacaagactcacactgttaagtatgtgtgggaccaatgagttttcagggttgtgtggcaggggcctagcatcctcccagcttcttttccccttcctgcagtggcatatgtaaacctagatcctcccaaccatgcctccaaattccagcagcatattgtttcactttgaaattgaagcctaatttcctagcagagataacagttttttaagctcatcaaaggcagggatcattttgtattctttggatttcctgtgtctagcacagaataggcattcaaagagtaactgactaactgaactgattattctggagctaaggaatattctgtatgaattgctgagaagttctattttctcttcccactctgtttccagggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaaatgaatagactatctagaacttgagaagattttattcttatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaaggtttcccaaaactgtgtatgcgtttctacctattttgcccattttcctggaatacatcagtcacatcatcttgtgcttactgaaaaactgactacattcactcacactgaagtacggcaaagctagcattgttgctcaagggtgagaaccttgaaggttagtatcacttgctacacatgagggaatttttgacctttatacagaggtgttgcttcagcttgtccaattaacaatgtggatggcagtgatccaagtatgggacccaggcaaaagtcaagttcctgtactgcacttttctaactacaaagtaatccatgtctccaggctcctgatctttcatcagtaaattatgaattataatactcacttcattttagactgcgccaccccttcccccaagctggcataacaccactcacagataatttccttagacccacagtttacaaggtaaaaggagggaattggagatggaagtttgatctccccaccagtctgagaatcttcacaagaagctcactctggtcctgtctcatgaaccattgcaagtaccaggtgggctgaaacaccaggggtgaactggggacaaaaagcggaggtgctgattgctgaaactgacatgcagatcttgcagctgctctgtactccaatcagcagagatgccatactgagaaaactggatgatgcaacagtcctactctaggcaaaacccacaggaaagcctgaatccctggttagatttcccacaaagcccaggtgctaatgtggaaccttcctcttacttggaaacaactaaaaggttttttccttttaaacaacctttgaactctagcactctcctaaggcttccccagaccaggaagcaatagcagaccagtgactaagttacaacattaagcactaaaagtctaacaccaccaagaatacctgtaaaagctggaagaagtgaccatctcctcgaatgtgcgggcatcaatgtaaagacacaaggattgtgaaaactcagggaaatatgataccatcaaaagaaaccaacaaagctccagtaatagacccaaaataattgaaggcccgtaacatgtctgacagaattcagaaaaatcttaaagagttcagggaagcacaaaagagtatagattaaaaaaattaaatgaaatttgaaaaacaatccaggaacaaaatgagaaaattgacaaagaaaaaaatataaaaacacacataaaagtagaaatcttagacataaaggataaaatagctaaactggaaaagctcattataaagcttcaacaacatatttaatcagaggaaagaatgggcttgaagacaggacatatgaaattacccatctgaaaagaaaaaaagaattaaaaagaattataggataccatcaagcaaactaaccttcatataataagaattcctaaagaagatgagagagaaaagagccatattttaaaaattatagctgaaagattttcaaatctgaagaaagatgatagcactcaggtacaggaaactcagaggtc

SEQ ID NO: 13829 - DNA, 10190 bp, Human
tcagtctccatcttcagaccccaccaccatttctacagtagccactgtggatctccctactccaggttctgcctcttccatgtaatgagccaaacttggccaaggcagtcaacaagcagcatgcatgttagagccaggaacagctgggtccatatccttcctctgctacccacttcattcaggttgctaagccactcaagcctctgatacttcatctatgaaatgggggtgacggtctctagtttatggagttgttgggaggtgttagtgagataccctatgaaaaatgcctgacatggcataggggctccccacatattaggcaacctttacctccaaccccactgacagccacacacctgcccatcagggagtgaggttgagaatatcaaaatatatatttgcaacagaaaatgatagagataaatagtaattgcattggggttacaagggtaggaatgatggattctgcctgggagagggaactagtctgagaacataactattgaccagggtatttcaagtattcactatgtgtcaggctttaacactatacacacagcctcatctgatcctcagaggagtcccatagggtaggtacctacagcaaacaggcttcaggggggcccaggagaccaggggtccccatgatccctgcctcctggtattcataaccttgagtaaggataggacctacccctgaccaatggaatatggcaaaggtgacacacgtacgtgattccatgtatggatcacattatatgagactgtgatgtcccttgtcttcctggcccactccactcccaccccaagtgttggttccttggaaaaacactggggatggaggtggaattgctgtgaaaacaagactcagtcctccacagaagctgcccagggagttcttcagaagtggttatcctacctgccatttacactggatcaggactgtccagaaatcattttcacatctccccagaagaatggcatcatctcaatactaatcttcacttgaactagaagaatcatgcttgtggttttcaaaaggaaaaggttcctattcatggtgcatttagaagcagcccagggtgcttatagaacggacctgcttcttgctatgttcttgagcttctgaggcctcttgacaaagtcgagcaagtaagacgaccaggccaagtgggcactctgggccccatggccaaggatgggctggccaggtggccacgtggcctccggtggccttgtttctgtgggctttatctgatcctgagctcagatgctgatagtgcactggcttattttctaaggagagggagcttgatttgtgcaggatgcgccttcaccagatacctccaggggcaagagtccactgaggttacagcgccccccgccccccatgcctctaagctctaagctcagagaagggtccctgacacagagtcctgttaaaggaatggccacagggataggagagaccagggtcgtgcatgccagctcaggatctggggcaggatggttggcagggggtcgtggggagcaaaggaggggaatcacctgccagaaaattgggcaggggtgctcagggaggaggctgcggagggactgggaccagtggaagggaggtggaataggtcttaggagccaaattccttgcagaggcctggggtgaagcctgggcagctctatccccgggagccgcccttttgcctccagcagctcccggtctagccacagcccctccaggagacccaggccgggttcctaactccgctgctctttggcctcgtccctgcctagcccctgctgcgggttgcttttttcccccctcctcctcctccctcctccctcctccctcctcccccttcctcctcctccccctcctcccccgactggccccgcccccactgccggccccgcccccactgccggcccgggccccacccacgccggagctgctccatttaaggagattgcgcagctggaaagctacacgtgtgagcctagaggcgggtcccggttgcagacttgccatggcctccgaagcttctgtgcgtctaggggtgccccctggccgtctgtggatccagaggcctggcatctacgaagatgaggaggggagaacctgggtgactgtggtcgtgcggttcaatccctcgcgtagggaatgggccagggcctcccagggcagcagagtgagtcctgggcacgaggggaggctgtggggagggctgcgcactgacccctgcccgtgtgggaccgcggtgggggtcagagggggccgttctcacccgcactggaaaactcacttctgtgcaggtctaggagcgcagcaatgtccatgcccagccctggccccaggaacaccccccgtaaagggaccacaggcacaagcttatccacatgagataatgtggtcctgcgtggtgaagccgaggctaaggtagctcagggcttagtgccattcccagtgcctgctgggaaggcccacaaatggggcagctattgagctgggctttgtgggatgagtaggagttctccaggtctagaaaggaggcaggagtagtataagcaaaagcattgcagcctggaggcaccaggtgggccaacaggatgaacatgacattggtgtcagattactgatctgcaaaatgagaataatatacctctgtggcaagctagtcacagacatgctcacatacatggctcaccgcctgaatggcctggggaagcatttgactgataacagattctggaaattaattcaggaggcttgggtggagtcctagattctttacttttcaaaagctccccaggtgataatgataatgactcaggaaacggctgtagatgagggctttagatcacagccagtctttgagggatgaagtaaatacagtagcgtctctggtgtgggtggcggtggggaattgattccaggaccgactgtggatgctcaagtccctgatagaaaatgacctgggtagtaattacatataacctcagcgcatcctctactatatttgaaatcagattactaataacacctaatgctacacctacacatcacttcaagctctgcttttgggaactttgtggaatttctttttttccccaaatatttttaatctgaggttagtcgaattcatgggtgcagtatccatggaaatggggggctggctgtaccttagtgtaatgtggtaaaagcatatccggatatttaaaatgccatttagggctgggcgcggtggctcacgcctgtaatcccagcactttgggaggccgagatgggcttatcacgagatcaggagatcgagaccatcctagccaacatggggaaaccccgtctctactaaaaatacaaaaaattagccgggcgtggtggcggacgcctgtagtcccagctactcgggaggctgaggcaggagaatggcgtgaacccgggaggcgaagcttgtagtgagccgagatcgcaccactgcactccagcctgggtgacagagtgagactccgtcccaaaaaaaaaaaaaaaaaaaaatgccgtttaggtcttcgtaaacaattcactgcctgtttgtttgttttttgagaaagtcttgctctgttgcggctggagtgcactggtgtgatgttggctcactgcaacctccacctcccaggctcaagtgattctcatgcctcagcctcccgagtagcttggattacaggcgatttttttttacagttaattttttttgttattttcaggagagacaaaagtttaatcatgtgggccaggctggttttgaactcctgacctcaagtgatctgcccaccttggcctcccaaagtgctgggattacaggtgagccacctcgcccagccagttcactgacactttaaacaatataacacatttcctaaaaaaagttcaaataggttatttcaaaaaatgttggtagagaacatggaaaggcttttctgtacatacactaaataaagcatgcaaaaattgtggagcaaatattttaagtttttcaaaagcctgaaaaagtgttaatggagggcactgtaaaatggtgcagccactatggaaaacaggatgaggatttctcaaaaaaagaattacggcataatccagcaatgccacttctggatatatacccacaagactctgaagccggaacttaagcatgtattcatacatccatgttcacagcagtatcattcatactagccaaaaggtggtggcagcccccgtgtccattgatagatgaatgggtaaacaacacaaaccatgaagtattcacccttaaaagtcagacacacggatgaaacttggagccattatactaaatgaaatatgccagtcacggaaggacagattctcttgtatgaggtactcagagtggtctcattcataaagtggaatggtagctgccaggggctggagggagtcgaggatgggaagttaatgttagtaacaggtacggagtctcagtttgggaagataaaaagttctggaggtggatagtgccgacggttccacatgtcaatgcacttaatgccaccaaactgtactcttaaaaacagttggccgggcgcggtggctcacgcctgtaatcccagcactttggggggccgaggcgggcggatcacaaggtcaggagatcgagaccatcctggctaacacggtgaaaccccgtctctactaaaaatacaaaaaaattagccgggtgcggtggcgggcgtctgtagtcccagctactcggggggctgaggcaggagaatggcttgaacctgggaggcagagcttgcagtgagctgagatccagccactgcactccagcctgggcgacagagcaagactccgtctcaaacaaaacaaagcaaaacaaaaaaaacagttaagattttttttttttttaaatgattcagtggaaatagaatggattcttcaaataacttagccacgggtgggataagggacctacttagtaagtattttttccccttctttcttaaaaatagatcgatgtcttagggtgggaattaggcttcctgggcgacacatctaatgcaaagatcagccacctttttctgtaaaggatctgatggtaaacattttccacttggagagctatgctcttgcagctactcagctctgctattgcagtgcaaaagcagctaaaggcaacggtaaaggaatgagggaaggagccttagtttatttacaataaagctttatttgcaaaagcagatgcaagccagacttagtttgctgatctctgatctacagtcagaatacacagagaaggagagattttgccgtataatttaaaatacttctctttgcaaaagcagtccataaaaaaagtgaggacaacaaactgagaaaaattattcacaacatgtctgattgatagagcactaatattcttaattcaaaaagacattttatcacaaaagaagacaaatacttagaaaattgtgcaaaagactttccattttgttgcataacgtaggaagctttggttttacttttcctatcatctttctaacttccagtaccagcctaattttgttatttttattattatgtatttattttgagacagagtcttgctctgtctcccaggctggagtgcagtgacctgacgatagcttacaacagcctctacctcccaggttcaagaaatcttctcaccttagcttcccgagtagctgggactgtaggcacatgccaccatggccagctaattttttattttttgtagagacagagtctcattatgttgccgaggctggtcttgaactcgtggcttcaagcagtcctcctgccttggcctcccaaagtgttgggattacaggcataagccactgctcccagccttatttcgtatatttactataagtgtgtgaaggtcatgatcagaactgccatatattttggcgggaaaatctatcaccctcagatccaggagtccatggatatcttgtttttaaaacgaagatttaaaaaattacggcaatggcagagatggagccccaagagaatactcagctttaacccaaggtgttgacaggttggaaacagtggctaaatttggggattgcagtggggcgaggcagggtgcaggtcagagggggccagaagggccccagccatcctagatggagccacaagtaccagtgccaaggctcttggtctggaattctgaaaacatttacctctgaccctggcagcccactggccattgcttgtgtgcagcccagttggcagggaaccctatccatgatttgccgcctcttttctggtcccttcagtatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccaggcaagtgtgtggtggttctaggtgaaagcgacaggtggcccctggtgactgccgtggccctctctcttctgtgcccctggcccccttggggttcttgtctgtcctcttcctgttgctcaagtcttccttcaaggaggcctgagtgtgtgtgggtggatcggtgcatgagttcccatgtgggatgcaggcagagtgggtgagggagggagggttgccttccctgggctagggaaatccataagctggagttcccacctgcctcacccctgcctgctgctgctgccagcctgcatgggcggccgttaaggccaactggaagagcatctcccagaggttctgatggctgctccctctcctgcagattgactctatggagcagctggtcctaacatatcagccggagaggaaagactgacactgggagtggctggtatgttggggccctgtgcgtctcggtgtagggatcagacgaaagtgagaagacctctcctcttttcagaaagacggcgtggcctcctcctccctgctgtttgctgagatttttcttacatagccacctgtcacctctgttccccagccccttggatgtgatggtacacagtgggtgggcccccataataagttcctaaagcatgggatctcatcgaataagactcatcatttaatccttgtgagaattttgtgaggtgtacgtgttaatgtcccatttcacgacgaaaagacaagactctggggatgggaatgacttcctcgagaccatacagccaggaaatagcggtgaatctagtgatctcgggtccctagatttaaccatggcactgaggtgccgtgtgacggtggccttggaggacccagcactgacccatagagggctcctctcagatgggcagcagcttggagcaggccaggcagggcctggtccattggaggggctggcactggacttgcctttgaccccagcagcttggatggggtgccgggctcccccatagttcactgactgtctcctttggtcttctcgcaggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccagagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaattggagcctctctttgacctctttctagcatagaaatggcagcttctggtaccgaaatgttaaggtaacattttaatgatccatttcatatttttccacactgggaaggaaattgtgattggtccattcagcagcaggacgtcggcgggagttaaggaaggggaggagactcgtgcgggctctgggtgaagccctgctgtgaaagggcaggaaagcccgtagtggtcacaggagaaccgggagcaagggagagctcccaaagcgagacaatgcaacagcatgtcattgcaggagatgcagaatgcaggtgcaagggaggaagggcccatgtgtgggagagtatgacatgacagaggagcagagtccttgagcagggagggatgaggcagggggccaaggcactgagcagtgccaccattgtgaccaggaagaagaggacgatacagtgcaggtcagggtgaccatgcagtggtggcaaggagaagagattccctccctcatgtcgctcacaagaaaaaaatcacccatgggctgaaatcccaaccttacaaaatgaatctgtaaaagcattcatagaaagtttggggaaatatgttcatgaacgtggggtacagaaaaacccaagtaaatcacaggtgtaagcaaaagacagtgtaagacaaactttttcaagtgaagcatttctgtatgacaaaatattaggaagcatcaatcacaatttagcatggtatataaggcacgccagtgtttgcctggagcaggcttgctcaagcccagtggtgttgcggggaggggctgtcctgtgccttgtagaatgtttagcaacatccttggccgccacccactggatgccagaagcatctcctgaccgcagcttgtgagaaccaaaaatgccaaatgcctcctgagggggcaaaattgccccgggctgagaatcactaccctagataaacacttgcacatgtggtatacacaagaggtatgaagagagagcactgtggtaagagttcagattccacagtgttggcatggttaaagggaggccccgtgagcaggagctgggtgagcactgcaggctggcattgtaccttctgctgagaagcttatgttgatctggcagcctggtctttgaggaaccctcttcccctagcctgccttccctcccactggcctgagtcgggggtatgcaggagagggtgcgtcatgcagcatgcatcccagtcaacataaggatttcatgatgacacagggtctcgctctgtcatccacgctggagtgcagtggcgcgatcgcggctcactgcaagctccgcctcctgggttcacgccattctcctgcctcagcctcccgagtagctgagactacaggtgcccgccaccactcccggctaatttttttgtaattttagtagagacggggtttcaccgtgttagccaggatggtctcaatctcctgacctcgtgatccacccaccttggcctctcaaagtactgggattacaggtgtgagccaccacgcctggcctaggaaaggtttttattgttaaatgggaaatttacaaagccagagagggaaggagacattgttttcctacccacagaaatgtgcctcccagaaaggagccggctctgctggatacccagtgggtgtctgcatccaggagagagaattcagtcccttagctgccttcttatagtgcaggctgggtgcaagtgcaatgatgaaggctgcacagacttcctgggtaccaggtgggtggggtctgggaatgccagccgtccagtgcctggacacttggggtctatatgtaactgtaatagatttgttgtcaaatgcgcacatatcccaacactgggtcgcagcagagaaagcagttgaatggtagggtcaccgaaggaggggataggaggaaacctcaaatccatctcccagagagtaggactgggccagtggagattgttgattgattgaaaagtgcagga

SEQ ID NO: 13830 - DNA, 8150 bp, Human
atccatttgcttatcctcagggaaatcagactaacaaagacttggaaaggaacataaaattctaaagctaggcttatggcctttataacccttagatggggcagataacatgccacggaggctcagagacagctctgagactatgcaatagctactgtttcccctcttgtggaatgttcacttaaaaaagctcaagggctctataagttgcccaatgaactccacagacatccttaattcattttcatttattggaaccctctctcaaataattttctaaatctcacgcaataatgatgtatattcttgctcaatattaagaagccctcatgcaaaactgaagaaataaattgttcttacaaaagaaggaaaaaggaattatattctcagaacattctgcttacccagacacacagatctgattcttgctccattgtttgtggcattctggatcctagggccattgatgaggctgggtcagtggccacactggctcctgggtaccccttccctggccacaaaagtccatcccagcagcactatttaaactggacttatttctcacttcacagctctggcctgggctgagacctccccaacagagcttattagcgagcttgtcatcttgctctgtggctatctaggtctggagtcaagagccattcacaggaaaatcagcatgaaacctttaagtttgcatattaaatattaacaccactaagggctacagtggaaaagaggtttgctgagctcaagggccctcactccacccccaacttcccttggcttttctcttctatgttgtgttcctggtaaatcccattatgtctcgactaccttaggccctctcagccccttcttgggaattaggctctctggataggcaaagaggcagatacccagctgccaggtgaatcagatgtcctcatcagatctcttaatttccactttggtgatatttcaaaggatcacaaattatgttcttagtgcctggtcagagaactgggaaagagctggaagatgagacaccaaactccatcccatggtgatgtttgaaccaggctggagctggtttcacatgtttttcattgtgcatgactttcttaattgccttagtgggaatgcgttactgcaaaataaagtgaaattgttttccttattgcttgtaatttacagaggggtggttttgatcatataaaccaggcacttttcaaatccattgatcttagggtggaaggagggatttctttttaagtattcatttcgaactatgctttcactagtaaactcaaagcccaagggcaaaaacccatgattctccattttgtaatagctattagatgtccacagcacatcagacctgtggaaaacgcatgctttgtgtatggaagagggagagggagcgtcaggagttgtcctttgccaaaaaacgtactctgacactcaaaggcacaggctggtggagatccagggaacccgggaaagcccaggcctaactcaggcccgcgcgggtctcttctgatcccataagatgaggagtgggtcctggctctgggcatcctggtgtcgactgtgagttcccagcagaggcccagagtcccggtccggcagccgagggaagcgggggggtcttccagaagaagaaagggccaaggtcaccccggtgcctctccagcagcagcagagggcggcggtcggtgtcgctgctggccggggcctcgaggaaggcgcgggccagctggggccgggtctgcgttcccaggagctgccaccgttccagggagcaagtcaggccgggacgtagcgcctgcgcgggaccctcacttgccaccaagacccccacaaaccccgccccatcctgccttacgccccgccccaaggtcgttctcccgacccggggtcccgccccaaggccgtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgaggtacagccagctttggagcggatggcgaggcagcaggggcagcccctgggagcttgggatgccctaggaagggcgaggactcaaggagcactcactatggggcagggaggatccccacagatgaagccactttgagccgggctctggaggatgaataggagttctccaggcagggaagaagggtgggaaaaccgcaaaggaatgtcggtcaaaggggtggacccagtgcctgtggagtgtgactataatgttgactacagcaggcattttctgggcttcggggtcctaatccttaaaaatgggtatctctaagtgactcatccatatggccgattatcggaatcatctcaggtgggtcccagaaatctgtatttttaaaaagaaccctcaacagtttagggtcaaccaggcatagcaaacactggcctagagtgtgaagtattttccactacctctgggctttatttagaaaacaaatttaacaagtgatgtcgtagtataagcgccggtattgaatcaatattgacttttttaatgtgtgatgccttaagatgggtccttaatccatgttaagtttttgttaaagaaatagataagtcttttacaagtatttggatttactcaatgaaaaagagtcaaaaaatgttcaaactctctccaaacatacactgaagaaagcataaaaattaaaaaatatattagaacacgtatgtccagtagcaatcaaaaattattgagtgttgactgtgtctctacagatgggaaactgaggcacaaaaatgtacatttgtccgaggtaagattgctagtaggtaatggggttggaattctaggctcttaaccaccacaaaatctgcatttttattggcatttcaattttttaaatatgtttttactttaaaaatcaagttaaatacttacttttttaaaatcaaaatttgaagaaataatttgaagattcagtggatttctttttttaaatctctgagaaatctcttcttcaacgtgacaccaaaaccacgaaccagacagtttttcataaaatcatgatacatgctccacaaaaaataacccactagcaaactgtgggacagattttgcctcacatcattgaaaaggccagtattctttttctctctttctttctttgttgttttttttttttcctgtagatacagggtctcgctctgtgacccaggctggtcttaaactcctggcctcaagcgatcctcctgcctctgccttccaaagcactggaattacaagtgtgagccgctgcaacccgccagaaaaaagtgtgcctttcatggccctgtctgggtggctagacacgtgtgtgtgctggtggtcctggcccagccagagtccctgagaggagcatgcatggcctaaggaagtgagcttcagggaacagtgatgaccatcatttcacactcggacccctgcccagatgggtggatggctggcaggagggattccggttttctgcgcctggagaagccctggcaagcggaacctgaaagtatgccctgtccttttcttctcctcagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaaggtgagtgtctttctcccagaggtccatcgggtgatcttgggtttgccctcctccatgtctggccttagtggtttatcttccctccatcccagtcccaaaagcattaaaaaatgggggaaatgtacaagtgcagatttctaaaggactttaccagagagaagatagatcctctgaggtctctaacagaaccctacctccacttcctcccagccaccagctagccgcaggaagacatctctggtgggcagtcacaggctgaaggctggtgggaggaggggcagtctccaagagcccctgaaatcctcacacctgggttcctacctgctgtttccagctaggggaaggcgcaggagtgaggaatggagggagtggagggctctggccgatcaatgccttctctctctctctgcctctcagattgacggcgtggaggacatgcttctcgagctgctgccagatgactgatgtatggtgagctccactggagcctgacccctcttagtccacagtggctgtatcagaaagaaagaccaccccttctccatgaaggcagtgctaacccctccccgactgctgccatctgagggtccctagggatgggagaggcttcctggaggcactcatgtctcccttaccacttcgggagccaagggctttgtaggcagccccctttatcgcagctgctcatatctataaagtacttcacaagtttcagctggcactttcatttaccattgcttttttttttttttgagatgagtctggctctgtggcccaggctagagtgtagtggtgcaatctcagctcactgcaagctctgcctcccgggttcacaccattctcctgcctcagccctcggagtagctgggactacaggcgcccgccaccacacctggctaattttttttttttttttttttttttagtagagacggggtttcaccgtgttagccaggatggtctcgatctcctgacctcatgatctgcccgcctcggcctcccaaagtgctgggattacaggcatgagccaccacgtccggccttaccattgctttattaaataagcactggtgcttgattatatcagctgagccagatattagatacgctattgagttttgaggaaataagagtacaaaactcagaaatgagttgaagtatagtgacatcttcagattacagacccaggtgtcagaatttgccttggctcagaaggcctctgggggccatccctgaccactaggcttcccacttagacctgctccagcagcaccacccctcgccactgcctggtcctttccttcacccttgattctgtcttcttttgtccttctccaggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaacttcgtgcggaatcagcttctatccttgacttagattctggtggagagaagtgagaataggcagcccccaaataaaaaatattcatggatttatttattttcctttggagataagggactacaattttttccccgtgtaatccaatgcttaaaaccccagtgttcttggaggcatacgttgagaaccattggagtaagcaacctcaaaaatgttgttggcaatgcccggtattccagagccccccctgcctccatctggtcctgccctccttaccctcctcattcccatgtgccctcggccccagccagctctgcctcctccttacctgggcattcaccaggctctgtccttgcacagataacttctatcctctctgctcacaatcccagcagaagcccctcctgcctgaagctgtccctgaccactcaggccccaagcagactcccttccccacctcccatgacctgcagtcacagcagatcccaccctgtgccctgtcctcttgctcccttctcaagaccctgctgcccctcctgtacctctatagacagtagctggacctcagatattaccaggggatgccttccagagaagggaatccatcctgtgtcgaatcctggccttcccacttccctgtgtctctagtccacagctttcttgtcacagagatgaacttagagggttgttctgaggattcagcgggatatataactgaagggctttaagagaattgtataagaaaaacactacttctcccgctttacagtctctgaacccaggtttcttaaccagcactagacagagaagaagcactgacgtccgacgtgccagggtttgtatcttctgttgtaacccggtcaccctgcacagaccatggcagcaggggagtttggtctgtgggagcaattactgtacaggtgcctctcagcagggctggatcgtggaaagtcagagcagggggaccatgggagatcaggcagctgcctcattttacgaataggaacgcggggacccagaaagaggaaagcttttgtgcgagattcttttgttgaccaaatatttgaccatcaccatgaacggtgccaggaactgggactcagcagggacaaggtgaaggccccattctcatgcagccttagttctggaaaaagataaaaagaaggtgcaaaatcccagaagaaaatagaatagggtaatggtagggagttcgattggctggcaaggaaattcctgtctgtggatatggcatttaagattgggccttgaaaaagagggagctagattcttaggaagaggggatggcaagtgctgtgcagatttaatttgctgtggaaattaaaaacatagcaaaaggattacttcttacaaaaagaaatgctgttttgtaagaataaatagccctaataaattaactaaatgcaatgcagaatctcagttttccacaagactgactctagggttttggctggaaacacaaagttgttttgccaatgtattctaaatacctcatatttttccctccatatatatatatatatatatatatatatatttctctccccccctctttttttttttttgaggtggagtttcactgttgttgcccaggctggagtgcaatggcggtcttagctcactgcaacctccacctcccaggttcaagcgattctcttgcctccgcctcccaagtagctgggactacaggcatccactaccatgcccggctaattttttgtatttttagtagagacagggtttcaccatgttggtcaggctggtcttgaactcctgacctcaggtgatctgcccgccttggcctcacaaagtgctgggattacaggcgtgagccaccgtgcccagcctccctctacatattttattacatatatatttatattttctttaatttctttcaataacatgttgcagttttccgagtataggttttgcatttcttttgttaaattgattcctaagtttactctttttttattatgataaaaaaaatctaattagcctggcgtggtggtatatacctgtagtgtcagctacttgtggggctgaggcaggaggatcgcttgagcctgggaagt

SEQ ID NO: 13831 - DNA, 35059 bp, Human
tatcgagataccctgaggtgtacaaaggatgagtcaaggtagcggagagagagttgaagagtgacagctgagaaacagagataggacatgtccaagaagtgccaggataacccaacaacacaggctgattgaggaaactgccagagattagacaaagtagactgaagagggaaagcaatgtttgttggagattttgctttagtttttgataaatatttcttagtcataccaattgttttaaatataattacgcccccaaaccaaatttctactcttattctggcaacagaataaaaatcaatatcaatgtttgatcattttcaaagaaactcagttcctatcttggttgaaatgcagtgacatccatatgacaattgagctcttcatgtggcactaatataactaagccctgagcacatcccttgcacttctatttagtgaagtcttttaaaaagtattttctttacagttgttaagtggaattactaaaaattacaatcagcagtattttctactcttttagcttattttttaaaatatttatctccatgcttttcaatattacacctatattgcttcttcttgatttttccattttaagatactgacttcctactatggaagttaaagattaagctctatttcctcctcctccatccccatcaagcatagtacccttctccaaagcccatccttctaaatgtaattctttttttgagggggaggggggatcaatactcagtttttttttgttttgttttttttttttttttgagacggagtcttgctctgtcacccaggctggagtgcagtggtgcgatctcggctcaaggcaagctccgcctcccgggttcacgccattcttctgcctcagcctcccaagcagctgggactacaggcgcccaccaccacgctcggctaatttttttgtatttttagtagagacgggttttcaccgtgttagccaggatggtctcgatctcctgacctcgtgatccgcccaccttggcctcccaaagtgctgggattacaggcgtgagccaccgcgcccggccaatactcagtatttatgtaacaataaatacaattactttcctttcttgcacaagattttgttttccctagaattaatagctgcataattcttacagccgcttagttttctgtgtacctgtcatgagttaaactccaaactctcggtcaaatctcctcttgattcaacgccagctggaattttgtcaatcccatccttctgaagcagtgtctcccaaagatttctgaccgaatctaatctagatgcgttgccgtctatgcctatacacagctattgttcccggagctctttcagtatcatcttgggatcttactattttctgtgtttgttatttattgtatttcctgcatttcataatttcctccttcttggcttattccctcattttggtggatcagatctacaggatcttcctggaggtactgagaaaggtaagataggtactattttttgtgtgtagtgatttagcacatctgaaactctattctattcacacactagattggtagttggatgagtattgaagactaaatcggaagtaattttccctcagagttttgaagacagtgccgtatggcttcctagattctaactgagcaatctgaagccactctgattctatagtctgtataacctggaagggtgtgggatctctttttcctcgatgttcagaaaattcacaatgatatgccttgacgtggatgctttaatatttgtgctgggtgcttagtaggatctttcagtgtggaaactcatctccttaacatctggacaactttctgaagtcatttattatttcctgcctttcattttttttttggtttggaactcctgaactggtcctgtgatgtgactgcagccgccaggcgcgtgcgcagtgtacactgcgtgcgcatacgcgagcccgttgcgcctgcgcgcggtgccgccgtcgcccctcttttcgcggcgttctccacctgcgcgggcctgaatggccttcaggagcacagtcggcctgaggagttgatggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaaggtcagtgcccggaccgcccctcttccggggtggctctcccgccccggttcctccctgcgcggcgcggggagggcccactgggtttcctttcgcgccttttctcctcgggtttgaaccgtggtttcaggttggagagcgagtcagagccattgagcgaaaaaccggcgttcattgggccccaacttcctcgcgtcactgccaactcccacccccgccaaaaaacaaacagataaatggtggcttggggaaacccggacgtggctgccaaggaaacgggcgactccgagggctgggaaagctcagcttggtgcacattcgctgccaatctaggttattggtgaagcggtgacgccaccctcctggtgtgaggataacaataactgtagcaaacagtcgctgagcgcttacccgcagtatttccaagtgcggtaactgagacaccgaggcatacgaaagctaagaaaatttgctggagttcatggtgttcacaaagcctcaaagcaagagcataacactgtgcctggcacatggggaacattcagtaaatgtcaacttcttttgtttttgatgaaattaccatagaccctagcgtaatgtttgacattgtaatatttatttccctcacacagcccctggcacgttaatttttttttttttttgagacgaagtgtctgtcttgttgcccaggctggagcgcaatggcacgatctcggctcactgcaacctcggcctcccaaagtgctgggattacaggcgtgagccaccgcgcccagccgtggttcattctttttaaagaaaaatttcctttcctttataaataaaaatcagaaggggtacaaatagttgtttttatcaggagccagtgggtcctgccttaaaaattaacgtgcagggccgggcaaggtggctcacgcctgtaatcccagcactttggaaggccgaggagggtggatcacctgagatcagaagttcaagaccaggctggtcaacatggtgaaaccccgtctctactaaatatacaaaaattagccgggcgtggtggcgggcacctgtaatcccagctactagaggggctgaggcaggaaaatcgcttgaacccgagaggcggaagttgcagtgagctgagatcgtgccactgcactctagcctgggcgacagagcaagacaatgtttctttaaaaaaaaaatagcaataattagtaggttttaaaatacttatgtgtgtgtgtgtgtgtgtgtgtgtgtgttttgttttgtttttttttgagacggagttttgctcttgttgcccaggctggagtgcactagcgcaatctcggctctccgcaacctccacctcctggattcaagcgattctcctgcctccaagcgattctcctgcctcagcctcctgaatagctggaattacaggcatgcgccaccatgcccagctaattttgtatttttagtagagacgggggcttctccgtgttggtcaggctggtctcgaactcccgacctcgggtgatctgcccgcctcggcctcccaaagtgctgggattacaggcgtgagccaccgtgcctggccgcttttcttcatttttattgttgttggttacattcactcagcacttttcacatgtggtaaatcttgctcattgttcttcagatacatttctgtaactgagccattggtttcagattcatgtgcaacattcaatattttcacttcaattgaaattttttatctttccaacataatctgtcaatacgcactgcctttgcacttatcagatataagaaatatgtatgttaaactaaggacaaatgtagcaaacatgtcatcagccactatttaccaagcttcagtcatccaagtgactcttggccatttttgccatgtctgaattcaactgtaatatttattgtaacatttacatttaaatcagtttattttttaaaagcctctttctaagcgttaatgttttttaaattgtagggtgtttggttgtttttttttttttttttttttggagacagaggctcgctctgttgcccaggctggagtgcaatggtatgatctcggctcactgcaacctctgcctcccaggttcaagcaattctcctgcttcagcctcccaagtagctgggattacagatgcacaccaccaagcccagctaatttttgtatttttagtagagatggggtttcaccatcttggccaggctggtcttgaacctctgacctcaggtgatccacccaccttggtgaaattgtaggttttaatttctagttacagttattactattttttaatactgattaaacacgtaagtaaaaaagtgaaaaatgtttgacctttattctacctctcacaaattactcctaatatttatactatactttgggaaacactgccacaggctaggtgataaggacattgccacaggtgatgccagtcagaattggccatttttatttcaatgcctagctttcaggtgtttaagtaaaggccttttgcatttcttttaacaacactctaaaagcgctttacatggtaatttaaataaaagcattttcaaagagggaacattgtaattattctggcgttttttgtgttaatatgaaaggatgtgtctgaaattgatttgagagaaatccatattataagcaaactatagattgttagcctgccattctttaaagcaagttttcagagctcttattctgcatatttagctaatggtacaatattcatttattttaaaattatttttcttttagggtgttactatcgttaaaccaatagtttacggtaatgttgctcggtattttggaaagaaaagagaagaagatgggcacactcatcagtggacagtatatgtgaaaccatatagaaatgaggtaggcactcgttttttctgtaactgttttacttaaagttgtctgtaatttgttttgcttaaagacaacctgtagttttttttttttttttttttttttttttgagatggagtcttgctctgtcgcccaggctggagtgcagtggcgcgatctcagctcactgcaagctccgcctcccgggttcacgccattctcctgcctcagcctcccgagtagctgggactacaggcgcccgccaccacgcccggctaattttttgtattttttggtagagacggggtttcaccatgttagccaggatggtctcaatctcctgacctcgtgatccacccgcctcggcctcccaaagtgctgggattacaggcgtgagccaccgcgcccggccgacaacctgtaattttttatagtaactttctgattataaaattggtccgttgtaggaatgttgtcaaaaagtttttgaaaaaatagagaactgtcatcttcatatgatactagaaatcaattttccaaaaatgtttcctaattaaaattaagataacaagaactatttatgctataaatacagtacaagtacatcttcctaacatcatatctaagttaacatagtatttaatcaggagtttcaggaataagcagctaatccttaaagtaataatgtggtaataagaatgtgaaagacagctctgctgtgtcatctgattgctagtaattttgtttcactgctgaatcttcaatgcctggaacatagccagtacatagtaggcatttaacagatatttattgagtgagtaaattattcctctatttaaaacccttcagagtctacccaaaaacttgcatgtgaatattgataccagtgttattcataatagccaaaaagtggaaacaattcatttgtctatcaactgatgaatggataaataaaatgtgatatatccatacaattgaatattatcaagcaataaaaagtaaagtactgataaagtaaagatgctactacatggatgaaacttgaaagcattatgctaagtaaaagaagccaaatataaaaaaggccaaatattatatgcttttatttatatgaaatgtccagaaggggcaaatccatagacaaagaaaatagataagtggttgctagtgggtgggggagaaagggtattgaggtaagtgctaatggatatggctttcttttgtgtgataaaaatgttctaaaattgtagtgattcttatgagactctgtaaatataactaaaaaccattggctaggcaaaatggctcattcctgtaatctcagcactatgggaggcccaagcgggaggatcgcttgagcccaggagtttgagaccagactggcaacatagtaagactccatctctacagaaaaaaaaggtatcattatagtaagattccagtttattttttaaataataaagttagatatgaatgtagatataagtaatttaaaaattcctaaaagtaaattaaaaagttaataaacattactattgaatgtgacttattgctttgcatttttttattcttctataatgaattatatattttaaaagccacttttgccaacagaaacccttttatttgccataactaatgaatatgcttctgtacttttaaaataaagaaaatgaggagtttttgtattcaacaatcttagattgctttaaattagttgtccttagctttatgtaatataattttttgtttgtttgagatggagtttctctcttattgccctggctggaatgcaatggtgtgatctcagcttattgcaacctccgcctcctgggtttaagtgattctcctgcctcagcctcctgagtagctgggattacaggcgccgccaccatgcttggctaattttttgtatttttagtagagatggagtttccccatgttggccaggctggtctcaaactcctgacctcaggtgatccacctgccttggcctcccaaagtgctgggattacaggcgtgagccaccgtgcccggcgtatgtgatataattttgttctttgaaattgactatagatttgccttatatttctgtaatagtaccagatatgtactgttgttttaatggaaaaaaatcaaaattgatttagaatattatctatagaggtgtattaaaacaagatttgccaaaaaaaaagttaatttgggacgtgtatttctatacattacaaatcataaaagaattcaacacaggcttcctttttgtttttttaaaaaaagcaaaataggccaggtgcggtggctcacgcctgtaattccagcacactggtagggcgaggcaggtggatcacctgaggtcaagagttcgagaccagcctggccaacatggtgaaaccccgtctctactaaaaatacaaaaaattagccaggcatggtggcagccgcctgtaatcccagctactcaggaggctgaggcaggagaattgcttgaacctgggtcagggaagttgcagtgagccaagatcatgccactgcactccagcctgggcaacaaagcgagactccatctcaggaaaaaaaaaaaaaaagcaaaataacttcccaggtgtagttcatgttttttagaaaattagattccataaaatttgaagggaagtatgttttttataaaactaagtatatacgctcagtgtattttttttcctagttttcatttgtagatcataaaactaactaattccttatattttaggatatgtcagcatatgtgaagaaaatccagtttaaattacatgaaagctatggcaatcctttaagaggtacaatatagtcttttgattcacaatatccaaagttaaaaatggctaggaaactaaaccgataatttactatttttttctgtctttagttgttactaaacctccatatgaaattactgaaacaggatggggtgaattcgaaataatcatcaaaatatttttcattgaccctaatgaaagacctgtgagtagcattaatctttgtaaatataaaatagatttcttagtaaatgtgaacatgtaataatacttaatgaatagtgttcattcagatgtgttttatgtaaatttatggcacagtgtatcttgccatgagttaagtttttcatttttaaatgtagcgcctttcaaaatccttttttttttcaagtatggaaaaaaacatataatatgaacatgtattggaaagaaaccatggaaatcagatgactactgcagcaaaaaaacttaaaactattattatcattcggttattagtaataaataagttgagcccatatgctgtgtaaaatagtttttatagtttttggtagttaaaccctaagaaacagtgtttttgcttttttaagctgtcatcagtactagcgcttcattttatatcttatttatgagtctttatttttatagccactggctttttcatcttttgatctcttcttatcagattgttgcttgataatgtaaaaaaaaaatccctccaggcttttgctttgatccttcagcaactttgttaggttgtgataccctcattttagagatcaggataccaaggctcagaggtcaagtcactgctcaaaaacactcagttaattatggtagagctagtttttgaacccagatatttgcattcatacctttttctagtattttttcttttgagtaaaaccactaggcctttttttttcttaagcctgtagggtcaaaactcagtaatggctctcacattccacatatgtggctggggtttaactccagtttcaaggctttcacattcatcaccattttatcttgttagaatcacatcagtcttttagcaccaaacatttacattttaattatcagattatattttttaaactgtgtatgtatttttaaaggagctgaatatcacctggaccagtatttcagcaaaccggttcctaactggctgcatcagaaacacctgaggtgcttgcttatttatttattaatttttgtgaggtgctttttaaaaattcaagctcctaggcctcaccttttggagagtctgattcagtaggtttggaatggggccagcaccccaggtgattttgatgcacaatgagaattgggacccaatgacgtagacttactcttttcttcctacgtaggaatttatttaggcaatatctcaaatgagaatctagtttgggcttgcatatctccaatatggagaattaacttatgtcactaagtaaaacatcctattcaaggttggggtagttttagttttaagaaagctgtacttcgttacgcttccctgaactttttactgattactattcctaccttagttttcttttctcatgagtaagcatccatagctcatttaaacattttttgtgttttcatgtgatgaagtttttagatctcctaccatctgtgttgcccttcaggaaaacacactcatgttatattttgtttggcaataattttttttttcttttgagacagagttacactctgctgcccaggctggagtacagtggcataaacacaactcactgcagcctccacctcctggcctcaaacagtcctctgcctcagcctccccagtagatgggaccacagatgcatgccaccatgctgagttaattttttattttctgtagagataggggctcgccatgttgcccaggctgatctcaaactcctgggctcaagcattcctctcgccttgccctcccaaggtgctgggattacaggcatgagccaccatgaccggtcaagaaattattaaatattatatctgctatttgtaagatattgtttaagggattgagaaggatacaaaaatgagacactgaccttaatgagaatagtttattagggaaaagagagcatagaatttagcagatgttgagagggagagagaagcagctcatatgttactagagtagaagctctttttaactttgtaagattgctgggttttcatttttattttgagaatatgctgccttacctccctgtctcctcatctgttaccccttatccccagttggaaaataaatctatgaaagaaatcattgtaccctgtaacctcattatgagacagctcttgaagtcactcttagaaaggtatataacctattgcactgctatagtgattaatctgtttaatagattcccatatagatttacataggcctgaattttattctctaaaaaatattatagggttttttagtattattaaactattgtactttttcaatagttagctcttacagaaaatgtccagtgaaggtttatttaaaatatctaagaaagacaagttggttggaagacaacttgtgatttacttctgctacccagtaacctattatacagatcaagccactataaaaagaatggttgtttctaaaagcaaaatgtcaaattgagttttcattcctagaaatagggatttctaggcaagtataggcagtttcattgttctaagaattttcaaacaccactcaaaattacagacatctgtcttgaaatgtttttattgcctatatccgcatgaatgcctctggaagtctgaataataaatttagggaaggacagttttacaatgtaattgtaagaatttcttaattgtaaaagtcagttgtgcacatggttttaagagaagatttttgaaataagtgtaagtcttctgtgttagttttctggtaccataaactgggtggattaaaacaacagaaatttattcccacagatctgaaggctagaagtctgaaatcaaggtgttggccatgttttttccaaagcctttaggggagcatctttccttgcctcttccagccccagatgttccttggcttttggcaacatatctctaatatcttcctccattgtcacatggccttatctttctccctggtctctgtgtcttcttctcttagaaggacaccagtcatattggattgtggtccaccctaatgacttcattgtaattacacctgcaaagaccctgtttccaaataatgtcacatccacaggtgctgagaattagggcttcgtatcttttgcctgcatttatagtcccagttacttgggaggctgaggcaggagtatcatttgagatcaggaattcaagaccagcctgggcaacatagtaaaaccccatctcaaacaaaatataccttttgcagggaggtcacaattcagcccataacatctttatcccatctttgacctcttttccaagaaaactgctttttaacagttacctgttctcaattcctctagaaattactcactcctgtgcatctcatatatttaaatccctaatactggatttctcagcttcagatagtatctttcagtgcctaatgattgattataggtgatcctttttcgtcctctttccaagtttctttttttcattttgccaaaggaattttttcagaaaggatgcctgagaaataaactttcagagatattgcccatctgaaatgtccttattttttcttcatagttcattgttggggagaaaaattctaggcactaaaggtagatatgctttcttgtctatgaatggagagagaagagaaagtcaagaggcctagctaccccatagcattcttgactttgatacttgccagttctgagcttggagcactgtagggctcctgggagctctggctcacacctcttaggcagttttcttaagttttcaggttgtggtttttctctggtgtcattgtttattatccttcttggtagactcatctgctttctgtctgttccagaaatttgttaaattatttgctttaaataatttgatatgtaattcatgctctcttattttgctgttattttagtagaattctgtgcatttccctcctcccctttctacattcttagtgcatcatcttgagcctggaagatgtcctttaagtaggatatttccacttgctgagccatgtccagggaaatctgacattctgttaattgagctagattgtctttagggggagttgatggtgcttgtttaaattcagttgcaaggaattttatattttctgactttttcagtgtacccttccttgctccctatttcatgacttttttgaagagtaccattctcttacaattatgctagctaactttttagaaaattatttggggtctggttttcagaacttcaacatgaagtctgatgttttccgaactagattttattttgctgaaataatcacacattgtgctacaaagcttttcctttgatgtcttactatacctgtttttaggtatttgaagacatgttgctcttgccaaagtgaattattactgaccaactttttatttatttattatgtcatttatgtaataatcttatagatccccaaagaaattatcttgccctcactgaactttttcattccccacagtaaatttgtaaactctaatcttcaaagcagtcacaattaatccacttgtgtaagtaaaagaattcatgttttagtgatttctcagtttaatttctatagctttatcttgtgttatttttagtttcctctctagagattcttgaacagattcttaattaccctctaaagagtattcatgttaggtagatatgaatggatctaataggaaaataaaggtacagaaaatttgggtgatttgctgcaataagttgcagttgaaacaagatcatgaatttgacatgtatatacttattccagtctctatttcagttaaaaaaatgccagtatcttatgatgataaaaaccattgcacagatttgacatctgtttctatttcacaggtaaccctgtatcatttgctaaagctgtttcaatcagacaccaatgcaatgctggggaaaaagacagtggtttcagagttctatgatgaaatggtaagaagattttataatgatagttttaaaagcatttgaagttggagaactttgaagttattgggtttttgttcattttatcccattagatatttcaagacccaacagcaatgatgcaacaattattgacaacatctcgtcagctaacattaggagcctataagcatgaaacagaatgtaagtgccatgcattcataattctgaaaaataacgtattctgtaatagtgaaagggttgtatgattcgtgccttttacactttaaaaaaatgaaataggtaagttttttaggtgttaaaaaacacagtttgtattacagtggaacatgtaaaaaggatgttttaaattgttcccaagtaggcctgctttcaagaagggtgaaagacagcctcttacattcgctgaagtactgtttgtctgttttattccctaattacatttaagtatagttttttattagtcttgcttagcctatcattttctgtttactagtctttgctaacaaaatctgtgtgaagaaccttgcaaaccataattatacttttatatactgtgaactagtttatcttatatttttgctgatgtcattttacatagtttcagattaatgctcaagtgttgactacctgaatgccacattgataatcggtcatgttgtattttctctctaagctgacatggtctcagaattctgtacgcattaatctgtgcatctattctcagtcatttgcaattggcatttaatatgaaatctatttgacatccctgtgttaacactgatgttactgttcagtcatttctttgattattcattcattacaatatatagtgagtaccagttaatgccaaccattgttctaggtgctagctgctgaggttagagcagtgcctgaatcagacaaaaagccctatcgtcatgggtcctacattctagtgggaggaaaacaggtattaaataaacagaacaaggaagtataaggtagtgattaagtgctatagagacaaacaaagtggggcagggagcatctttggtgggacgagatggttggagttttagatactgatatcaaaatgtcagtcaggaaatgctttctgagcatttggagacctaaaggggtaaaggagtgatctaagggaaggatattatatgtagagggagcagtgaggacaaaggccctcaggtaagtacatggctgaaaaacagcaagaagtccagtgtgactagagtagagtgaacaagaggacgaggagtgggagatgagatcagagaagttaataggggactaggtcatatagggacttgtgggtaactatgagggcttcagattattaaactgagatatgaagtcatttgtgagttttgagcaaaggaatgacatcagatttaacttctttaaaatgtttaattttgtgggtatattgtaggtatatatatttactgggtacatgggatattttgatacaggcatacaatgtctaaaaattacatccaggaaatgagatatcgatcacctcaagcatttaccctttttgttacaaataatccaaatatactcttttagttatttttaaatgtacaattacattattattgactatagtcaccctgttgtgctatcaaatgcttaatttattcattctttctattttttgtaccaataaccatcctttacccacctacccactacccttcctaccctctggtaaccgtcattctactctgttttctgtatctcatgagttttttttttttttttttttgagacagagccttgctctgttggcctggctggagggcagtggcatgatctcggctcactgcaacctctgtctcccaggctcaagtgattctcctccctcagcctccctagtagctgggattacaggtgtgtaccaccacacctggctaattttttttatatttttagtagagacagggtttcaccatgttggccaagctggtctcgaactcctgacctcaggtaatccacccaccttggcctcccaaagtgctaggattataggcatgagccaccacacccagcctagttgttttaatttttagctcccacaaataagtgagaatatataatgtttatctttctgtgcctggcttacttcacttaatataatgaccttaagttccatccatgttgtttggaatgacaggatttcattccttttttatggctgaatagtactctcttgtgtatatgtaccatattttctttatccattcatctgttgatggacacttgggttgctttcaaatcttggctattgtgaatagtactgcaataacataaacatggaagtgcagatatctttttgatatactgacttattttcttttggatatatacctagcagtgggattgctggatcatatagctctattttttgttttttgaggaatctccaaactgttggccatagtggttttactaatttacattcccaccaacagtatataagggttcccttttctctgcatcctcgcctgcatttgttattgcctgtcttttcgataacagccattttaacaggcatgagatgacatctcattgtagttttaatttgcatttttctgatgatcagtgatgttgagcaccttttcgtatacctgtttgccatttgtatgtcatcttttgataaatgtctattcagatcttttgcccgttttaaaatcagattcttaaggagttgttcgagctccttatatattctgattattaattctttgacagatgggtagtttgcagatattttcttccattctgtgtgttgtctcttcactttgttgtttcctttgtggtacagaagttttttaacttgatgtgatcccgttaatccatttttgccttggttgcctgtgtttatagggtattacacaagaaatctttgtccagtccagtgtcctagagagtttccccaatgttttcttttagtagtttaatagtttgagatcttagatttaagtctttaatccattttaatttgatttttgtatatggcgagagataggagtctagtttcattcttctgcatatagatatccagatttcctggcactatttattgaagagaccatttttttcctcaagtatatattcttggcacctttgtcaaaaatgagttccctgtaagtgtgtggatttgtttctgggttctctagtctgttccgttggtttatgtgtctctttttctgcaagtaccatgctgttgtggttactatagctctgtagtataatttgaagtcaggtgattcctccagttttgttctttttgcggaggataacttaggctattctggatcttttgtggttccacataaaattttaggttttgttttttttttttctatttctgtgaagaatgtcatttgtattttgatagggattgcagtgaatctgtagattgctttgggaagtatgggcattttaacaatattgattttccagttcatgaacatggaatatctttccttttctgtgtgttctcttccgtttctttcattactgttttatatttctcattgtacatatctttcacttctttggttaattcctagttatttaatttgtagctgtggtaaatgagattactttctttttttttatttaattttttagtatttattgatcattcttgggtgtttctcggagagggggatttggcaggatcataggacaatagtggagggaaggtcagcagataaacatgtgaacaaaggtctctggttttcctaggcagagggccctgctgccttcccgcagtgtttgtgtccctgggtacttgagattagggagtatgctgccttcaagcatctgtttgacaaagcacatcttgcgccgcccttaatccatttaacccttagtggacacagcacatgtttcagagagcacggggttgggggtaaggttatggattaacagcatcccaaggcagaagaatttttcttagtacacaacaaaatggagtctcctatgtctacttctttctacacagacacagtaacaatctgatctctctttcttttccccacatttcccccttttctattcgacaaaaccgccatcgtcatcatggcccgttctcaatgagctgttaggtacacctcccagacggggtggcggccgggcagaggggctcctcacttcccagacagggtggccgggcaggggcgccccccacctcccagacagggcggcggccgggcgggggctgccccccacctcccggacggggcagctggccgggcgggggctgccccccacctcccggagggggcggctgccgggcggagacgctcctcacttccctgacggggtggctgctgggcggaggggctcctcacttcccagacggggaggctgccgggcgtaggggctcctcacttctcagacggggcggccggtcagagacgctcctcacctcccagacggggtggcggcggggcagagacactcctcagtttccagatggggtcgcggccgggcagaggcgctcttcacatctcagatggggcggcggggcagaggcgctccccacatcccagaggatgggcggccgggcagagacgctcctcacttcctagacgggatgacggccgggaagaggcgctcctcacttcccagactgggcggctgggcagaggggctcctcacatcccagacgatgggcggccaggcagagacgctcctcacttcctagacggggtggcggccgggcagaggctgtaatctcggcactttgggaggccaaggcaggcggctgggagatggaggttgtagcgagcagagatcacgccactgcactccagcctgggcaacattgagcactgagtgagcgagactccgtctgcaatcccggcacctcgggaggccaaggctggcagatcactcgcggtcaggagctggagaccagcccagccaacacggcgaaaccccgtctccaccaaaaaatacaaaaactggtgaggcgtggtggtgcgcgcctgcaatcccaggcactcggcaggctgaggcaggagaatcaggcagggaggttgcagtgagccgagatggcggcagtacagtccagcctgggctcggcatcagagggagaccgcgcagagagggagggggagggggagacttctttcttgatttcattttcagattgttcactgttggcatacagagatgctactgatttttttgtatgttgattttgtatcctgcagttttactgaatttgtttatcaactcttaatagcttttttggtggagtctttaggtttttccaaatataatatcatctacaggctgggtgtggtggctcacgcctgtaatcccagcactttgggaggccaaggcagatggatcacctgaggtcaggagttcaagaccagcctggccaacatggcgaaacccttctctgctaaaactataaaaattaaccgagcatggtggcatgtgcctgtaatcccagctactcgtgtggcagaggcaggagaattgcttgaacctgggaggcggaggttgcaatgagccgagattgtgtcactgcactccagcctaggcaacagagtgagactctctctcaaaataaataaataaataaataatgataatatcatctacaaacaaggctaatttgacttctgctgaattttatcagatcctttttcagcatcaattgaaatgatcatatggtttttgtccatcattctgtcgatatgaggtatcacattgatttgctcatgttgagcgattcttacatccctgggataaatcccgcttggtcacgatgaatgatctttttaaggtgttgttgaattctttttgctagtgttttgttatggatttttgcatcagtgttcatcagggatattggcctgtggttttctttttttgatgtacctttggttttggtgtctaggtaatactggcctcatagaatgagtttggaagtattattttctcaattttttggaatagtttgagtagggttggtattagttcttcttcaaatgtttggtaaaattcaacagtgaagccattgggtcctgggcttttctttgctgggagactttttactacagcttcaatcttgttgcttgttactggtctgttcaggttttggatttcttcatgattcaatcttggtaggttgtatgtgtctaggaatttatccatttcttctagattttctaatttattggcatataattgctcatagtggccactaatgatcctttgaatttctgcactgtcagttttaatgtctcctttttcatcctttgagttttctcttttttcttaatctggctaaaaatttgtcagttttgtttatcttttcagaaaaccaacttcttgtttcattgagcttgtattttttcttcatttcaattttatttatttttactctgatcttttttcctctactaactttgggtttggtttgctcttgcttttctcattttttacaatacatcgttagatattttatttgaagtttttcctctattttgctacagacatttaaagctacacatttccctctgagtactgcttttgctgtgttgtttccattatctgtttcaataaatttttcagtttccatctgtccttccttccttcctttcctccttccctcctttctttctttctaacttttttggagctggggatctcgctgtgtttaccaggctggtcttgaactcttgtcctcaagcgatcctcccacctcagcctcccaaagtgctgggattataggtgtgagcctctgcacctgacccaatttttcaattcttaatctcttcattgacccactggtcattcagaagcatattgtttaaattccatgtgtttgtatagtttccagaattcctcttgttattgatttctaattttattccattgtagtcagagaagatacttcacattacttgcttttttaaaaaaaaatgttttatgacttgttttgtggcctaacatatggtctttatccttgagaatgatccatgaggtcaggagaagaatgtgtattctgtagccatttgatgaaatgttctgtaaatacctattaggtccatttggcctattttgcagattaagtccaatggtatttttttgttgattttctgtctggatgatctgttcagtgctgaaagttggatgttggcgatgccaggtattgttgtattggggtctatctctcttaaactctaataatatttgctttatgtatctgactgctccactgttgggtgcatatatgtttacaattgttatatcctcttgctgaattgactcctttattattatataatgaccctgtctctttttatagtttttgttgtgcaatctgtttgtctgatgtcagtattgctactcctgctcttttttgattttgcatgcaatatctttttttttcatttgcatgcaatatctttttccatccctttattttcagtctacgtgtgtctttataggtgaagtgtgtttcctggaggcagtacatcactgggtcttgttttttcatccattcagccactctgtgtcttttgattggagactttagtccatttacattcactgatattgatatttacattcattagtattgataagtaaggacttccaccattttatttttctgattgtttgatggtcttctctttcttctttccttccttcctgttttccttttagtgaaggtgattttttctggtggtatattttaatttctttttatttttgtgtttctcttttatgtttctaggtttgagcttaccatgaagcttgcaaataatatcctataacccgttgttttaaactgatgacagcttaacactgattgcataaacaagcaagcaaaaagaaagcaataaacactttatattttaacttcatctccccacttttaactttttgttgtttctatttatatcttattgctatctatgtcttgaaaaattgtagttattatttttgatcggttcatcttttcatatttctacctaagacttgtgtagtttacaaactgcaattacaatgtaataatattctttgtttttctgtttacttgccagtgagttttgtatcttcagatgatttcacattacttattaacatgcttttctttcagattgaagaactcttcagcatttcttgtagggcagctctggtgttgatgaaatctctcagcttttgtttgggaaagcatttctccatgttcgaaggctattttcaccagatgtactattctaggacaaaaggctttttttccttcagcactttaaatgtcatgccactttctactggcctataaagtttccactgaaaagtccactaccagatgtattagagctccattgtatgttacttgtttttgtgtttatttcctcttgttgtttttaggatcctttctttatccttgagatttatgagtttgattataaactgccttgaggtagtcttctgtgtgttaaatctccttggtgttctataaccttcttgtacttgaatattgatatttttccctgaatttgggaagttctctattattatccctttgaataaactttctactcctctctctctctatctcctctttaattaaggtcaataactcttagattctacccctaccctgcctttttattttgagacaggtcctgactttgtcacccaggctggagtgcagtggcatgatcttggctcactgcaacctccaccttccgggttcaagcaatcctctcacctcagcctcctgagtagctgggacccacaggcacatgccaccactatgcccagctaattttttttttttttttttttttttttttttttggtggagatggggttttgccatgttgcccaggctagtctcgaactcctgggctcaagcagtcctccctccttggcctcccaaagtgctgggatcataggtgtgagctgctgcacctggcctggatttccccttttctaggttattttctagaacttgtagatgtgcttcattttctcttgtctcctctcactgtgaatttgcaaatagcctctcttcaagcccactaattctttgttctgcttgatcagttctgctattaagtgactgatgcattcttccatatgtcagtggtgttttcaactccagcatttctgctcgattcttttaatttccatttatttattaaatttatgtgataggattctaaattctttatctgtgttatcttgaatttcttttgagtttcctcaaaacagctattttgagttatctttctgaaaggtcacatatctctgttagagattggtcactgatgccttatttagctcgtttggtgaggtcatgttttcctggatggtcttgatacttgttgatattcatcaatgtctgggcattgcagagttaggtttttattgtagtctttgtaatctaggtttgttgtacctgtccttgggcaggctttccaggtatttgaaggaacttaggtgttgtgatctaaatttttggtcactgcagccatatctgcattaggggataccccaaggcccagtaatgctgtggttcttgcagatttgtagggtacgactttggtggtcttggataagatccagaagaatcctctggattagcaggcagagactcttgttctcgtcccttactttctcccaaacaaacggagtttctgtttctgtgctgaactgcctagacctgaggagggatgacacaagcacccctttagccaccaccactgggactgccttaggtcagacttgaagccagcacattactgggtcttgcccaaggcccactgtaaccgctgcctggctgccacctatgtttgtgtgaggccctaaggctctataatcagcaggtgatgaagtcagccagtatcaggggaaattcagccagatatcgggtgaaattcacccccaatatttcacgtaggttctttcctattttccctaagtgccggccagtctgagaaataaagggacagagtacgaaagagagaaattttaaagctgggtgtccaggggagacatcacatgtcggcaggttccatgatgccccacaagccacaaaaccagcaagtttttattagtgattttcaaaaggggagggagtgtatgaatagggtctgggtcacagagatcacatgcttcacaaggtaataagatatcacaaggcaaatggaggcagggtgagatcacaggaccggggcaaaactaaaattgctaatgaagttttgggcacatattgtcattgataacatcttatcaggagacagggtttgagagcaggcaaccggtctgaccaaaatttattaggcaggaatttcctagtcctaataagcctgggagtgctacgggagactggggctaatttcatccctacagctgcgaccgtaaaagacagccgcccctgaagcagccatttcagaggcttaccctcagggacacattctctttctcagggatgttccttgctgagaaaaagaattcagcgatatttctgtcatttgcttttgaaagaagagaaatatggctctgttctgcccggctcaccggcagtcagagtttaaggttatctctcttgttccttgaaccaattgctgttatcctgttcttttttcaaggtgcccagatttcatattgttcaaacacacatgctctacaaacaatttgtgcagttaacgcaatcatcacagggtcctgaggtgacatacatcctcctcagcttacaaagatgacgggattaagagattaaagtaaagacaggcataggaaatcacaagggtattgattggggaagtgataagtgtccatgaaatcttcacaatttatgttcagagattgtagtaaagacaggcgtaagaaattataaaagtattaatttggggaactaatagatgtccatgaaatcttcacaatttatgttcttctgccatggcttcagccgttccctccgttcggggttcctgacttcccgcaacatctctccctttctttttatataaatgtgccatggtgatgaaggcttgttcattctcttgatttttacccaggattctttgactggtccggcacactaaaaacaagctgattaaacagagaaatgtaattccacaatttactacagtggagcccccaatagacttaatccaagtcgtggggtttaatccataaagattttctgccacctgatctaacgcctcagctccaggcacaatggataagtgagcttgagaggcttcaaaaatttgtttctttaatttagttatgtccaatgataaattatcttccctacccagaaggcgtcctttgaccatttcccatgaataatcagtctcattataggaataggggatgatacagaaatccaaagtattccagttgcactgcatttgcatgcgatgttcgagactcaccacccaatctccaagccaaataacagactgtcttaaatcattaatttgattagcttgtgtccatcccttaagggcactgagtttccctgggctgcgggtaggtccagagattctgtccaggagccagggcctggagttggaaaccttaggaataatcctggtgctctgttttactgtggctgagctggcacccaggctacaagacagcatccttcccattcttccctcccctttttccaggcagatgattctttccccgtgtccaccactaccacaggcccacaaggagttctgtcagggtaccacaaatgtttacttaaggcccaagggctcttcagtcagcttgtgttgaatactgccaggcctgggactttcccttcagggcagtgggctcctcttggcctaggtaggtccagagatgccatccaagggccaaggcgtggaattggggagttggtaccaaagcttaagacaaagtcccctttactctttcctgtgtgtggaggctgtcccagtaattcagatttggtagaatggtggcttggaccagagtgatagcaatgggagaagacattagattttggacctgatttgaaaataggtacaggaggatttgctgatgttttgaataatgaggtattggagaaagaaaagcaaaggatgacttacatggttttgggcctgaggaactccaaaaaagtcattgctttttacacaggtgggaggtcttggaggaacaggtttttgcaattcagagtacagctttggcggccaggtgtgatggctcatgcctataatcgcagcacattaggggggctagcatgggaggattgcctgagcccaggacttcaagactagcctgagcaatgtagtgagaccccatctctacaaaaaaaatttttttaattttctgggtgtggtggcacattcctgtagtaccagctactcaggaggctgaggttgggggattacttgagcccaggagggcaaggctttaatgagctgttgtcatgtgactgcacgccagactgaacaatacaacaagattctgtctcaaaaaaaaaaagtgcaagtttggacatgatgggtgtgggatgtctgtaagacatgtaagttgagatgttgagaaggatgttgcaccatggcattcaaagagaggagaagtgtaggctggagacataaatttgaaagttaatacaattataaattatgagaccaaatggtatcatcaaaggagtaagtgaagatagaaaagaggtccaaagactgagagacctgggcactccaaaatttaaagattgaggagataaccagcaaagggaatgaagaacaaacagcaaatatggagggagaaaaactaggtgcatgtaatgtcctcacaggcaagtgaaaaaagtgtatcaggaactagagagtgtctcatactgctgataggtcaagtaagatgagggcccagtaattggatagagtaagatggagctccttgatgactttaacaggagcagtgtaaggagaacagtaaggtcagaagatgacttgaagtggataagagaacatcagataagataaattggagacagacactgtgggcaactctgtcttgaagcctggctgtaaagaggagcagtagtctttgaagcagtaacagaagcaagatacggggtcaagagggtattgttttcagggggaaataaactagtatatttgtaggctgaaagggagtgatgcaataaaagaagaggtagagggatggtaatgaagtggggagggaattgctgtttaacaattagtggttatagaagtgttttgtttatattttcataaaacacttgattaggacttaaaagatctgggtactaattataattttgtgacttaggtagtcattgaaaatttgtatgctttagtttctttatctgcaaaaatgttatgaacataaaacagttaagtatatgatcactttgaaaaggtgaaaagcactactgtgcttcattattgatcactctcttctttctctcataccatgaaatgtgcccattcatggcagaaaattctcttttaaaattcaagtgctcacatttttctgtttttgacaaaactatcatcatttatttatgtataacaagtagttataaataatatgttttgtgaaaaggctataaatctgtttcaatgtgttaaatcttacgtatggagctgtataaccttgggaagtttttatcaataaattaagttttctgtgtgatctttagttcattttcttaacagtaccaaatcaataaggaagaaaagtctaattccataaatggtgttggcataattggtaagcttttgggaagaaaacttaattttgatcatcacttcatagtacttaccaaaacaaattccagtttagttaaagatatttaaatgtttttttgaaaatcagccagcctgttttttgaaaaattagattactggctatcctggctaggaaggactttccaaatttaaagtgttaggaaaaatcacattaaaataaggatagactttattaagtatatttaatttctgcatttccaaaaggcaaagaagaaaagtttgcagaaaatatggcaaagaattaatgtttttttaaatgctaaaattgataaatagaaaaacctgttaaacctcagtagataaatgggcagaaggtatggacagacagatagaataagagatcaccagtaaataaaatgataaaatatctggccctgctaataattttaaaaatgcaaaccaaacagtagtgaatgactatatttgtcctattaaattagcaaaagcatttttttttcccctagagacaggttctcgctctgtcactcaggctgggttgcagtgtcatgatcgtagctcactgtagcctcaaacttgggggctcacatgatcctcctgccttggccccctaacagtagctaggactacaggtatgtgccaccatgtctggctaattttttttttttttgtaggggcaggtttctccacctcagactcctaaagtactggtattacaggcatgaatcaccatgccagccaggaattttaaatagttgtaccgattaagagtaaactttgcactctcatgaattgttttgtgagtataaatttagctctttaggaaagctatctgggaatattaatcaaaggtctaaaaaatatgtatagttttaataatctgagggcatatgatagtcaatatttagtaataataaaatgccagacttattcagtgcttactatttgtattcttctgagtctgtacatgtataaactcacttaattctataacagctttattaggtaatatttagaaaaggaaaccgaggtataaggaggttaagaaacttgcccagggtcacacagctagttagtagtagaatcagaacttgatccctggcagtcctcagaacttaggctccaaaaatttaatagtatttttatagagagaatatttattatggagtatattggaagtttaagcactaatgatctagctttttagttgcttcttcaagaaatagtaaaaatgatagtgaacacttagtgagagcttactatgtacctgacaagcactttccatttcttaacttatttaatactctaaaataaccctaggaggaagatactatgattagcaccattttgtaggtaaaagctctagaaagatttgataacttgcccaaaattacccagtagagcctgcattttaaacccaaaatctgtccacttaactaataagttgtaaaaagcctgatagtctgtctcctaaccagtatgctgaactgactttataaaagtagtaattctttggatttgttttctcgaaattgagcttcattgggaaattaaaaacagaaacttttctttttttgtataagcatttaacacataggaagcagaacactggaacaagctaaaagaagttttaaaatgttttcccccaggatctcattgctaattaactcatgtcttcttccaaacatctagtgcccttcgcagtcttacaagttgtcaaaaataaaagtatcatgaatcaaacaacaaatctatgttatatctacagtgaatgctgtccttctgacaattgagttaatcaggtctccctggctagttttaaaactaccgcttacagctatacaggactccttgtctttatgctgcttcctgggcctgtatgcccacttcatttacctaactcctttctcattgtttaaaattcagtttagatgttactactaccaagaagccctccttcataaaactcaccctttctacttgatttgaatccagtctactcttgtcgttccctatgattacctcataacattagtgcatttttttcttacctgtttcctgcctctgtaccccagcatctaacaaagcgcatatcattcagtgtgttttttaaattgatgtggggagagagggtataggggaatacaaatttctgcatagtaaaaagcactgggaacaaagtctaaagactgacaggccatagaaaaatgtactcatgtcacaaatgactagtttcttaacatacagtagtccccctttatctggagaggacacattccaagaaccccagtggatgcctaaaactacagatagtaccaagccctatatactgttttttcctatacatatatacctatgataaagtttaatttataaattaggcacaataaaagattaacaacactaattaataaaatagaacattataacaatgaactctaataaaagttatgtaaatgtgtgctctttccccaccccaccccccaaaaaaatcttattctactttttactcacctattttcagaccgctattgacagtggctaactgtaagcatggaaaatgaaaccatggatgaggggggactactgtataaagctgtatatagctcttacaaatcaataagaaaggccaataacccaataggaaaatgagcaaaaggaaaacagatcatttgtagaaagggagaaatgtctcaaacattataaaaaagatgagtcagccccaatagtaataagatgaatgcgaattacagaaatactgtttttaacctttcaggttaggtaagaccaaaaagttgatgcagtagggaaacagacacaatgctaatgggattataaattggtagatccttttgagttgcttgatgttcttccagaattacaagtacatatatattctgtaacagttccatttccaggaatttatcctacaaatatactaaaatgattatttacagcatacacattattgcattgtttgtaaaagaaaaaaatggagatactctgagtgtacatcaatagggggcagactaaatgaattttatttatccattcaattaggtcctctgtagtcattaaaaagaatgagacagctctgtgttatagggtgagcttccagatataatgttaagtgaaacagcaaggtgcaaaacaatgtgtatagaatgataccacttgtgttgggaagaagaagaaactgcacttgggtatatgctttgtatatcagcagactatttctgggaagatatcagagaacacaacagtgattatctctgggaagaagcactgattggtcatggcaggctggggaacaagtgtagtagaagggcatattttttcactgtctactctttaatcttttaatttgtaatcttgtgtgtactacctatgtataaaaataatttgtaaaagaatgaaaagaattacaaagtaaaatatgaattgttttgacaatcacaaaaagcaagtcaccagcaatgagcaaaataaggaaagaactcattaatattcattgaatttttttattttttttatttttattttttttttttgaggcagagtctcgcgctgtcgcccaggctggatggagtgcagggcgcgatctcggctcactgcaagctccgcctcctgcgttcacgccattctcccgcctcagcctcacgcgtagctgggactacaagtgctcgccaccatgcccagctaattttttgtatttttagtagagacagggttttaccgtgtattgcatgttttttatgtgctagatgctttacatataattacttcatgtaatcttcgtaaatcctctgagaaatacctagttttagctgtatcgtacaaagagattgatggagccttagaaatgttagcattcggctaataaggaagcaagggtttatttgaaatcagatcttttctgtttccatagttgggtttttttcccaccaaaccatctggcttccaattagtgaccatcttttattagtgaaagtaagtataagtgtactttaatagtgagcagcagttaccaaaaatgtccacaagatggaaatgttagacacaagcagatatttttctttgtaaaacatcatgctacatatccaagtggcatatttaaatagatgtgtcctgttttgcagtaacatttctttagtactttgttatagatagatagtttcagatatcacttaatgtttctcttttctcataacaatagttgatagggctttttctgtaccaggcagtattctgggtactttacataaattaattcattaagtcttctcaacaggctgggtgtggtggctcacacctgtaatcccagctgcttgggaagctgaggtgggataatcacttgaacccgggagtgagagtttgcagtgagccaagatcacaccactgcactccagcctgggtgacagagtaagatcctgtctcaaaagttttctcaacaaataatattatgaagtatttgccattatcatttctgtttcataagtgaggaacataggtgaaatagcttacagtgtcacagctagtaagtggcagagctgggattcaaattttagcagttattgccacctatttgaaaaaaagatattggcttgtattgatagtgtgattttgtttataagtttcacctgggccgggcctggtggcttatgcctgtaatccccgcactttgggaggctaaggagggcggattgcctgagctcaggagttcgcagtcagcctgggcaacacggtgaaaccccgtctctactaaaatacaaaaaattagccgggcatggcagcatgcacctgtagtcccaactactcaggaggttgaggcaggagaattgcttgaacctgggaggcataggttgcagtgagctgagatcatgccactgctctccagcctgggcgacaagagcgagactccatctcaaaaaaaaaaaaaaaagtttcacctgtatataaatttaagaatacttgtagttaacgcttcccccccacccccacccattaagacagagtctcactctgtcgaccaggctggagtgcactagcgtcatctcagctcactgcaacctctgcctcccaagttcaagtgattctcatgcctcagccaccagagtagctgggattacaggtgtgcaccaccacgccctgctaattttgtatttttgatagagacgaggttttgctatgttggccaggttggtctcgaactcctgacctcaagtgatccacctgccttagcctcccaaagtgctgggattacagacataagccactgcgcccagtcacctctcattagctgatgtatcttgggtttgtgtgcccccttatttcaatcttaatatgtgtatggaaaaaaggacattatgtcttaaaattttaactgtgagttggtgaccagaattttatttttagttgtaggaaacatcttagatcctctcttgggaattcagacattcttcccctcccccaacctgcacccatgtttaatgttgtaattcttaagttatccacatttcatcatggaaacattgtcgtcaggaaatgccatatttattaccctgtcatatatcttaaacatgtgagaaaaatactttagtaaaagtatttgttttctttagttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctatttctccctcctgatgtgtttcttcctctttgaagactttctggaactccctcaatacagttaaagtatctttatagtattgtgacatcacatctcttattggcactcattgtcgcatgtagaagctctttgatggtaaagattatatcttaagttttgttctgcctatatcatagtgtcattattcttcacatacaaatatattaattcttaggggccaggcatggcggcttacgcctgtaataccagcactttgggagtccaaggcaggtggatcacctgaagtcaggagttcaagactggcctggccaacatggtaaaaccccatctctactaaaaatacaaaaattagccaggcatggtggcacatgcctgtaatcccagctacttgggaagctgaggcaggagaattgcttgaacccaggaggcagaggttgcaatgagctgagatcacgccactgcactccagcctgggcggcagaatgagacttcatctcaaaaaaaaaaaaaaaattaaatctttcatagagacatatgggaagcagctgcagctgtgcattagcttcatgcactactcctaccctctcctctttagcctcttctgttcaaatccacacagcaagtcctctacttttagactcatctacttttaacattcattaatacctaatctttaaaggtatgttggctgaaccatcttggcaacctaggaacaaaaatacttttttatctgtctgccctgatggattggttactttttactttgtggctttattttttaaagttgtgacttttgcaattattatggaggatgtacaaaggcctctgtggtctgaaatttcggccagagccctctggggcttgatggtggtactttcaattgtgccaggcatcattcattttctctgcaccttttatccccatgcctacctgccaggcttatcatgataagatttcccaagtatcgcatagggcctggggatagatcaggaaaataacatgagggaaaagccccattctacttgaggagttggcacaggcaatcattattctagtcagctgcccacgaatgtattggttcaaatgtattggttcataaaactaaagtccatgtaggtaggtctgacttcatgcatgcatacaagggttcaaaatatgtggtcatggctcaatcttactctctattggctcttatttctttgttggctttaatcttggtaggatttcactgtgacattgcaaagaactcctgtaactcaataaaaatttttttaatgggcaaaggatttgaacagagatttctccaaggaaggtatcaaaatggtcaataagcatatgaggagatgctctgcatcattcatcattaggaaaatgtgaagtgtatcgcatttcacttcacatccaccattgtggctataattttaaacaaaatacccaaaaaagttgatgaggctatagaaaaattggaaccctcatatattgctggtaggaatgtaaaatggttcagccactttggaaaacagcttggcaattcttcaaaaagttaagcataattatccaatgacacaacaattccactcctagatatatacccaagagaaatgaaaacatgttcacacaaaaacttgtacatcaatgttcatagcatcatgcatgactgccaaaaaggaaacaattcaaaatgtccatcaactaatgaatgcattttttaaatgtggtatctccatatgatagattttcccattcttttataagtggaaagagaatatttcccaagggataatttcttcatctagacaataagaagaattaaagaaactcagctaattaggcagctcacttcttgaaagaagatcaaagtattagtttcattttttctaaccaatgtaggtgtttggtgctgttattcatattttacagataggagattaaggaactatagcttggtgttgagtcaaccagcagtgactcagatgagtaatctgctatgggcttttctg

SEQ ID NO: 13832 - DNA, 35630 bp, Human
ctgagattacaggcatgagccaccatgctggctggaatggtttttaattgtattgaaagaagataaactgcaatagaaatccttgcatcttctctgattctattgcttccctctttcacttctaaagacccttgcaaattactttgagcctaccggacaatcaaggtatccctatccctacctcaagatccttaacttaatcatatctgcaagggtaacatattcacagatttcagggatcagaatatgaacatctatggtgggccattattctaccacaccaccaatctagaaaatactctcacctttaaacgtcagtgtctcttttcttctataatgccccaagaaagaaagtgaatcagtatttaaatactgattcttggaacaggacaggacactttgcatattaactcatattaactcatttaaagtatcaccaaccttcaaccttggtgaggtagatattattgcttggattttaaagattctgagattgaatatgagagttgaaaacttgactgaggtcatctagctgataaaatgtctgattagaaatgggtacccagatcaccagactggcctccaggactgcaaccatgctttttccaccataccaagtgcagattgagtcttttttatgcaaaaatgcttggatttgaggggattttggaatatttgcatatacataaattatccaggagatgggacccaagcctaaacgaaattcatttatgtttcacatataccttatacacacagcctgaagattatttcatacaatacttttagttattttgtgcatgaaaaaagttttgattgcatttttgactgcgacctggcaaataagatcaggtgtggaattttccacttgtggcatcatgtcagtgcgcaaaaagtttcagattttggagcatttcaaatttttggattagagatgcccaaccttacagatgttgtttgggttattctatgaatgatttctggccagtttctcaggaaacacgctctactacagtatattttttaatgagtgaaaaagaaattaagaatggaggggaaagtttcaaactggagagacatctttgagtaaagtatcgtggctgaatgttcctacctttattgaccatgtgacctggttaaatcacttaggttctattaggcctcagtcttctcttctgtaaaatgagatgtttagacctaaggacacctttccagttcccttcccgttgggacattctaggattctgagagagaagcccccctggcctcaagatacctccactctcttgggtgtgctctaagatgactgcattcatgttagaagcatctgaactacgccagagacaacctactgtagatctaaggaagaaaaaatgaatggcaatgaatgcgagaggaaggtgggggggaaagaagcccacgaagattagagatggaaatggcaacataaacagcatgcaaagataaccactgacgggtatctagcgtttacgatgcaaataaaactctgctggtctctgaggatgcagaaacaagacattgtttttggtcttaagccgttcacagaatgcccgggggttacactttgcatttaagcacggacatataacttccacctttaaaagtcctggatgtgagaaagataagaacaacggataaatgaaaatattaacaaaacgtctgagtatgccagaggccacgtgaaaagacggtgtgtggaaacaggtgggacccactgctaagctggatgcgcgagtaggacaaaaaaattggcccccactcccgggcctcacccagacacaaaagaaacgtcctctgccctcagaggcgcagcctttcctcagccagcagagcggctgggctgcagagtccccgcccccggccggcccctgtcgcccgcgcctccctccctcgggcctcggaagtgacgcaagcgcccccccaccgccgctagatccgctgctgctgccgcggcgggcagacctgcaggaggcggcggcggcggcggcggccgaggctgaaggaagatggcggacggcgtggaccacatagacatttacgcggatgtcggcgaagagttcaaccaggtacgtgagagcccaggtccccgccgccgacgcgggcggcgctgcggccgggaagctgacccggggcccgctgcggccgcgagccgaagcgactgcagagtgtgcgcccttgccgcctctgggccgcgccgccgacccctggcgtggcgcccccccgcccctcgttctaccgcgtcgtttcacgggccgcgggcgcggcaagtcgccgcgggacccggatgcgcggacgcggccgctgtgcagctgccgccggctcctccctcgccggcgctgcctcgctccctattgttggcggcacccggctggcgcttcccgccgcgctaggcccgggcggtggggccgcgtgtaagcggcggagagaactggccgccgccgcgccccctcccccgtcgctggtcggaggaggaagccctggcggggcgcgtgcccgccgccgccgccccttccccgccgctgccgctcgggctccgattcctcccatcgctccattttgtctccctgcccgcgcactgtcgcctcatggaaggccgcgttcacggccctttgtatcccgcgcgcccagtccccggggctctccttctcgggtttgcgacaggtttcggcgtggcgccttcctcctcccctcacactttctgaaggcgactgaggtgcgggctcatttgcaacaagtcctttgacttttggagccacagataaaagtcggtgcgctggtcctgcctcattaatccagggcttgcagtgctttgaagcccagtcgttgttggcctttgtgatgaaaatacctgtgaagatgagtggccggggaccaaaaggaagaattggaagcgcgatggttggatggaacaaaaagatgttagctcacccacagatctcatagtgattaaaatgaaagaacgttcaccccaaatccttatgatgtggtttaaaaataaagagttatagataagaccctattttcgaaaacaaagtgttaaatccccccacccccacccccgggccccgtgttaccttttgaaaggttgagcgaaagtgagaatgcaaggttttcctgaacgacgttgcttagaggtaacgcggggctgtgatgtctgttaatgggcatccttgcaaaagatgtcgtttgttgctagtgacgtttaaggtttgaacctgctgttcgtatctactgcattttatgtagtaacacatttaaaacaattaaattgtgcttaactgcaatgttcctaaaagccttatttttttgtatttcccaggtccctatgagaagtttaatgaaatattactggctaatgtggttttcccacctccattaaccatcatattcgtgactagttgctcaggctttttaaaaaacaaggaaactcaagagatctttactgttttatttttcaggaatgactttgtgcctctggtttaaatattagaaaacagaaaaataccagttggctttaaatgtttgctattcagttaaagactggatttgtttaaatgtaatacattgtaatcaaaggttaagtttttaaatctttgtgtttttaaaattgtgcttatgttttaaataataatacttgagttgtgtccattacaaatcagatacattcctcgagtgcaacacaggttctaacgcttataagacctctaggaaatttttttccttttatttatcaaatgaatataactgcgtttaaaagagggctgtaactgcaaggaacaacgattgagtgttcaagactgcctttattagctttacttacaagataatacattggttcacctttctatgcacaataaaagaagaattgggtctcaattttagaagttaagcttttttcagtacctcttaatgaaatatttttaggcttttgcatacttaatttgagagggacatctcccttatccggatagctgggtggattcttatccctgtgcagtagcaagtgctgactgggcaggaggtaaaaagagattagttttgtggacccaatgagggactccttttaaatgtaagttttcaatgatttgtataaggtacctactgcattacgtctaacacagttgtataattttaccagtaaaatctttatatgtttgaatagattaatggcgaggataaatagaggcattgtttttgctactttgcatatcattggccaatcaatgattgattgatttgtatatccttttacattaccgcttcttgctgtggtagtttctgtaccaaaaaaaaaaaaaaggtcacaaaaggatagttggttattttcagagcttatcttgtttttaaaaatatgttactgtcattgaaatatttttccaaaatcttaccagaattagaggcaaccacaaaataatttacaactgatttaatctttactagctggcgaccttatttctactagttgctatagtagactagaactcttgttttattgtcgttgagtaaaatactaaatagtagccagttttgacttactttggcttcaaagctgttgtaaacattaaaaaaaaaaatctttgttttccagtgtaaactgcagttctcattggatttgtatactttgaaattcgggatagtctttatttccattttctactattttttgtctgtatcctgctgagtcttctattttaaatgtcatacttttatgaagcttttttgtattttggtaaggcacagtattatttcaaaaagtgatttgcatctattgaagtagaaaaaagtgaggcattcaacagtcttagcagaaactaatttggggatagattgagaataataaattagtgaagctctaatagagtgcctttcttcaccaggtgaacttaagaatggagaatgaaggggggaggaggcacaagggactggctactccttatgggttctctttagttcttagaggtctttggatgtcaccaagctgagaacagctggaaggggaatttgaacatcttccaaacctctctattacttgaagttgagaagaaagtgattctgtctcacagtagcatatcaattcagtttaaactgcatttatactcaagtgtagtaattactagcccaatatttagtaattgtagattttaaaattctggccaaaactaaataatttaaaagttgaattgtttagcgcgagtgtggtggctcatgcctgtaatcccagcactttgggaggccaaggtgggcagatcgcttgaggtcaggagttgcagaccagcctggccaacatggtgaaaccccatctctatcaaaatacaaaaattggccgagtatggtggtgcctgcctgtaatcccagctaatcagtaagctaagcaggagaatcgcttgaacctgggaggcagaggttgcagtgagccaagatcgggccactgcactccagcaagaccctgtctcaaaaaaaaaagattgaattgttcaaaatacatttgttgagtgtctgttatgtgccaacaacgagggatacaaagtttaggtagtctctacccttagagtacactgtaggggagctgagagatacctacatacagtagtgcacacgtatccacagttccactttctgtggtttcagttacccgtggttctgaggtctgaaaatattacatacaataaggtagtttgagagatactatatttagctaacttttatgacagtaaactgttctacaatcatgtgtcgcttcacgatggcggtatgttctgagaagtccatcttaggtgcttttgtcatttgtgatcatagagtgcttttgcatttcaaacctggaaggtacagcctactacacatgtaggctatatggtgtagcctgttgctcctaggctacaaacttgtacaacatattactgtactgaatactgtaggcagttgtaacacagtggtatttgtgtatctaatatatctaaacagaaaaggtaagtgaaaatcttgatataaaagataaaaagtggcacacttgtgtagggcactcatgaaaggaacctgcatgattggaagttgctctgggagagtcagcaagtgagtggtgggtgaatgtgaagatctgggacatgctgctgtagacttcataaacactgtacagtacactcaggctacactaaatttatttaaacttttttcttcaataatacatgagcttactgtaatgttttcacttgattgattattttctcactgtcatccagtctggagtgcggtggtgcagttgtggctcactgcagcctttatctcccaggctcaagcagtcctcctgtcttagtctccagagcagctgagactacaggcatgtgccaccatgcctggctaatttcaaattttttttgtagggatgaggtcccagctagtctccagctcctgggctcaagctgtcttcctgctttgacctaccagtgttgggattacaggcgtgagccactgtgactggcccgtttttactttataaatttggactcttcaataataacagtttaaaatacaaacacattgtgtaactatataaaatattttctttatatccttatactgtaaacttacttcttttttttgttttgttttgttttgagatggagtctcgctttgtcacccaggctgaagtgcagtggcgcgatcttggctcaccgcaacctctgcctcctgggttcaagcagttctcctgcctcagctgggattacaggcactcaccaccatgcctgcctaattattgtatttttagtaagagacgaggtttcacatgttggccaggctggtctcgaactcgtgacctcaagtgatcctcttgccttggcttcccaaagcgctgggattacaggcatgagtcaccacaccgggcctaaacttttttctattaaatttttttttttaacttttaaaattaattttattttagaagagacaaggtcttactgtgttgcacaggtctcaaactcctggcctcatgtgatcctcttgcctcagcctcccaaaggaggctggaattacaggcatgaacgactgaacctggtctttttttttttaagctttttttaaaaactaagatatacacacattaacctaggcctgcacagggtcaggattatcaatatcactgtcttccatctctgcatcttgtcccactggaaaggtcttcaggggcagtacgatgcatgggctgtcatctcctaggataactgccttcttctgtaatacgtggtgaaggactgacttgcctgaggctgttttacagttaactttttgaagtaggaagagtacactctaacataatgattaaaagtatggtatagttggccttggtgtggtggttcacacctgtaatcccagtgctttgagagcctgaggcggcagattgcttgaggccaggagttcgagaccagcttggccaacatgtcgaaactccgtctctatttaaaaaaaaaaaaaaaaaagtgtaaaaacaaaaaagtatagtataataaatacataaaccagtaacacagtcgcttattgtcaagtattgtgtactgtacataattgtatgtgctattcttttatatgactgagagcacagtaggtttgttcacaccagcattacgagcccaaacgtgaggaatgcattgggctaagatcgctaaacaatagtaatttttcagctccattataatctgaccacctggaccaaaacattgtcatgcatgactaaattgttctcttttattagttattttttacagtgcctactttataaattaaactttatcataggtatgtataaagaaaaacatagtatatgtagggttccttgctttccgtggctttaggcatccactgggggtcttggaacatatccctctcagataagaggggactactataattatagcacactgacaggtcctatattgtagttaccattcttttatgttttatgtgtaaagttttgttgatctggagaggaaagtcaaaaaaattctgtgaactttagggaaacttacactgcttgcattgaagtagtatgttttgttgcttgtttgggagtcagaaactcttaatgtggaatttagtttctgctctgtcaggccatcaccgatagcacaaatttagtaatctgaccacccagctttaaaatggaagtgtaggccaggtgcggtggctcatgcctataattccagcagtttgggaggctgaagtaggcggatcacttgaggtcaggagtttgagacctgcctggccaacatggcgaaacccctgtctctactaaaaatacaaaatttagccaggtatgatagtgcacacctgtaattccagctacttcagaggctgaggcaggagaattgcttgaacctggggggcagaggctgcagtgagctgagatcaggccactgtactccagcctgagtgacagaacgagactttgtcacacacaaaaatagattaattacttttaaaagaatggaggtgtatagaggcagtagttggaacaaagaattcacttaggagttacggacctggacatccgataagtcagtttttatgtcatgaatcattttgctttacgttcagtcattatgtatgtattctagccaattgttgagccaattaatgaaaataaatttcttggacaaatatcagagaaacattgtttatgatttatttatgtttactagaaaaccatctgaaataaagctgtcaggttgagaatgagctaggtagaattgattcagaaaaatggatagaaatgttcagggaagctagaactcttctctattttgttatttatgggtgcagttaatttagttgcctgtgaattgtccactatggtttatgtggcatatttttagtaccaaattccttaccattatataaggaagggatttttacagggattactagccagttttaataactactgagaacataattagataaaaccagaaaatgatatattttctttaaaaatgtatgcattaggttatctgctattggattttgcatactagtatttcttttccgaggtataggatatattttgtaaatgcaaaatgtaacttccccccttcatatatttctctaaatggaaataatttaaaataggctttgaaacaagtggcctttgctgtgcatttactgatagtatcatataatgcacgaattttgtatgtatttatgtatttttatggtagagatgggatcttcctaagttgcccaggctggtcttagactcctgggctcaagggatcctcttgccttggcctcccaaagtggtgggattaacaggcatgaaccaccatgcctagcctcgaatgatattactgtaattttagaaccatcaaaaaaatatcaggcctgtcagggagaatgatgaatattttgacagccaacaagttcatcccaatagtggtatacagtatgtatcgtatatctgtgatattaaaattgtaagaggggtaattagggaaaaaatgtctaaaagtaacttcttgaagggagggaggagacagggataatgaaaaggttgagaagccatactttaagggaactaataggattttggtcattttgccatccattttctctggcttggcaacagatatttgtatatcatgtggagcataatcttgttgtgtaaaatgttgagagaataccttgtctaaagaatgattgtagtgatttagaatggtagggaatgaaaaaaattagtgagttttttttttttttaaacaaaccctaagagctgttgtttattccaagctttatgtaacatagctggctagctactatgaacagcagataagattgggcaacatttggtatcaaagataattagaggaatgatgttgatattttcttgttttttgaatgccattaaaattaaaagtaataattgaaaagacccttcatgtaataaaaaatgataccgtgaaatatttctttgacaaactggaaaccttttttttagtctgttcagtaggctcacagagctttatttatatatgacctgtgatatacattttgcataatttctcatgcaaacatcatgcatattttctcactttatgaagtaagaacaaagttcagtatgttctgtatttttttttacgctggaggattgatgtgatatgaagctgattaaaaggaaggttactgataactacaaaagagtgtgctttgagtttcatttttagtaatggcagcaaatgtattcagattcattatgttttttcacaaagtttaaatgtataccattggggctaagtgtacaggctgtggccttggaacagagagaagctaactagtccacatggagatcaaaccccaggaccatggtcttaattaggatcgtactacaaccacttggaagcagtacaactaccagacaaaatggctgatcctaaatattggtagaatcatatcaatgtggaaaattggtttgtgtcaacataggaattcatggatggacaaaaatagtaagtgattgtgatataccaggttagtgtagctgcaattatgcttgtaaattttttgtctacttatgtaaacattttcacaggtttgtagctaatagaagaaaacaaagaatctgttcacctatttatgtaagtgaaagtgtaaatttaaaaatacatttagtcctgctgttaataacccttccattcttttttactttccctcagaccatatattgtgattatagtttctgctgaggaggatggaaactcaactccctttgaataatattagtaattctacttgatgttcagaaccggattgcaagagagtttaaagtgcccaacaccccttgtgggaaactttttagtatcttaagtgcatggaactactgctgcagccacaccgcctgaagcttcagccacactgaaacttcataacaaaacttaccctcttttttcctaatttctgtggtcattgcaatttgagcatgttactttgtttaacaaaaactcatttcttaaagattattttagtattgctgtacaaacagaataaaattatggcattattcagtgacttgtggtcttagtttctgccctttgttaaatttagctttgttctctgatttaaccttgagatcccagaccccttattaaataagtcttatagacattctacctcgtaacaagtaaaattggtatgtaaagattctgtaactagtaaattggataagtcattaattacataaacgattacctgatgattacttgaggtccctttatttaggtatataaatgatatttcccctactaggcttttttctttttcttttaaaaagatcttattctcggccgggtgtggtggctcacacctgtaatcccagcactttgggaggctgaggcgggcggatcacgaggtcaggagatcaagaccatcctggctaacccatcctgcctaacacggtgaaaccccatctctacaaaaaatacaagaaattagctgggcaaggtagcgggcacctgtagtcccagctactcgggggggggggggggggctgaggcaggagaatggcgtgaacccaggaggcggagcttgcagtgagccgagattgcgccactgcactccagcctgggcgacagagcaagactccgtctcaaaaaaataaataaataaaaattaaaattaaaaaaatacaaaataaataaaagatcttattctggctctcctttaaatagcaaaacagtagcctgggcccataatatcttgttgctctgtttaccatcatataacaaatgcttttctctgggtcattctctatccatttagggactattttggctaatagtccctaaaaccattagctcctccatatgtgccatttgtataattctttagtaaattgtattaatgggagaatctgtaagttacgtctgaactttcaggttgtcttataattgtctttttccttatgtcagatgttctatgtcataagaataaaatggttcacaccaatacaagtacttagttgtggaaagggagagtagaagataaaaatggagattttcctgtgctacaggcttagtcaagcttatggtctatttaatggttatcaaaggcaattaaatagtgttgagtgttctgcttttacctacatttcatttttcatgtacttagttacaaattgaaccctcttctatttttttcctgctcctgtttctgtttcattttagttttccttttccctgattatcatttaggcatgtaagtgacacccagtagcattgctttaattctgctggtgacagtgccaaagctttactatactctttttgttgtctgttgcttttctcttgctaatttgcttgactagataactaagaattcaggtaagcattagctctttgttcactgagaataatacaacttgcaagataattaatttggattgttctacatgtatttcgtttatttctctttaccttgttcatttattacgacattttgaattatttacatacccatatttcttctttcttttatggctcagctcactatgcttttttttaatactggtagcttcctcaaggttggaaaacaagatctgaatactatagaaaataataactatttttctgtggtcatattaaagatataatggctttggattttggggtgatttttctactgtcagtttaaaaaaaacttgtctatttgcatttgtgtgttattacttctagttaagagtatttccaaggaaagtttcatgttacttattttgtttccatgtctttttccaaaagaacttattttttatattataataaatatcagtggaaaagtaggtttcgttatatagaaattaactttaggctgggtgcagtggctcaagcctatatttgggaggccgaggcaggaggattgcttgaactcaggagttcgaaactagcgtgggcaatgtagcgagacctggtctctacaaaaaaaaaaaaaaaaagaaaaaaaagaaaagaaataaaggaaaccccctttttttgtttttttgttttttttgagatgaagtcttgctctgtcgcccaggctggagtgcaatggcacgatcttggctcactacaacctccgcctcccaggttcaagcgattctcctgcctcagcctcctgagtaactgggattacaggcgtgtgccaccatgcctggctaatttttgtatgtttagtagagacagggcttcatcatgttggctaggctggtctcgaactcctgacctcaagtgatccacctgcctcggcctcccaagtgctgggattacaggtgtgagccaccactcccggcaagaaattcactttttagacctgttcaagaatacatctattgcataaagtggaaaaagatttgtactgaaatccttggcctttttccatcagatttttaaaacaaaaagttgaatttgtattcaagtctattttagtagtattttgacttttgtataatctagagcattatttctgtatctcaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatgggtaagtgaagttaatataagaattaaattattggtaattgattttgaactgctctagtaattaatgtttttctccagatttttataagtttgaagttactgtgtttttctatatgtgtttgcttgtccaatgaggagggaaatacaaatatctttgcaacatcgttaattcgaattcttctagttttgagttttgtggtcattcaacttttcttggtggagatactagttaaatatagttaaattagttttgtcttcagttaccttttttatgctaccactttaccttgcttccgatagcccagtttcactaaaaataatgctcacatggggtctcaaaccaggattcaagtgtaaaaggaaagagacatagtatcactcctggtttaaaaatagtgtccattatttaatttgtgttacaaatttgagttttatttctgcccttaaatttgaaatctgatttatagaagcacttctgtgcgtattatattttaatttgggttgtcatgagactaagattattgatttagagcttcattaaatgcacatatgtatatttattttttattaatattacatcttaagtatcattaaaatagtcctatagaatgtttgtatttctacttagttatatgtatacttgaaagttaaaaacttgtatatgcaaaaatcaataaaacttggcacccttgcatttccttaataacactgtatttttaaacgttttatttacatttctttttttcggggggagacagaatttgcaaaactctgtcacccaggctggagtgcagtggtgtaatcatagctcactgaagcctcaaactcctgggctgaagtgattctcctgtgtcagcctccaagtagctaggaccacaggcatgtgtcactccgcctggctaattaaaaacaaaacaaaaaaacacttttgtagagctgacttcttgctatattgcttcaggctggcctcaaattcctggcctcaagtgatcctcctaaccaagctctcaaagtgctaggattatggtgcccagcctatttacatttcttttaaaactaaatgtaacagatctcccaccacccagtctgagtattctataaaattggagacagtagcagtgtagttatgaaagtatggttgctaagtaagtatttggatcttagctccaccatctattattagttttgtgaccttgttaaagagttaaagctctttaacttctattgtatcatgtgtaaaatgggtataataatagtgcttatatggttgttataagagttagttgatacataaagtatatggtagatattaaatacatgttagttttttcttatctgcattttaattcaaaaacaagatgaaattcaaaatactttcctttaatgggaggaagtgaaattggttttattcacaatttaaaatcatagcagtttaaagctgtaagggaccagaaactcttgagagtcaaatcttattgtaaccccaagggtatataccttctagtttctgaaatacttatcagggaatgaagttaggttcccagatggtttttgtgctgtttaaaaattggagtctgactggccataactagacttagatttgcactcagcatttattttctcttttatgtctcaaatttccccttaaaaactagactgggataataaaaatcttggttttattttaatggttaatgagggggaaaatatcttgcagtggacaacagatgaagacttaactgaagcagttcattctttgggagtaaatgatattttggagataaaattttttgaaaatcgggcaaatggccagtcaaaggggtaagttttttttttctttctttttgatttagtagctagtgatacagtttttacaagttaactttcctttaagttaatgttaattacacatgtatacacatgtatacaaacaacacatgattgtttacattggaaggaggttcttgggcaaagattgatacttttcattttacgtaccctattacctaacacactaaaaccagtagagtggaaatgtggacagatttattttctatttttcccaagttttctctatctgtggttgaaatggttgttgaaatgacagtttaagaaccattactctccctgtgattaagagatgggagaagatgggcaactgaatgatgtgttacatggatattttgctttatttcactactaaactatacaagtgggatagcctcagcatgagaacattataaatacagatatctaaaagtaagaaaataaaataccactgtcctaccattcattgatgtttacttttaacattttagtgaagattcttttgggctttttcctaaaaataaataaataaataaataatggaattataattcatgtgttttatatgtttgatataaggaataaaaataaatacacatcctctctaatgtctaattcttttgcatcatacctggtatgctactgtaatttacctttcttatttttggttatcgtggtggtttccacttttgcctattgtaaataatgttgcagcagacatcattttatataagtcttttggtacagattttggattttcttttaaggataaattgttagatgcacaatgataaagaattttcttatttcttatattgcttacttatcttagaagattataccaatttatactaaactgagaatattttcaaaatatatgcagagtctgaatacttctcactaactttacttataccacttggtcaaagccactatcatctctcacttaaactttggcagtagcttcctaactggaagtatagactgccccctacagtctgtactccacataacagaagttttaaaaaaaaaatgacattctgctcaatcttctcatggtttcctgtctgtctcattctttaccattgtctacaaggtactttctggtctgttttcccaccacctttctaaccctatcctaccactctttttcagccacattagtctctttgctgttggccagaccaattcctacctaggacctttagctgttttctcttcttggtttacttttccccctcaaatatccacatggcttactctttgacttcattcaggactcaaactgtttaagagttttcttccatgaccatcttgtgcaaagtagcaccttcctatcctgtttcctttatttctgctctgatatattttactcgtttgttgtctcctcttccaagcctttaagcttaatgagaacagagattttgttttgttctctattacttctccagctctagaatggtaccttgcgtataagaagtggtgcttaataaatatttgttaaattaatttagttttttctaaatgttgtgacccaagataatcctggtgcaaacagcagaacttgttgactaaaataagaaggataatttaaaagatcatattgaacattagggggaaaagagcttaagcttcttaagctactaagaccctccctccctcaaataatttagaatatcctgtaactatacgaattggtaatcattctgattattttaaatttgtttttctttttgaggtataattcatatgccataaaatgcaggcttttaaatgtacaattcaatgataatttattatatttatgaagtttagcaaccattaccactgtctcattccagaacatttcatcactccaagaaggaaccttgtacctggttagcagtcactcccatttcctctcttcctatctgctggcaactgctaacgtgctctggatatgcctgttctggacatttcatctaaatggaatcataaaatacgtagtcctatgtgactggcttttttccttagcataatgattttaaggttcatccatgttgaagcatgcatcagcatttctttttatggctgagtaatattccactacatggatatagcacttttttcttttaatctatcagtcgatggacgtctaggttatttccacttttggctattaaggaaaatgcccctgtgaatatttgtgtacccattttgtgtgaacatgtattttcagttctgttggatgtgtacctaggaatggaattactgggttaatatagtaactctatgtttaaatgtttgaggaattaccagattatttgccagaggcattgtgccattttattaatacgtgctcatcagcaatgtgcaatggttccagtttctccacatatttatttatttatttatttattgagacagagtctcactctgtcacccaggctggagtgcagtggcgcaatcttggctcattgcaacttctgcctcccaggttcaagcgattctcctgtctcagcctcccagcgtgggactacaggcacacgccaccatgcctggctaatttttgaatttttagtagagacggggtttcaccatgttggtcaggctggtcttgaactcctgacctcatgatcctcctgccttggcctcccaaagtgctgagattataggcgtgagccactgcacccggcctctccacatctttaatacttgtctttttgattatagccaccctagtgggtatggggtggtatcttgtggttttgatttgcacttccccaatagttaatgatattgtacatctttttattgtagcaaaaagtggaagcaacccaaatgtccatgaactgatggatacatttcttttaatgttgtatatttataatggaaaattattcacccataaaagtaagtggtgatgcatgctgtaacagtggatgaagcttgaaaacatgctagttaaagaaggctggtcacaagggacctcctattgtatgattccatttagatgaaatgtctaggataggccagtccagagacagaaattaggtttagtggttccatagggtacagggatgggaaggaatgggagcgatggctaatggatatggagtttctttttggggtgatgaaaatgttttaaaattgattatggtggtggttataacactgtgaaatactaaaaaccactgaattatatattttgaatgactgaattctatggtatgttatacaagatgaacaaaaatgtgtactcgtatagttaagaaatatttttagtttttaaaattatttatttttagagacaggatctcactgtgttgcccaggctggagtgcagtagtgtgattataggttactgtagcctcaaactcctgggctcaagcaatcctcgtgcctcaaccttctaagcagctgggattacaggcatgagccactgtgcccagctgttgttttagataaaagcagattaagacctttttacagaagaataacagtaataatattgatctctttttactttgtatcctcaccccttaaacactttttaggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaagtaagcagtcctcagaggcttttattaaaatatgtacattttaaccagtgcatttgttaggtgttatactagagaagtcatcttaatactagctcactaggaactccatttcacaaagtccatgctttgaattagatttaatcactggttatgactgtgggcctgtgtacgagaaacctactcctgttccatttttctccagatgtaacagacccaatactatacaacaatgtgcaagttctatagccctgccattcttgtcctattatttccatcttagatacagaaagaaactacattctaattcttagattaaaggagagctatgtggatgtgtattatggtgggggagagatcactgataaccagaaaatgttcattgatttttctgcttggcaacaagacctttcaccacttggtaaactgaatatagaaaagatttgtcattatacatttaagtacattatctttaaagagatgagatggatgattatgtaattaacagaaattcaagtggttccttttcttttaatgttttagcacttaagacttaactgaagaagtgtgttacaaaatttaaatgatgtaatactgaaattaagatatctgttgaagaatttcggtcttggctgctgcagagtgctggtattttgaaagtaactcacgattacctatggaaaatatatttaaacctggatattttgagtctttaaaagtacccaaatagatgtgaatgttttcctaaaccatactttcttatgtagtttgcataggcacaaggcatttgcaagttaatatattagaaatagagttgtttttaataatagtggttacatttcagaaaactatttttaataagtgctatttatgagtatttggatatttgcagctacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccaggtaaaacttttcttaaattaccatggataaaacatgtctacctaatacctcttttccttttctctctttttcaagtaatgcattattaatgtgacttactctccttgttatgctatttttggaatccaggaaatttgatcaagcatcttgttaaaggaactcggcctttgttcctggaaactaggattccatggcatatggggcacagcatagaggaaatacccatttttggcctaaaaggtctttatttttctccaaacttgcttgacttatatatagaatatttacatccgtcttactttcttacctcttaaaaaaatcctttcaagatcatttttccttgtttcactttctagcttggcatcagagtagaatataaggtgggtgatttcactgtaagaagtgtgtgtacacggaaagatggaaaatatctctaggcattgtaatatttttttattaaagttttcgtttcaataatttttcttaagcataaattgagctagttaaatttgtaaggatatacttcattgtagttggtagtgtaacatttaccatacgggtttaatttaaagacaaagacttggtgtatgctctatgcgtttaaagtataatcttggcatataaaagttaaaatatcttattagtgaagtgttttttttttctctctttctcctttgttttttagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaaggtaagttagtgtgtatctgtgaaagtacttgatgataaaagataggaacaatgactgtaaatattagattgtaggtatataaatatgttatttctgccttccaagaagatgaggtgtttaagctgctaccctgttttagctgaaagatactggtataggagaatttttagatttgttctctttgttggaaaagtagcatgcttcaatatggaaaagtaactactatctctaaagcacatgtcagaagcagctagtatgaattgctatacaccgttgtgactaactgaggaaatctgttgagtatgagttaaggtttatgtttttgttttacagggaaatggatactgcaagaacgccattgagtgaagctgaatttgaagaaatcatgaatagaaatagggcaatctcaagcagtgctatttcgagagctgtgtctgatgccagtgctggtttgtgtatttcttgtattaatatttcttatttatgttattaggaatgacctaaaaatgtaagtacaatctagaagataggtcatttacatgtagtagttctttttatattcccaaatcattacctacgatttatttaaaaagcattgaaaaaagttgtgtgtcacagtgtagtggggaaaatccaaattttaagttatttggtatagatttaagtcttacccttgacatttaatggttcaggggcctcatgacaccttatttattcttatatttgcaaaatgataatgtgcttcacacacgtataataagttgagtcaatatcatgagcatgaaaggcttttgcaaatggtgaaacactgaaagaagacattgtcttgcatagttattttatagcacagtacttttgtaaaatgccttatcactcttatcccaagtggtttgatggtgttttgaaaacaaaatttgtttgacttcaaaccctttcctttccctcacaggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaaggtaaaactttcctgtctcatttccatttaaaaaaactgttagtttacaaatggaaaaaatactgtgagactttaaaaggaggactttgcttttacttactgattatttagcagctggagtggttttttttttttaactctaaatgttagttgcttgcttaaaaccctttaaaggctcctactcagtcttaaagcaagactgtaaagattgagggactgtgtgataaagcccctgcctatctttttagcctcattttgtacctctccccttactcactgttctccagtgagtatttctccatatttctccttttctttaggtacaccaaatgtttgaccacctcactttatattccttctgctgggagcagttttccctgtctcttcacatagctggctccttattcttcacgtctcattctaacttcttagggtggggcttctcccaagttagtctgtcgtattgttctttttatttcttccatagtacttaccataatcaattcttacttgttataaggcatatttttcctcattagaacacatgttgaatgatggcaggggatttatctatcctgcttactatatttcttttcttttaagagatgggtcttgttaagttacccaggctggtcctgaactcctgggctcaagtaatcctctcagcttggcctcccaaagtgttgggatgataggcatgagccagtgtgctcagccatgctcgttataatatttctaatgcctacagagtgtgtggtacagaatgagtgctaaataaaaatttctcgaatgagggagtgactgaatgaatgaatgatctatcttttaggtagttcctttttttttctttttagcattgctgctaactttgaaattttatatatttttgaaaggcagacctaatcttcacttggtattcttagatatgtctttagtgtactctatctggtagtaatctgtaagagaaaagagcttgcctttgacatggtccccagttttgtaattattacctttttgacccggtgtaagaatctttgtgtctaaacaaatttgtcatagatatagttatcttgtatcatctttttaagttttgaagtccaaagtaataattttttaatcccaacactttgggagaccaaggcaggaggatcacgtgagccccaggagtttgagaccagccttggccacataaggagtttttctacaaaaaaattttaaaaatatctgggcctggtggtgcatgcctatagtcccagctacttgggaggctgtggtgggagggttgcttgagcctcagaggtcgaggatgaaatgaactgtgatcatgtccctgcactccagcctgggtgacagagagagagagagagaccctatcttgaaaaaacaaagtaataacttaggccttgatcaaggattttagcacctaatgtttgctaagcttagctgtctggtgcagaaatacaagacataaatattatttcgtagacagttattatttccttactgtgaatttagcagaatttatagaagtcttttgggtagtaagctttggttaaattatttgtttttaaaaaatcgcagttcatgaaacatttctacttattaaatacaatgtgaatactatatctattcttgctactggtcataattgttagccctctcccatgcctcttctcctcccctgaatataacatgcgtattagaaggtttctttgtgttggatgctgctcatgaaccatatgttaagaggttgtcatattcatgtatttaagccccattgtgtgttgtgatttcatgacttttatatctaaaaaaaccatattgtagatgttctttagcttgaaacacgagtgctttgaaattttccctttacctttctatttgtgcattcagtaaatactacacatctgttttaggctactagtttaaatagatgatgtgatgcatttctgtgatgtgtctggttgctgatttttttgttaatgtttttaatagtgaaatttctggttcatgcttacctggtgagttggtaagtcgttattggcagctcaggatagtaagtttaaaccagatttacaaagaatttttgctgcctaagtttttttagacatcaaaaaattgaatatttttaggctatctaattatggagagcattaatccagtaatttcttttagaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaaggtgggtattccttgttccctgttaaatgtgtgtgtattcttaacagtaactataactccaaggctactgtttatacagtatatacctacattttaaatggtccaactacttgtgaatttaatcttctggaaacatctgaaacaaattataggtaagtaatgacaggtaaaaattttgaccctttatcttatgaatattttattgctgagttatcactttcaggtttcaaatagttaatggtcttaacaaagcaaggaaataatcaagaggactcattgtgtacttctaaaatctaaaaattggggttcttgtatcacatacataggttgcatgcaatttaaaatacaaaacacagggagttatttcacatatatgttatgtgtttggatttttaaaaataaatggaaagttactatttttgaactagttttatttgtccctaaaaatttatgagaaaatctaacacaataatagtttataatacaggagggtgttttctcaacattcaaagagaattttcctttaaaaaaaaaattttttttttagaagagacactatcctgacatctgctttttgtttttaaaagaaacagtatcctttaatttgcaaagaagatgtaaaagttaatcaattaaaatgggtttagggtgcactgatttatatctaaaaattttaaattgtgtcaagccatatacccaagtttagaataccttgaaataattttctttgatgtttcattcataaatcataatcattgtctttttttctgtattttaaaactttcttgtgtacatttttcataaagtgggaagagttgtctgtttatgcttcattttcacatgtaattttattttttatatttgttaatagcatttattcatgtgaagagctgggggagggcactataaggcttatgcatgtgacacaaaggttattctgtaaattaaaatattttttctttatatgttggttggcatattcaaattaaattaaggctaaacaaacccctcataggtaaatactctttatgtgattattttcagtaatcatgggaaacttactgaaaattcagtcatggtaattgttagtatttaaattgttatgggcaaaattaaaggttttatcaagtgtatgtaattctgtgacagaataccaatttctttaaccataacagatacgcaaatgaagtccttaaatgcctagaaaataagcatgctatttttatggaacacagatataagctcctacactatttacaattttaagggctttttgagttaaaaggctggttttgatactttgcattttgaatatgcagattgaatatcaaaactttaatttgtagttttccatgtattacaaaatttaatataaatctcaaaacattcttttaatatgaggcaaaaaaaccttttacttttaaaactaagcttattgaaattgatattgtttttgaatgtaaaaattgaatgttgtattatgtaaatctaaacactaaattttaaagatgtagcacttttttcccctgagttaaatacatctgatcccatcttaatgaaaaaattctcaatatccatcagttgcttaaactggattgtgactgggttattagttgaaatgcttacctatgtcagtcatttccattatagaagggtacaggttctgtaagttacctatttttttggactttataagttatcagcaagcttcttgttagtaaaggcatgataatgaaacttgaattcatctacaaaattggatgtgcccatcaaggggcctctaaaccaatttaagcccaaagttaactaattacaatttctactggttttagtaaaactagcatagtcaaccaagtaaacaaagtccattgttaatcttatttgagttagctaacattacattctagtaatgggtacacctaaatatatcatgacttgagtttcattacattcagacataaactacaaattcctaatgtgcaaactattgttgacatttttcttaatcactgatgtaccataccagaatttccatgttttgtttgtacattaatcagaattgagttgtaatactgtatgtgccttcatccaagaaaaattttacataagcatttctagtgcaaaaaattctgttatcctggattattgtacgtttgctatatcaaacagtattgtggatgtagacttgaataaaggggtggggactgggattaaatatattcaagtaaatctttaaaacaaaagctatctgcaaatttgatcaccatcataataaggtctgttgacctttttagaagttttaaaatatgagtccttttgagctttcatgtaaatcttaaatggaccaaatggactgagtgatttgaaagctaaagtgaatgtcactagtaaggctgtatacaaataaaatactaatgtaatctattaaagtgatgatgaatggctaaaagggcaagttcttaactttttaactggaaacgtaatgatcttggcaagctgttaatgtctgtcccatcttaatttttttttgtgtttgaactgttggtaatgttaattgcattctctcattttaaaatgtattggtttttctaaaagtattcaatatctaagttcaaatagataatattttaatgagaaaataccaatattgtaaatttcagtatgtaaatacgttgtgcttcatattctgtaatttctacctctattctcagaccactctgagcaaaataaaagtagttcagtgctttacgattgtacattttttactgaaataattttagtttcatagttgagttacttaaaaggttacgttcctcttgtcacttctttggaacatccctactcagcaaatttgtgttaacaattcagcttttctttgtttactgaaaccaaattatgtttttttaaaatactctttattcaggcttttcctctctctattttatgaggttttacaattctcaaatcatccatgacaatttttaagcattgggtatggggtctggattaaataacttgcctttgctatctgattacttttttttttttttttttttgagatggagtcttgctcttgttgcccagtctagagtgcagtggcacaatctcagctcaccacaaccttcacctcctgggttcaagcaattctcctgccttagcctccggagtagctaggattacaggcatgtggcaccacgcccggctaattttgtagttttagtagagatggggtttctccatgttggtcaggctggtctcaaactcccgacgtcaggtgatccacccatctctgcctcccaaagtgctgggattgattacaggcgtgagccaccgcgcccagtctagtctgattacttttttcctaccttaaatatcatgatcttaggatcttagattttgttattgcccaagatttaggatgctttgcattgtgtattcagcttattagctttgtgttaattttgaaaaaaaaaaaaaagccaaaagaataaaaaaaattcttacatgttaaagatgtttcattttcttcttagtgttgctttgaggcttatgtgaaaattaaattctcttaattacctggtgaatgatactggttataataagattttaaaattgtttctgcagctcttaggttatctgaggtctgcgttatagctcccagccctgtttccttgttttcccatgtatcctaactgctctgcttcatctggatatgtatgctagctttcattgctttagctctgatttttctttgagtattcacaaaacctgtctcactacacagctgacttaattgaagttacaagagggagtaggaagtgatcccttgaatggatgtatagtgtgttttgctcactgtggtttaagaatatagttttgtttacaaatgattaatgttccctgttgaaaaaaaattcaatgccagtgtgagtcatcttgctctctcaccgtcatctcagtgttaaatttactaccattgttttagtttgtaaaatagattgttttgagtaaattctgtcttgaatgaatatttagttaacgttgtttaaagaaacctaataaccaaaaaggggtaagggtgccatttatgctatccaaattttatgaatttgtggtagcatgttttgactctccatgaattataaataacaggttattttgagatgttcattttgtaaatcttttgggaacaaacctcatttttctttgaatgtgattaagtttatttctattttactgggttgtaagagcaattatgtatgtgttttatagagtaataaaatgctttacttaaaatgaggtaagtactatgtacagaggtagaagaaaatatgaaatgttttggtagcaagaacttcttgtaaatatctacaataactagaattgtttttatgtaatatgttctagtcaacacaagaaggaattttgattttagagttaactcatatgtagataattatttctcttgcccacctcatttccattcctcttattaaggagaaattttcagatagagaaaagtgaattttatttcgttgagttagtagtgcatctctaaaattatgagaatccttttaattcagtatattaatgtgaaaatctataaaagtgccctgtcaagtatttatttaaatcttaaaagatgaatttaccatgaatttaaaatactaattctaacaaatgtgcatagataaatttctaacagaaacagttataatttgagttgttaataatggcttgatatagtatcttaaaatacaagtacttctctgtgtgttgaaattttacttagtgctcactttagtttacagactttattaaaaaggtgtagattccatttatcatcttagttgttttaacatctgtttacataggcctttcttttataattaatagctaaagcaagtaattgtgtggctttgacattacagattttaccaaatgatacattgaaaacatggacgttgaatgtatttgtcacttttaagcttctttttgatatctttgttgatgtagttgcctacttagacatttgagagtataatatggaattggattattggaaatgggttgtattgccttcaaattcactttcgtttaagactgtaaaatttgtatttccaagtgcataaaatgtaaagtgtttagaaatagaaataaaaactgctagactatcccccatattttatgtctgtatggtgaaaattagatttattaatagaaaagatctatctataaagtataatcaaacaaaagagtgcattagtcctgggaaaagatgtgtgttgcaattttacaaatgggattctctatataaaaatagtataattctccactggagtgataatgacacaaagatgcagtgtatgtgatatgttttatggaagagttgaatatttttgttttgctatgactttaaatagtttttccctcttaatgactttttatcccttccagcgcaacagaaaatttagggagatagcattcttttgcagttagatttattaatttcccagtaattattatttcaggttagaacatatgccttgtctctctctaatacataaacctgttttttaatagtgtagtgcagataataaaaataaaacatttgaaagctgccattttgtattttttccccattaaatagtttcactaaatagcttcatcaacataagatgaagatgcaataaaagataacaatagtaatggctgaagttatctgaaagatacaggcatatagaaactatatatataaaagagaagtctggattgtatttttttttcttttgcagttttaaaattttaagttattactgctaggcagtgtgaatgcatatatgtactgatgctcttaagatacaacctaggaaaggacataatagaaaaatttatagcagtggcagaagtaactcttaattgtagagcaaaaagtatttttcagttatttttatttcaaaatatcactaaactgtgccctatgaacatgttcaaactgaaaaaaaattttaaaaaaccttctgccctcttgactcttaaatcactttattattgaagtggtttcttgtcatttatactttcattaccgactgtttcagtggttacttatatccaagttaattgaatgtttcttgtgaacctctacctgaagtttgcatatatatgtattctttaaattttagtttatcaactttattctattttttttcttttatgtgagttttaaatgaactttatcattgtagattcccacttagcttgttttggttagtttataatactacgttaggtatttctatataggtggaatagactaaaagtaaagtaaatgttttaaatttgtattacgtctaaagatttgtacgtggatgtcattaatttaaatgtccatactctatttataaatcttacttacaaattttgtaacatggaacaccatttgatttataatacttgcagaagttcctgtatgctgttaaataaattaatttgtaaaataattttgcattttatatttagttcagcatttaattgttaaatgagtttatagacttgatatgtgggtgaatgaaaaatatttacattaaaatcatccaagcattttccatttatttttgtagtatgcatattttagaaaatgacttatgaatgtttccatcatcacagaaacagtagctgctatgttttcattactgcttcagtcattaaatttataaggcaataatatttaagaagaatgaaatcagaatgtctcagtttaatcatcaggtaaattggaacatttcaccaccacaaaggcagctactgtttcagttaattcttattttgtgttagaatacataacagtgaagtagatgcacgacttgtgtatgtatagttaagccagcgtttttctgtgtattttggggaatagcaaaatctacatcacaaattttgacacattacagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgtgtaaaaacaatccaaagagataaatccttgcatagacaccaaaaacagtgtctcagagaccttttcattttttccttagttaataactgtagtggatgtgaaaacaaacgagttgaattttaaaacatagcatttattagtgctatacagtcacattcctttcagccagtagtaaagttaaacagatgagtgatacagtacctgaatggtactgcttctgaggcaacactttggattgaaagtgctgcttttggttaaaggaactatgttgtggaaagcatattccagtgtaaatttgcagatgtgtgttttttttttttgtcacttttcataaggtttggagtaagttgcagtggcttttgatcatagtttagcccatttaatggtccttttacctagaatgttcttaagcagttaatgacaatttggaatacacagataacttgtagcttaagatactattttcatttaattctcctgtggagaatattgctttattttttactagtttcaggtcagttattaaaataaacatggaggttttaatgaatgttgtataatattttatagtgaaggaaaattgtggaaagggcaaagactttctctttcccttatgtatttaactgtgccaatctaaatacatactgttttatacaatgagatgcattacaagacttttctgttggagtgctctcgacattttggttttcatacctgaatgatcattgcattttctgtattttctaaaatggctccaattttgtgttttaagcttcagcttaagaggaagtttatgttctaattcttgactgagaatacagtattgagattctctgttttacagataacaactggtttttattactcattaagttcatttgcatcccgtagccctctgtaaatgtttcccctagttgtatgtacgtaaatgcacgcttatccagtgtatattagacatttttgtgctaaaatatattaagtgggatttttgtagcaaagcattctatttttctgttcttacagtgtgtgtgtgtgtgtgtgtgtgtgtgtatgcgtttttttaaccttaacttcagtttaaacactggtgtatttatttttttaagcaacttgactcttagaagccttagactgattttttcaataaatattcaaccaaaaattataaatttattaagatgtggccttacatatggcattccttgtgttcgtaatgtgagatttttgatttagataaatcaagattcaggattaaagtttcattgtaagttgaaatagaaaatgtattaaaatgtctaggcttctgggaggaagttcttatactcttctttcttggcattagaaagaagcaatatgaatttttgtgaatattctaaatattcaggcaacactgttc

SEQ ID NO: 13833 - DNA, 7231 bp, Human
  misc_feature (1)...(7231): n = A,T,C or G
ctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccattgtctgttactcttgtcaccatgcaacataaaagaggaacccggaggagaagacaaagagttctgtttaagggcatgttaggtttcaaataacctcaggtcttcagggacctcccagaaaggatgtccagggagtagtttgctatcagggtctagctcaggagacagatgtggcgctggggtattaatctgggagttagcatgcagttgaaagctcatgtgaggggagggaattaccgaggaaacaccatggaatccagcatcagcaatggaagtggagtcgaggggagagacttagggctgaggtctcctacactgaggtcaaggaagcaagtgagcctagcctggagtctactctcctagagtttgagctgcctagaagggtggtgccatgaaatagaagccctaacaaaagctaagtgcatcactgactatgagggaataaccagagagatgacctggggaaggaaaaaagggaagaaaatgccaaaaggttttctcctccagatgaagatctagaagcagcggggaaaacgaggatattgaaccagacccttcagttagcgcatttttcacacaggttataatacaattgattggatgacattcccatcctgagaatttcctgattaccataattacgtctcatcctttcatctttttaattggccatttacaaaccactttcaggagtacagggccacataatcaaacctaactaatgttgacgaataaataaaatgtttctttcatatctaataatacgtagcctgtcctagaactacaaccctgtttttaattgactgacatttaaaaccctgaatttttatttctgtatacaaaaaagagaactttgagacagtccctaagtaggcaattcgttttcacacgttcttaaaacatattctacactcccttcgctttccgccttcctgcctcctcagatctcgtttcttcggctacgaatctcgcgagaagtcaagttctcatgagttctcccaaaatccaccgctcttcctctttccctaagcagcctgaggtgagtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtcagtcggcctctgaggtccgcagagggacgtgatgggcgggaatggggactaccgggctcctccactggtgggggcgccggcccgccgtggggtgcgggccgcctggggtccgtgcggactccggaggtccggtgtctagtggtgagtggtggccgcaacgaggaaaaagttttgggggaaagaaaagtcgggtggaggcgtaacacgttactacaagagtgttgcgtacaggagggctcttaaagtgggtcatagcccgaaggtgttgagagagacggcactcactacctgcagccctgacagcaaaggggtttctgtagagcgggagggaggaggtgtagagggttacggttgagttgtgccctgcggatgcgtcgagtcattttacgcctggaagatccagcattggattgaaacaggctgtattttcttccaaagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatgtaagtggacaggaggtagatacccatttcctacttggggcttggcataagataccaaaaattaaccaaaacgttttattttctagcatgcaaatcaagaggttccaatcttcgtgttcactttaaggtatgcgattcatagttgtgatccaacagttcctcatgttccactcaaaaaaggtagctgcagtgatgactttcttaggacacctttggatttaccgtgaaaattaataaattctgagcagccaccttatatttaggcattgatgatcagggtgtaaggatgtagcgtttgtgaaattgagaagtagtaccagaaaaccatttgaaaacctagtgtgcagatcaagatggggcattttaattgtaattacatgatgatggaatttaaacgttttatagtgaataaatggagttttggagttttctctagcttcaacgaagtttacctggcttttagtcacaagtttttttaattgccttgcccccaaagaatagaaataactcgacattttgaaaagctgaaaattgaaaatttaacgtttactttaaaaattaaagctttgatctagttaaccaacactttattcttcatacttagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggtgagaattcttagttgccatttgaaaagacagattttaatggaaaagtgatgggataggataagaatggctaagatctgtgctgatgaacctatttctggttgctgtaatgacaggacaccttggattgatggtgaaataaaccatatcctaagaaaccgtgatatcagataaattcatcttggctgtaatgttaatttaaatcaaggaaaatgactcatcatctccattttctttcaggccaagcaatggggctggacacaaggtcggtggcccaaaaagagtgctgaatttttgctgcacatgcttaaaaacgcagagagtaatgctgaacttaaggtacccaaaccactaacatcctgtgcaacttgggtggttgtttaattaatgttggctgttcagatttatgtccttgattttcttgttttcagtaattaactcttaggattttttaaatttctacctgcagtttccacagaatgaaactatttccttttattttttttgagtccctttatggcaaaattctgtgaagatccagaagcgtgctctgtggtctctttaagcctaacacttagtatttctagttttctgctgtctttttacactggaggtactttaccaggggcttttacccctttttgtgacatacacctttggtagtatgattaattatcaaaatgattgccttagcagtgattaatgtggtttgtggcctaccttcataatggagagtcatgttgcatttcagaaagaaattgtttaaaatttcaaaaagtttaaacaatgacaaacttgtgttgacaaaacacaaatttctccattttgtatattacccattagccttttgcatttgaaggtctgggccagaactggaattagtttaggtctgtatggctccaaaccttctaagccatgctgagaaattttatcatcaagacttcgaattgggttcttccttacccctcagctctccacccgtctaaggatctttgggaaggccactcatagacaaaatgtatagcacactgagtttggtggcaatttagacatgtaaaggtgaaggcagacaactggttaaaaaaatgctatttgcagaataaaaggattgccttttaaaaatgatttcattgaggcaggactctggagcaagcctgggaattcatatttagcaatgatagtttgtggtgttttactaattaaggatgttcctggtttcattctccttcctttcttccccagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaaggtaaataagtagttgctcggttttgtttgtgatagtagaaagatttgtggttgctgtgatgactatcttaggacacctttggaataactatgaaagaaaactattctgagcaacccttttcacctgtcttattttggcttttgtaagtttgtttcttgactaataataaatggtaagttttctgtaatcccagcactttgggaggctgaggtgggtggatcacaaggtcaggagatcgagaccatcctggctaacacagtgaaaccccgtctctactaaaaatgcaaaaaaaaattagctgggcgtggtggcgggtatctgtagtcccagctactcaggaggctgaggcaggagaatggcatgaacccgggaggaggaactaggagtgagccgagatcgcgccactgcactccagcctgggtgacagagcgagacgctgtctcaaaaaaaaaaaaactggtagttttatattcagtacctcaggcccgtatgattatctgctgatggccccacttagatgtacatagccacttcaaaatgggccctctccccaaatctaagaagcttgttttcagtaattgatcacatttagttcttttaagtcaagaacctgagtgattctgtacacttctttttacatctaatgaacttaagttctgttgatttctaccatttaagtatttttcccccttagtccttaacgactaggtttcctgcctccagaataagctgaagtcctccaagatgtactgtggttttctctaagaaacttaacacatttttctttccccagatatcccagaagaaactgaagaaacaaaaacttatggcacgggagtaaattcagcattaaaataaatgtaattaaaaggaaaagaatgttggttgtctttattagtgaacatatttcaagtgtccttacaagatggatcaaatgaggattttttaggattagaactagaaacacaagattgtttaccctgcaccattaaaaaccattttcatggctgggcacagtggctcatttctgtagtcccagcactttgggaggtggaggctgactgcttaagcccagccagggcaacatgtcagaaccctgtctgttaaaaaaaagtaagtgtggtgtcacttgcatgtagtcccagctaattggggggctgaggtgggaggctgcagtgagcactactgcaccccagcgtgggcaagacagaacaagaccctgtctcaaaaaaagtttcattatcccaaaaggaatttgcagtggttttctttgcagaacaatccagtatgtgaatataccagttgatcatccccagttggaaatggctccattgagcattgcctttgagtatgataacagcactcaggctcaggttttgaagctttttaggttgatgctcaacctgtatcatttcgtcaattgataaaggggttttgtttttgctattaggaacgatggtactgtgaacgtttgtgtgcagatttttgtgttttcatttattgagtatatactagagtggaattgctagatcataaggttacctgagtaaacatctgaggaacttccaaatatttccaaaaaggctgcacgctacatttccaccaacggtttatgagggtcccagttttcacacaacttcgccaacacgtactgacatcctagcgagcgtcnnnnnnnnnnnnnnnnnnnntcagtacttttcgtttataaagtgatgtaactgcttcttttaagcaactgacgtttgtaaagttggccttaagttagtttgctctgcccttgaatttaagaaaccagcaaaactaatagcttatccacagttgcctcaacggcctagctgccaccttccgtgtgggtgccgcgccgtttgcacaggcatcatcctttaccgagatcctgcgttctgggtctgggtgtagtcaggtcaggctttcttcccgcagcgaagcttttagttgggcatctgggacgcgcaggactttcgcgctacctgcaggccgcagagccggaagcctcgccgcgccccttgggcaacactgctgcgtgctgtgcgaccccgggttgacgcaagcgcgcctttgtcgtccccgttgaaggcgcccattggctcggctgcggatcgtccctccctccggaagtgcggacattgtcagctgcgtttccgcggtcgcgggtgagtgtgcccgggctagcggcctgggttgggctttgtagctgctccgcaggcccagcccgggccgcgctcgcagagtcctaggcggtgcgcggcctcctgcctcctccctcctcggcggtcgcggcccgccggcctccgcggtgcctgccttcgctctcagggtaccttccttccgcgagcgcgctcctccgccctccgccccgccctcccctcccctctgtctgtattctttgtccaccaccggcgccctcggagcttgcatttgcctctccgatactttatattgattttgttcttttccgtggccaagtatcggtttcacatcctttctatgaccttcaccgttaggcctctgttctcgtctcttttcaatcattgtcattgactcaacctgtccccgctccctctgtctccactaagatgacatgctcaactggatgacttggaggaaggtgactttccctgttatgccttccctatttcggatggagcctcagactttaactgtctactctgttgtctggacttaagttgagtgaaagaagattcctctgcaacagctttaatccgttttgctcgctttgttggcttggagcgaataattaaaataataatatctcgtagccaccttctagacttttctgacccagtttccatatgtgtgaagtaaaatatcttaccgaagtattattatgaagattaa

SEQ ID NO: 13834 - DNA, 106924 bp, Human
  misc_feature (1)...(106924): n = A,T,C or G
tgtacacgtttcctttgttctgtacacctaatgtctttgacacttagtattttaggatgggaaaggggaagaggaacactgaatgtgcacttttaaatgggtattgtgcctcttattaagctctttattcacatcttatttctttagtaattcacagaattggaatttttggattaaagttctttttttttttgagacggggtctcactctgtcgcccaggctggagtgcagtggtgtgatcttggatcactgcaacctccgcctcccgagttcaagcaattctctgcctcagccccccaagtagttgggattacaggcacccgccaccacgcccagctaattttttgtatttttagtagagatgggtttcaccatcttggccaggctggtcttgaactcctgacctcgtgatccacccgtctcggcctcccaaagttctggaattacaggcgtgagccaccgcgcctggcctggatgaaagtttttttaaagggagtcttgctctgtagccctggctggtgtgcagtggtgtgatcatagctcactgcagcctcaaactcctgggctcaagtgatcctccagcctcagcctcctcagtagcttggacgacagctgcacacaaccatgcccagctaatagagacgggggactcactatgttgcccaggctagtctcgaactcctgggctcaagtgatcctcttgcctgggcctcccaaaattgggagtacaggcgtgagccaccgctcctggcccgaaagagtgtttttaaggctttaaaaaaatattgccaacatggtgaaaacccgtttctacaaaaatacaaaaaggatccgggcatgacggcgagtgcctgtaatcccagctactcaggagactgaggcaggagaatcgcttgaacgtgggaggcagaggtggtagttagcggagatcgcgccactacactccaggctgggcaactgagggagacaccgtcttaaaaaaaaaaaagttcccaagtctaaaaaaaaaaaaatcatcaatctgctctcaaaaactgtcgcaacaatttacaatctcatcagcactgagtatccatttccttgcacccttctcagtagtattaccattaaacaaacaaaatttatatgcgtcagtttgttgggctcaaaggagcctctcgacaagtttcctattccccacgctgcctctcctctggacacaggaaggggtccttttccttatttattttgttatttcattttcgtcaacacggctcggcttggggacaggggtcgggggcaggccggttaccgcagaggtggaggccgcgcggcacctggcctggagagctcaccacacagcgacacagacttcttctcagctgggtccacctgcttgcctcggggcgacagagggcgccacggcgtccgcgacggaccccgcccccaggcagtgcgccgcgctcccgtgacgtatttccgcgtcatctgccgccgaggcttgcccccattggttgtctgcgaggcaataggggcggagccgagtgggagtgtggaaagcgccgcatcccgggtgggaggcgaggcttccccttccccgcccctcccccggcctccagtccctcccagggccgcttcgcagagcggctaggagcacggcggcggcggcactttccccggcaggagctggagctgggctctggtgcgcgcgcggctgtgccgcccgagccggagggactggttggttgagagagagagaggaagggaatcccgggctgccgaaccgcacgttcagcccgctccgctcctgcagggcagcctttcggctctctgcgcgcgaagccgagtcccgggcgggtggggcgggggtccactgagaccgctaccggcccctcggcgctgacgggaccgcgcggggcgcacccgctgaaggcagccccggggcccgcggcccggacttggtcctgcgcagcgggcgcggggcagcgcagcgggaggaagcgagaggtgctgccctccccccggagttggaagcgcgttacccgggtccaaaatgcccaagaagaagccgacgcccatccagctgaacccggcccccgacggctctgcagttaacgggaccagctctgcggagtaagtatggggcgggcggtgaacctcggggcccggctggggaggcccgagccggggagcaggagcgcgcgccaggctccgatctggtttgtcacgtacgtctggggctggcagggggcgagaaactcccggccgccgaggtatcggtgactaagcactgattgtgttcctgactcagaccagttagcggatcccgcgggtctccattcctctctgtaccccttttcccgaccgttttagtggttcctggccactgtacagtcttctcccaagaaaataaaagctagcacgtctcccctgcctcctcccagttctgttctaaatgtgatcatctgggagtctggcctgtaacggggagaggaggctaatgttttggaaagaattaagatcgcatctgtgcttttgagaccagctcagggtattaagtgtggagcatcatcctcaccttcatgcctgacacctgtggggcctgagtgccttgttgcaggccaactgcctggccagcgggggcgtgctggaagtccgtgtggacttcgtggcttttccttgctgactttggaggttcctggtacttggccttcctgggaaattgctcaagaaagcggctttcttcttcatcctactcttcattcattcattgaacaaaccattttctcactaatgatttcctagctttccgtacttcaccaggagcccctaaactcctgacctgaggcatgaacaccatgacctagaaaccacatgctaggtgctccatctctgcagcttccagcgttgcttacaaacgagcactttatttcattaaataatcatgagtctgtttcctgggggtttctgagctcccacaactctcttgggttctaggtaagggacaagactatgtgagggaaagctgcttagctagctagagaaatagccagaaaagattaggttattattatttttttgcctttttttggttgttgtttgcccaaccttcaataaggattgggttcttaatcttttacctgcacactgcagactttaggaagctaattgatgaaatcagaataggcttggaccttatgctctttggtgatttctgtaacctcccttcctttctctagatttttagaaaattttattttttaaacttttatacagatggggtcttgctatattgcttaggctggtcttgaactcctggactctagcgatcctcccaaagtgctgggattacaggcatgagccactatgcccagccaactttctctagattttaataacccggggacctgttggcttgatgacttgttccatccctgtaatgatcacaaggtcgatggtggacctgtggtgtgtgttcagctgtgtttttcagacctgctcccaacagactctcttctttagtcccctctcaatcctgtggggtctattttgcataatactgacttgtataggtagttggattgcattattgcattgcaaacatttgttctttttttttttttttttttgagtcggagtttcactcttgttgcccaggctggagtgcaatggtgcgatcttggctaactgcagcctctgcctcccgggttcaagcgactctcctgcctcagcctcccgagtagctgggattacaggcatgcgccaccatgcccggctaattttgtatttttagtagagatggggtttctccaagttgttcaggctggtggcaaactcccgtcctcaggtgatccacctgcctcggcctccgaaaatgctgggattacaggcatgagccaccgtgcccagcccatttgttcagttttagtatacagtgtttcaccctcttaaaatagactgaaagtcatgactgttgttaggacaagttttgaccacagtggattctggctgagtgttatggcctcattatcctttcctatttgatttggaagtggatactgagtagaagtacctgttatcattctgttgtaatcgtgataccacaactgtattctctcaaggaggaggaatttcattaaaacagtaaaagcaggatgagaagaaactaccccagatttggtggcagaaaaatttggatggtactgggagagtctaaacagtggttaaaaggtaagggctctggagtcaggctaagtttgaagcctagctctgttgtggttttttttttttttttttttttttgacagtctcgctctgttgcccaggccagagtgcagtggtgcgatctcggctcaccacaacctccacctcccggcttcaagcgattctcctgcctcagcctcctaactagctgagactacaggcacgtgcaaccgtgcctggctaatttttgtattttaatagagacagggttttaccctgttggtcaggctggtctcaaactcctgacctcgtgatcctcccacctcagcctcctaaagtgctgggattacagcccggcctctgttgtggttttgtgacctggttcaagtcttttagtctaaggcttaggtttagtttttttcatctgcaaaaatggggctaatgatagaacctacttagcatagttgtgaagattaaatgaggtagtacatagtaaacttccaaagctgttggctgctggtgcctttgttactgcctaagtgttggaccaaaggaaactggaaggtgattttcattcatggtggtagattatgtgttaaggtgcctttgcttctggacaatcaactctccctagtttggttttttgtaccatctgcatctacctctatgactcattgctgtgttacaataggaggcatctttgtgtaggctgcccaagacaaacagggactgtttccctgtgtttcatagcactaatgagagggaaagctgtacacatcttcatctttcacttctgagagtgttcctcaagcaaaatgttccctatcttgggctaccagcagaaagaattctgttgctttcatgatttctgtgattagaccagggcacaattttgaacgttatcagacaatgtgaactaaagaggaagaaaatccattttgacagtaaagaactcttggtaccaaattggcaaggttgcttttcccttggcacctgtgcttacctctaacatagcccttacccagttcagagatggagttgggtaatacgggacctgaagttgatgcaagttgtaggggtcctcaaagaaaaatcatgcaaaaatagctttctttcgtgtattttgcagaaacatgtgagcatattactagggtcttaagtgttagaatgagataatgagataatattgttcctctgtttaaaatgttcttctggttctattgcagttacacaaaatccaaactccttatattggactatgagactgagtgatctgcctgttgtccccaccaccccctcccaccaatctctttaaccacatttcctgccactcctttcttccaccacactagtcctctttcacttcctctatgggatggtctatatgcactgcaggcctctgtacatgctgttccctttgcctggaatgaatcactcctccttccctaggtaggcaggaagcagtcttcacctatttgcctaaatgtcacttcctctgagatgtttataagcatctcagaggaatgtggtccctctttgtcatgtcacctgagctgctgcttttttttttttttttggtatgggggtcttggtatgttgcccaggctggttcttgaactcctggactccagtgattctaccacctcagcctcttgagtagctgggactataggtgggtactactgtgcctggcgctcacctgagcttttaataagacttaatcattgtaatttttcattggggtgttcttaatatttatctctcctgtacactataaactttaagcacagcactgcctttttgttttttgagacggagtctcgctctatcgcccaggctggaatgcagtggcactacctcggctcactgcaagctccgcctcccaggttcatgccattctcctgcctcagcctcccaagtagctgggactacaggcgcccaccactgcgtccagctaattttttgtatttttagtagagatggggtttcaccatgttagccaggatggtctcgatctcctgatctcgtgatcccaaagtgctgggattacaggcgtgagccactgtgcccagcctgcactgcctttttttgactcaccactctgtaagtacacccaaaatagttctggcacataataggtccatagatgtttgttgagtcagtgagtgaatgaaatttctaatatttgcacaacgggtttaataaacctttttatgtcttttccttttcttttcccctttatgctcattccttttttccccattttcttttgttttagtcacccactcaaccattctaagatatttatatggttttataattccacctgttagtctggttatgtgtatacccttgggaagtagaaggatggttttgtatgtatctgcttaggattctaaaatgttattgtgctacaaatctgcatttcatagacaggatagaataggttatgttgaggtaacaaccacaaaatctcagtaatttaacacactttcaggtcagtgggaggctctgtagattggagtcctttagggatccaggctgatcgaggcatcgtctctcaagtatacctacatgaggagggaatcttgtgaagagctacattcaggctcttaaagttttgcctagaggtgagccttgtcatttttgctgccatttctttggccagagcaaatcatgtggccatgttgaccttcaaggagggcagtgacctttttggaagggggagaaccacgaatatttgtgtgttttttttggtttttttttttttttttaagaaagggtttcgctcccactgcccaggctggagtataatggtgcgtgccaccatgccctgctaagttttgattgttttgtagagatggggtttcaccatgttgctcaggctggtcttgaactcttgggctcaagcgatctgcccacctcatcctcccaaagtgctgaaattataggtatgagccactgtgctggtgcaccaggagtatttgaacagaagcaatgaccatccctaaattttatatcagtttcttctttgttttcttttcttttcttttttttttttttttgagatggagttttgctcttgttgcccaggctggagtgcaatggcatgatctcggctcaccgcaacctccgccccccaggttcaagctattctcctgcctcagcctcctgagtagctgggattacaggcatgtgccaccgtgcctggctaattttgtatttttagtagagacagggtttcaccatgttggtcaggctggtctcgaactcctgacctcagatgatccgcctgcctcagcctcccaaagtgttgggcttacaggcgtgagccaccatgcctggccttagtttctttttttaaccaattttgttttgagctctattcatgatgctatacaatatgtgtctagttcattatttctcttggttgtagagcagtcatgtttgcctgccacattttacttatttatttctctagaattagacatctttgttgtttcccaaccccttgctgcctcaaacagtcatgaccatgcccatccttgcacatccttgtctcctttggatgttgtgagagagtttcctgtggaatgtactcagaagtggaattgctgggtcttagggtacattgtctctccttccaggataaggcatgttatctctttctctctctcttttttttttttttgagaccgagtctcactctgttgcccaggctggagtgcagtgttgcaatcctggctcactgcaacccctccccacaaggttcaagcaattctcctgccttagcctcctgagtagctgggattacaggtgcctgacaccatgcccagctaatttttatatttttagtagagacagggtttcattatattgctcaggctggtctccaagtcctgaccttgtgatctgccctccttggcctcccaaagtgctgggattacaggtgtgaaccaccgcaccggctattaatctctttctttaaaacaataccgttaatccagttgcagtagtgaggcagggtacctctcaagatctcactttttctttgaccttgggcaagtcctttctactttctgactcttggtttccttaatctgtaaagtggaggtgataattgtttacaaaatctttaccatggtggcctacaaggccctacctgaccaggtccttagttttcttccagtgttctcttcactcatgcactctagccacactgtcctttgtgctgttgggttgtaggttgggcacattcttatcttagaatctttgcatttgccattcctgctgcctggaaagcttgtctctcaaataccgtatgacttgcttcctcacttccttcacccctctgttgaaatgtctcttcacagaggccatctttgatcactgtaatacagaactccctgtcattttctaccctttgattttgccttatttttctttgtagcgctgatcactaactgatgttacatcgtgtataagtatttatcttcttctgccaccccaagtgtaagcttcatgatggttggggctttgccttgttcattgctcagtgtgtagaacagattctggcacatagaaaatactcagtagatacctgttgattaaatgattgactagatcctacctcagaggaatacctttgaagatgtataaaatttctttgaaggctataaggtgccgaataaccttaggagggttcactgcttggccttagtagcgttcatgattttggattttgaattgtttctatgtaaccctgaaacactcagacttacttattgcattcagggtgtagttcatagcatcagcagttctgccaggtttgtaaggaacacacatctgttagagtgtgaaggccctggaggaagaaaggttgagacaggttgatgtgcttttttttgtctcttatggctctttctgaaggttgatgtgcttttttttgtctcttatggctctttctgagatgtgtaccatgatgataaccaggaactttttttttttttttttttttttgagagacaggatcttgctcagacactcaggctggagtgcattggtgctcactataaccttgaactcctgggttcagggaatcctcctgcttcagcctcctaagtagctagtactaccggcatgtaccaccatgcctggctaattttaaaatttagagatagggtcttactgtattgcccaggctgggctcaaactccttgcctcatgcaatcctccctccttggcctcccaaaagtgctgggtttacaggcatgagccaccatgtctggcctgataagtaggagcttttgaagtggtttcacactgattttgtagttttgaacttggatgcttcttttgggtagttgatgcagtaactaatactggtgctgtctttcagaacagcttcatgtgaaaaaggcctgcttaagcctgtgtctttgggaagaacatctctgctgctgttacagcagatacagtaatagcaaagaaagtcttaaagatgatttagcccatggcaaggaaatatatgggactcttgtttgaatataaacactcacagaattccagtttcacttatttatgcacctttcaaagaaaggaagaagatactgtggtagagtacagtagtcctcccttatctgagtggcatatgttccaagacccctagtggatgcctgaaaccacagatatcaatagtaccaaaccctgcatatactgtgttttttcctatgcagtatatgcctatgatgaagtttaatttataaattaggcatagtaagagattaacaataataaccaataaaaaagaattataacaatatattgtaatgacagttacatgaatgtggttactgtactcactgtgggtaactggaattgtcaaagcaaaactacatttaagtgggtactcctgtagctgttggccctgccttgcctatctagcttaattttcctctgtttttccgttcacctgctgtggtccacttaccactttctttactctcctcactgtgccaccagcatactgttgcttaccttcttacatctgtctggtcttgctgacatggtttttttttttgtctgaaatgccctcctccactttcttgcatgatttttttttttttttttttttttgagacggagtctcactctgtcacccaggctagagtgtgcagtcacatgatcttggctcactgcaacctctgcccactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtctttatgatatttttatctactaaaacttttaacccactcttacgtagttttgagagtcatatatattttttaatttggtggggttaaggaaaacttcagcaattttcgtggggtatctttccatttgttcatgtgttcctctttctcattttagggtattatagtttcttaataattctcttgcgtcctgagttaatatttcaaatacgtaacattttgatgctgttgttattgaacatttttaagtttgtattttccatctcgactatggtttgttttgtatgaactggttatatccagcagctttgttaaatccacttaatctatctagtaacgttttttgattgaatatatatgcatttgtagatttactagtgtcatctgcaaaacaactttttcttttcaatgtgatagatattttatagctgtctcatcttgcgttgctctcagtagcagttctggtgtctcagggaacactattaagtgtaacgaggtttctcaaggacctcctgggccagggacttttctgttctttccaaggagctgtgaaaaaaggaagcagctgcccagatttatagaagcagagcttattagggctggatgggacctaacaggttctctagacctgggccttcatttgagagatgaggaaaccagacctagagaggtgtgaatttgccagagttcacactgctgcagtggaaggaggtggttgagcttttactcttatttttttatggtacatattacatacagtacatgttttcatttgggaaagttacttggtttgacagttttccaagtttacccaacattaaattttggtaactatgcaatatccttaaaaaaattattttcaagtaattatctgaagctctagaaaaggttacccctctatatcctcactctcctaggtggttgagggaaaagagaataaagaaaagttgtggggttggggctgggacagggaggaaagggtattttagtccttgatccttagtaggagggcctatttttaagcttcataatgtcagttttaaaagcagtggttttcaaaataaccgcagacgaaagtccccttgaaatggatgcctttctggaattgacctattttgagtttagctgttaccagaagggttcagaatctcgaatgctcttaaatgcatttacttttcagacaaagtggaaattgagtgcataatccacgtgggttccagattcaggttaaatttagaaatttggggagttgtggagagaagacatgaaatgagtcaatcgttgttttacaggtttgtctgaatccaggttaattatgtttccttctttattgaattataatttgtatatccaggttagttttacaaattagatcagaccctcagtccatttgagagtagactcagagtcagaattatttgccccctttgctgctttcataccaccctttagtaaacagtcctcaagaatgtccttatgtcggggagggcagacctcagaagttagcaagaattccaagctcactgtaaaccttttgtttaatggtttactcaaatccagatagaaatgctaccaaaatgccagcctgtatttcagctcctctttcttggagtctttaggatggtgggaaaacaggcagaagaaagctgtttaacattccaataattattaataatagaaaatgtatcctgctaatcaggcactcatttgcgtccactgataaaactaggtcattggagccaaggaaaggtaccgttcactaaaggaaagaccagtagatagtcaggcatggtggcgtgtgtctgtagtcccagccactcgggggctgaggcaggagaatcacttgaaccagggaggtggtggttgcagtgagcggagatcgcgccactgcactccagcctgggtaacagagtgagtgagactctgtctcagaaaaaaacaaaacaaacaaaaacagtggaatattgggctcagctcttaacacattatatttagagattgcaacacttcaatatttactggaatactcctataaaacggtctcttttgccttgttttattttggtaactaagtgaatgctgggttagccataaaggtagcttgctgcatttctatttcttgtgttctaaatcactgaataattttttaaaaaagtagttctaaagcatttccagttaaaaaggaaggcgtaacatttattaggggaagtcaaggggagaggtagtgaggaaagtaccagaaaccaccaacaggtgtttcggttacgttgaacaaagaatcagcttgatatgcaatccctgggaagagtttgtaaattcctgaaggagggtgagagctggaggggacacggtgagcggaaatggtgagcggaaatcagtggttcctgaggcacagaggacttgggttaccggaggcttgccctcagctgaggacctgggaacaattcctgagcaagttgctttcttgatagacaaggatgcatctgtaggaccactgctgttaatctgtggggcaataagaattgatcctactgcaagaaagagagtaggataagtcagaagacatggaacttgtatccctagaggacatcgcaactggaaaaatagctaccatttatgaaggcctacctcatctctttgcattcattatcttgaatttgcactaaaattctgcaagaaaggtcatagtattctattttacaaataaggaaaattaagctcagggaagttatttcataaggttgcacaactagtaggtggtagagctaagtttagactcaggtctgtcctactctgataggcatgctttttccacacggccctctcagtactgtgtaaaatgccagagggctttctggatcttcacttcccaaaactgctaaatttaaattaattaaaattaaagttgaaaaatcagttcctaggttgcactgcccacatttcaagggctcagtgtccatgtgtggctagtggctactatactggaccagcacggattagaatgctttcttcattgcagaaagttctattagtgctggtctagaggtcattcagttttgcccctttatttaattttttcccccttttattccacaaaggagaaaatgagggacaaagaaaggaagtaacgttcagcatcagacagctaattaatccagttttttggactggttgcctgttagattttcccatgccccacattcttcccttaaaaaaatgaacagaatggaaatgtgagaaatggagtgactccgctactctcccagctttgcctggcctttaaactagattctttctcccaaagaatcctgcattttaccaagttcaaagggcatgtccggattagtttccccaaaggaaatgaaatatatttgttggaaaggaattccattcttaatgtatgaaataacacttggattccctctggttctttctctgacttcctaccaagcgctttgtaattgaacttgcagctgctaaccatttgtcttccaaaggagaccaacttcaaacagttcaaatgacagagggatgtatactttgaatgcaagcagctgcctattatttgccattgattcaaatggcatttatgttagagtcaaatagatttagattatggccaaaattacaacaatagatttctaacttgtatgttaagagtaagatgtattaacagtcattgaactgatgtttagtgtttaactcatacataccaggcactgggttgcaacatgaactaaaaggacttttgctgaaatggaaaaagatgtcttattatggacaagttgaatgcattttaaattcctgtctgaattatattgctggtatttgccatccatgtaccttcctgtttagccttgaaattcagtaaaagcctcagtgtggatcatacttcatagctctgaagtaaagtgaggagtcatgtgcaaatgtccttttagtagatgctattaaaaggcatttaaattatacactccagtgtctaaatgacagtctgaagtgtatgtgtgtttggaggatgggcaagtgggagcaaaaggaggcattgtgctggggcgattgatatttttaggaagcctaaatgtaatgtttgatttcggtataactaacagactcatggtttagaaaagttgtctatcaaaaactgagaaattgaggttttggtttcttcttaaagaaatgttcaagtcatgtgcatgagtatgctcagagagattaaaaatggagagaaattggaatggtggcaaggtatccaggaaagtacctgtcttctctgagagtccaagggcaggagcagaaaggactttaaagatggtggcaacaggctgggtgcggtggctcacacctgtaatcccagcactttgggaggctgaggcgggcggatcacctgagctccgcagtttgagaccagcctgaccaacatggagaaaccccatctctgctaaaaatacaaaaaattagccgggcgtggtggtgcatgcctataatcccagctacttgggaggctgaggcaggagaatcaattgtgccattgcagtccagcctaggcaacaagagtgaaactctgtctcaaaacaaaacaaaacaaaaaaaaagattgtggcaacagctggaaggggtccccaggagctctgacacagggttttccaactgcccaacatcacggggttggggagcagagcatccagagggctccgtgtattgttttgtagtatagggtctaacttctagaaagttgggaataggcttctgagagttttggagtcaacaggcctgaatgcagaatgatcaaaagaagatggctattcctctcagagtggtgctggttttgggggccagcagtgcagtgaaaagcccaatttcccaatcctattttgaatatttctgcccccacaagcgtttcatttgactccagagactaaccactcttccagagggtctagaagtcttcaggcttcagaatttttaggccatagtgctttggaataacagtcccttgtgtagaaaagtgtgagatctgagctcttttcctggtcaacctgtgaagtcactgcatgaccaactctgtgcctcaggttttttctctgcaaagtgggagtgatggtaatggcttcctacctttcagggtttgtatatgagctgcacatagtttcatgggttaccactcagcatgctttcaagcaagtagagattacattttattgttgaaagaaatcttggttgtcttctgttgtaatcttaccttgaatccagggctacaaagaagggttaaagctagatatggctcatgcctgtatttccagctacttagaaggctgaggcgggaggattacttgagcccagaaggttgaggctgcagcgagctgtggtagtgccactacaccccagcctggccaacagagcaagacttcgtctgttaaaaacaaaacaaaagaaaagaaaaaccaaagtaaggttaagagaagttggctatgtcacacagtatgttctatttggaattttgtgacttttgagtaacataacctaaaggccgtgtggcacagtggaaaggctttgtagccagcagactttgagtttgaattctgaccctgccttactatgtctgtggtcttgtgcaagtgcttttacatccttgggtctgttcccacatctgtaaaatgggcataacaacatttatccaacagaaaggattcatacactctgtgtgtaaactgctttttgtgattaacaagactaatgataacagccaagattagatccccagtgcaggttgccttactttctatcaggtgagaaggagagaaaattcttagttcccaaagaacttacagtgacggggctcttcagctgctctttatccaacagacttagaatagagacaacaccgggcatacttgcaattttttaggatgtgcaggaagcaaaagaattattttcagtgaaacaggagtctgcaaaaggtgccttaggaaacaactgccacacagtacatcccaatatagactcctcccagcttctctagggcagccatctgcctgacaggccccacccagataagcccagctttcttctcccaagagtttaaggaagatttcctgatgtatgtgtgcgtgtgtgtgggggtggtatggggttgtgttgggcgggggtcaagaggggtgttaatttgggatgggtagtcactggcttttggtggcataactggaaggtaacactccctgtggctgaatcctgatccctgtggggatcagcgcatggttcatccagacatcttcctcagtgggtcctggcctctgctcatactatgtcttctactggggattcccgtctccacctccaatatacgtatgttgaaatcttcatcttacgtcaaagctcaacttggaggtcatgtcttatgtaaatccatcacagacctctcctccaccccatccgggcagcggtcatctgctccaccctccggagcactctgtacatattccatcacacttcagttacttatgtaattgtctagtcagcagaagatactcctctccaaagggcaaggttctgctaaccgctgtgaagcctggctttgagtttatgaggggtgattcttttcagtttataatttcttggcacaggagggtcacagtgttgttggtaaccgtagcatctgtcctgggaggctctgtatgctcttcattgttcatacatccatttatttcttcactcagccacatgaggcatgtgggatgtatgttatctctgcttgatacatgaggaaactgattctggttaaaggacttgtgcctgtcatacaggcagctaagagtgcctatagtcctttgtattgccttttcagccaacagtcccatcccagcccaaaggaggaaacatttggggagcatatactggtgagaacatcttccctattctgtggcgttctcttagccttatgcctggcacagaggaaggctctgggaatgtttgggccggatggatctgggagcctcttttgcatgccaagctgcatacttatccctagcaaatgctggtctccttgatggatatgtgacatgggtggctgaatttacatggcacctggtggcttctcacactcctccgccacgcctctggggactaggataggacagatggccacagacaggattctcagctctgcaaatcacatttgggaaaaagttaagtttgtgcaataacacaattttggtaacatggtttcatgctgctggtaaattctataacactctctggataaatcacacttcagcagaactcacttgggaacagagtttaatttcactgtaggtggctgtgattcccacccaccagtcttcacacccccgctaatatatctaggctgataaggtgaatgctgtgctaagcaggctatttctgggcccaggatagaattacattgtggtttttaaagaatttttttctgtatatttttctattcacagaccctttgaaagaagaattacattatgttaatcatccgtttccccatcagcacctttaattccttctccccagagtataaccacttgtcattaaaatgacagaggtggaaaagatcttgatagttcagcctcctgtatgtatatatgaagaggttgaggcccagagagactgggcagcctactcagttgtcagatggctggtgaagacctgcatccggatccgttgacttctctcctgtgcagggcccttgttttttgccctgccctactgcttaaccttgtcttctgtcttacaactaggggagagtctatggcatgttcagtttgaaatgaataaaagtgaatacttgttcattgttaaaggaccccaacacagaactaatttcctgttaacccttacattttctcttgacatatctttggtgaggaccattaaaggcttaacacatttctgtacagtgacatgcagtcctaggggttaactgtgtgggtttgagcgataggatttaacttttaggaaaaaggggaaaaaagaaggttgataagtgtatttggagagagagaaaaaatagttaatttttctcttaacagttaatctgaaatgataacacaattgtgccttttggctctaaaatcaccatatttttgatatataatccaaaggcaggtatccagactgctgaaggcttattaaaatgtaacaataggtccaagtctagaacttgaaaaaacttctcatttgtcaaagaagttccagtattctacattctcttgctaatgaatttggggagccttggaagctcagcaactgggatgccatcgacaggtttgcggtcctctctagtctggggtaggtcttaaggggaaacttttgggagggacacacatacagtacagtgaaactgtacatgaactactcaggagacagatcacttggcagggatgtggcgatctttgtacatatttgttctgctttactagctacattgtaagcttctgcagatgaagagttcagccttgatgtcccatctcccgcccaggcctgccatgtactagttgatcagtaaaagtggaatgaatgaaagccagtgttagtttacagagcttctgtgggacagaagctttgttcagttgagtttccatcaatatcaaatgcaatgttatgtgcgttgagtttcttgataactgttcttgaggtttctttttttttttggtcctttttgactgattaagcaaggctggactggttggagaccccagatgggaccaagaaatgcgaatcctgcctggattgttgtaggtagagtgcttaatatggggcctggcatgaaggaagttgggagtattatctggtcaactggagtttagttattaggttgtaaatgactatggtaggtacagatgtcatgaatatactagggtctcagggtctgaaagagttaaagctcctctcagaatagcccaggcagttcccaggaagtagcttcttaggcaggatgtggcaaaccagtgggtaaatgagagcccttctcctttggaagaaaaggaagtaggtggggagaagtgaagaggaagagcttggtagacaaatctttttatctgcttcttttttaagtgccagacagaccctgcagatttttgatccaaagtgaccaaagtcctaagaatgccaataatattggttttgctattgtcttttccctgcagctaataactcaagtttaagatccactagagtgttgtttcaatagattttgttttctaattttgatcattggtgtattcttcagtgcgctttcaagattcacagtgaatgtggtgtcatccaaaatcacattcttttctaaccaaggataagtcagaagaaaagatatatatatgtatattagaaaagtgtctctttaatgtgtttacctatttatccattttaaaacacattcccacccattctctgtccaggtgctcataacagtccccttgtgatacaggacaagagtgtgcttccatttaaggcaggagagagatcttgcccatggttagatgaccagttaccagcagagttaatagagggctccagaccctctgacttcaagttcagggttgtttccacaattttggtcctttttgttaagaatatagtttatacattggagacaaattattgatggaggctgcaattttgcaaataaaaataaccctcaaaaatccagtaatgtgtatgtgaaatgaaataggtgaactgaatttggtgagctttagtgtcgctgtaaaagcaactatcctttgtaaacttactgcatagctaataatgtaaatcagtgttgtgtttaggaatcagctccaggactgtggtttgatatgtggaaacacctctgcgtttgctgtgggctggtagacagaatgggctggacctggctgtactgtgaaaggcttctttgagctggttctttgaccaggtaatgaaaacgttaagcatctaaaaacgaagtctttaggaggcttccaaggatctggaaagctgaactcagcaatttttagacttcagttttctggacaggacagctcttctagtcaaggaagccagtatctcctgcatttgtgtagctcttgactccatttctttgaaggtttcaaatgataatttttacacttacccagataatctactctgcctgagcacataattggtaatttggcccaaagactgcatacttagattgcatcctggtcacactgatatcttacatgcattttagatatttaaatattaaaacaaatattcttatggcaatttttgtttgttttgagatggggtcttgccgtattgcccaggctggagggcagtggctattcacaggtgcagtcatagtgcactgcagcctgaaactcctggcttcaagccatccttacatctcagcctcctgagtagctgggactacaggcgcatgccactgtgcctggcccttgtggaaattttatttatttatttattttattattttattattattattattttttgacacagtctctctctgtcgccctggctggagtacagtggcgtgatctcggctcactgcaacctccacctcccaggttcaagcaattctcgtgcctcagcctctaaagtagctgggactacaggtgctcgccaccacgcccagctaatttttgtatttttagtagagacagggtttcaccatgttggccaggctggcctcgaactcctgacctcaggtgatccacctgcctcggcctcccaaagtgctgggattacaggcatgagccaccacgcttggccccttgtgtcaatttttagaagctaggatgtcaggctgctctttactgaaccctaaatatcctgaagcattctgggctggtgtctaggaccatcttgatcctaagggaataagcttgactcttctcctcttggtgcttcagcactgcattttcctcagtgggattggaacaagcattaaagcaaaacaaaaagttgtaaatgagacttagggcaactaacctgctctagccagaatgaaaaatttgttgacgtttaaagttctctgacctccctgtgtctacctgttcataatactaaaacaaattatgaacttaagtaataagaaaaaagattatggcagatttcacacagctaaaataattacaagaattcagcaaccacaaaaatatttctcactgcaaattctcatccatttctgtattgtaggcattttttttttcttttggttttagtgtttattgtatacctcacactgggttagactcaagtttgggggatacttccagcttaattgagggtatgagcatgtaattgcaaggcattgtgacacatgctctaactctggtgtgtgatacagcacaggctatgggaactcaaagggtgagtgactaacgctgtcttgaggagtgaaggactgtatccccaaagcagggatctgggcctgtcttggggtttttgggtcttctgttttgttcttatttttttcttcttcttctttttttttttttttttttcctgtaaccttatttatggtgaagggacttttttttttttaattgtttacacttgcccttttgatatcctctgcattcgtggctcttatcatcatcttagacttgtgaacctgcctcaggtctctgttaggagtttctggcctatctggtcagccatatactgagtagctccacacgtagagcctgcaggttatctccaactcaccttttccaaaaaatagatttataatcctcttgtcacctgtgatgacctctcatgctaactacccagagtttgctagagcaattcacggaactcaggaatgcactgtacttctgattacaattttattatagcaaaaagggtacaaatcaggagcagccaaaagaagaggcatatagggtaaggcctgggagggtcccagatgtaaagcttctggtgtcttcacctcttggaatcagggcacagtcactctcctagtacattgatgtgtaacaatatgcacagagtattattaaccagggaagctcccctgagcttcagtgtccagagtttttactggggccccattacataggcatgattaattgaatcattggccatgtgattgaactgaatctctagcccttttactcactgcaggttaggctgtattacatggctcagagccccaaccttgtaatcacatgattggtctttctggtatggccagcccccatcctgtgtcttttttttttttttccccccagtcatcttttatttggaggttaattcccattaggatatgaaaggatttagcaacgatcgagactgtgttccttatggaggggctcgggccaagaaggtcatggcggggagtgcagagcatgccctcttcttcagtggtacttgcatagccacttgtgcttgagctccttgtaggaaaggcagtagctgaagagcacgtagcttgccagcaccatggtaacccctgagatgctccccttcttcatgtcaatgcactgcttgtagtaccagtaataacctcttcaaaatgctccggtagtgccactattgctgaagtcctgcatcaagctccagcttggcagctcccctagtttgacctccagaagtttcttgttcttcactggtatgactgatgccatcttggagtcctggtgtccactgtccctgtgtcatctttttaagcaaactgtgggcccacattgaatcaccttattggcgtaaactatcagggcccactgtgaataacaaagacactcctattacttgagaaattccaaagatttagaggttacctccagaaaccagggacaaaggccagccaaattctttattatacaacatcctcctaacccccaaagctgtctagtcctcatctttgtgatgtggtaagtcagatccctctggatgcccagccagaaacctggcatcaccctcaactcctccctccctccccccatatccagatcatcacccagtcttgccaactctgccttcagtttctgtcccagctctttattgcctggctgctgtggtgttcaaattctcatcttgtcttgttttccttgttgccttcaagctgactttcctggcttggctctcccatttctaagttgccagactcttggttccaaaatataaaactgatcttgtcactttctttagaatttgctgttgcagaacaatgtgtgtattataattccattttcgttaaacaaaacatactatatatattcactggaaatgtatttcaaagaaatctagaagtgtatatattctacagtgttaagagtagttatctgagggaaggtggaacatagagttttactttagactatatatttctagactagttggattttttcatactgagcacacattagtttttttaggcctggtaatattacagaagtcaaattacagaagtcaccctagctccccactcgccttctaaacctaattctttagcatggtgtgctgtgcccttcatggtctagctcagtttacctgcagccccatctcatcactcacctggatgcatccactctcaggatattctcaggattaaacttggggattacattttctgaccttcactttccctcccttatcttagatggaattagggagtttttctgtatgttcccatagctcccaatgcctaccttgcttttagcattttgacctaccctaccctgtagattgttgttacacttgtatagttgttgctgtacttcttcttagtatcctttcctatgtttggcttacattgtgatacacacccccctacaatcccccccaaacacacacacccacccacacacccacctttcagactgccttgtgaggacagggatcttgttgtcttcatagcctagcctctagtatacatagtgcttgtcatggagtagacgcttcatagtaaatctgcattgtattttcacagctgtaggcataaatggatgtaacccagagattcactcaagttacctatcccatgcccttttctagattggagcactccccgaggtttagattctcatcatcagttctgctgtgggactcacatttccctttctatgttttttctctttttgctctgttcttgaactagcttggaatttggctccttttccttggtttccactataacaacagtgagaacaaagtatacacaaagctatttgtgtgcacagcagattggacttggaaggtttggggtggggagggtatattatattacagcaatacaggtaacttaaaatctaatggtgttaggtgtctttggtcttaaatgacctttgctaccctgccatggtacctcctttccttctgctcttgctgctcttaacgagtccccaaacaagcttttctcattttattttgcaacgtaattcagctctccagctgcacctctacatgctgttcagggctgcttctgcccaccccaaggctgaggagcaggcccttctaaactatgggcaagctttctggttctctagtaggaccagatcccactgtgaacaggtattgttagcccaaagacttatttccccaccccacatcttttttcagaagacagaagcaagcactatcagttttggttttaattaagtttctttctgtgatattacttcttctaggtaggttttgactttactagaccaattgctgttaatttgatggtctaactagtaattttctacccctagtttaacatgttgaatgttgaccaggtgcagtgtcttacgcctgtaatccccgcactttgggaggcttaggtgggtggatcacctgagccctagaagtttgagaccaatctgggcaacatagtgaaaccctgtctctacagaaaattacaaaaattagccaggcatggtggcacgtgcctgtagtccagttacttgagaaactgaggtgggagggaggatcgcctgagcccaggagattgaggctgcagtgagccatgattgcaccactacaccccagtctgcgcaacaaaatgagaccctgtctcaaaaaaacaaaaaacctatgcttaagtgagcacctgcattgacttccagtcctgatcctgaaatcaggattccctgaaggttgttggaaagtgatctgggggtagggttttttcccagaggtgatacgtgctcagggatgagatttgctgaccctcctgtgtgtatttgggcagggagaagggtccagctgtaacaaacagctgttcttgtatataagggggaagcaagtctggagaattgacaatttctcctgtggactagaattggagacatattttgagtgctgtgtttcatctgactgtatcttcctgcccttgggtgtgcttctgggcactggctactgaccttttgccttggggacccgaccgtacttatggttctgttaaagttggagggtgtccaggttcttggcatcttcaacaaagaattggacaaaatgcacaaagcaaggaagggacgaagggatttattgaaaatgaaagtaccctccacaatgtgggagcggtcccaagcataggagctcaaaaggccccgttgcagagttttggggaatttaaataccccctagaggattccatttgttattttgggtacgctgtatgtaaatggagaggttgaagtaaagttacaaagtcatttgcggcctatgacctatggagaggatatttcctgttatagctgaagagtgaattggccttatgttccctacctccagacccaattttcctgcctcagttctgagttatgaggtttaactgattgggtcacattggatcctgtaccttctccctcattgaagagcaaactgcattcctgattgatagaccagcatgggccattattatacagggattttctaaaaagctctttttctttttttaaatttatttaaactattttttcctcattatgactggaaggataaaagatatttttctatatcagcttctcaagaacagggaatgggtaatgtccagtacgtcatctttctaaggccatagccagcttgtcttttcagtaacagccagccccactgtttagtggtcaccaccagacccagggctccctttgtttttctgatgctgaccacattttttttttttttgagacggagtctcgctctgtcgcccaggctggagtgcagtggcgggatctcagctcactgcaagctccgcctcccgggttcacgccattctcctgcctcagcctcccgagcacccgccaccacgcctggctaattttttgtgtttttagtagagagagggtttcaatgtgttagccaggatggtctcgatctcctgaccttgtgatccgcccacctcagcctctcaaagtgctgggattagaggtgtgatccactgtgcccggccttttttttttttttttttttttccttttttcttttttttgagacagagtttcactttgttgcccaggctggagtgcaatggcgcaatcttggctcactgcaacctctgcctcctgggttcaagcgattctcctgcctcatcctcccaagtagctgggattacaggcgtgcaccaccatgcctggcttcttttttgtcttataacttctgtttttttttcccccctctccctccaaactccatcacttttccttttgtacttctacagaagcctgatcctttaaaaattatctggctgggcgcggtggctcacacctgtaattctagcactttgggaggccgaggcggatggatcacctgaggtcagggattcaagaccagcctggccaacatggcaaaaccccgtctctactaaaaatacaaaaattagtcgggcgtggtggtgcatgcctgtaatcccagctactggggaggctgaggaaggagaattgcttgaacctgggaggtggaggttgcagtgagctgagattgtgccactgcactccagcctgtgtgacgggagcgagactccatctcaaaaaaaaaaaaatttcatatgcggctaatatgaaacacattttatatactgggacagaaggaaccataggctgtcacttgttttaagcaacaatatgacaccccctgtctgattcaggatgttattcaatatttgaggaaagtctttgtgagtgggtggtcctcatgactccagaggctcctctgtgtgtgtgtatgtgtgtgtttttcaacatgactgcagaaacatgttgtgggaaggtaatttatgtgatttcagaagactgtttgattcccagggggtgtttttgtttgtttgtttctttttaaaggataggaatatgtgattcttattctacctgggattctttttaatcaaacctgtttttatgacataaacaaaaaaaaaagtctgttggcttggaaactacctgatttacagtgaaattaaaaataaatgccttggccaggtgtggtggctcacacctgtagtcccagcactttgggaggtgaggtgggtggatcacctgaggtcaggagttcgagaccaccctggccaatgtggtgaaatcctgtctctactaaaaatacaaaaattagctgggcatggtggtgggcacctgtagtcccagctactcgggaggctgaggaatgagaatcacttgaaccggggaggcggaggttgtggtgagccgagatcacaccactgcacttcagcctgggtgacagagcaagactctgtcaaataaatgaatgaacgaatgaatgaatgaatgaatgcctttcagccgtgcacagtggctcacacctgtaatcccagcactttgggaggccaaggtgggtggaccacttgagcccaggagtttgagaccagcctgggcaacatggcgaaacccagtctctacaaaaagtacaaaaattaaccaggcatggtggcccagctaccccaaacgctgaggtgggaggatcacctgagcctgggagatcaaggctgcaatgagctgtgactgcactgctgcactccagcctgggtgacagagtaacaccctgtctcaaaaataaaataaaataaatgtctttcaacctggggaagccgattgaaaaggtaaataaatttaccttatttatttttcaaaataaatttacctgtcctttcattttcttatttttttattttaagctttattcccctaatacttactcttggcatatatatatatatatgtgtgtgtgtgtgtgtgtgtgtgtgtgtgtgtgtgtgtatgtgtgtatatatatgtgtatatatatgtgtgtatatatatgtgtatatatatgtgtatatatatatgtgtatatatatgtgtgtatatatatgtgtgtatatatatgtgtnnnnnnnnnnnnnnnnnnnncatacatacatacacacacatgcatacatatatatacacacatacatatatacatacacatacatatatacacacacatacatacacacacatacatacgtatatacacgtgcatatatatacttatataatttttatatgtacaattttatatatatgtacacacatagacacacacatatatacacatacacacacatacacacacacacacacacacacacacacacacacacatatatatatataaatttttttttctgaaacagggtctcactttatcacctagactggagtgcagtagtgtggtcttggctcactgcaaccttgacctcccgggttcaagcgatccttctgccttggccccccaagtagttgagactacaggtgcatgccactacacctggtgcatttttgtattttttgtagagatagggttttgccatgttgcccaggctggtctcaaactcctgagctcaagcgatccgctttggccttccaaagtgccaggattacaggtttgagccaccttgcctggcctggcttataatcttttttttttttccttaagtgctaactgcgagttaatggtttataatattcctaatcctaattctataccattgtcgctgggtgcagtggttcacgcctgtaatctcagcactttgggaggccgaggtgggcagatcacttgaggtcaggaattggggacgagcctagccaacatggtgaaatcctgtctctactaaaaaaaatacaaaaattagcctggcatagtggggcctgtaatcccagctacttgggaggctgaggtgggaggaacacttgaaccaggaggtggaggttgcagtgagctgagatcgtatcactgcacttcagcttgggtgacagagtgactccatctcaaaaaaaaaaaaccaacaaaaaacagcaacaaaccaattctataccattgttcacagattagcccctactagaatgccctctttctctttttttttttttgctatctcattattttatatcattctagaccagtttgagcctcatatccccacaaaacttactctagcatatcctcaactacacagctgcctgtgttctaggccctttgtgagaattaggcgaactgtggtacagtcattgccccagaatcacttttgaagttggtggtgaaaccataaaagcaataaaggtaattaactacattgtgcattttccccagattatttattgcatgaacaacatgaaaacgtggggattaaatcaccttctaccctgccacagcaactgatttcatttatctatgtttctttgcagtgcttgttcgtatacattcatttttcccccataggtaatacaatataattcatttgcacctgagagtgtttgtcaaaatttctgatacctataagtgtgtgtgactttggataagtcacttctcctgagacccagtttctccgtctaaaccaggggtttagactacatgtcctgtaaggcaataatcatgaaaatatcttctgttgtggagtatttcacagttgcttgaacatttgtattgttattctttaccataactacatgggattgagtggaatatgatattccttttttacggattgggaaactgaaactgaggtagccaaagaaaacactcttaggtgaaaatgaattatattgtagtacctatgacgggaaaaaaatgaacgtatatgaacaagcactggaaggaaacatagataaatgactttaaggttgactttttatctctggtttttagcagtttgactatgatgtgtctaggtgtgggatttttctttttttaagtattgcttagggtgccctgtgttttttcgatctggatgtttgttgttttttgttaattttgggaaattcttggcctttatctcttcaagtatttcttctgtcctgttccctcttgttcatccaagaccccaactacatatatgttagacgattggatcttgtcctacaactcttggatgctctgttctgatttcttttattctttttttttgctttagtttggttaatttcttttttgtttttttgtttttttgagacaagctggtcccaaagtctgggcctcaagtggtcaagctggtctcaaactctgggcctcaagtggtcctcctgccttggcctcccaaaatattggtattacaagcatgagccaccgtgcccagcctccatttaaaaagttctgtcgacctatcttcagggtcactgattgttccctcagctccatgtaatcggctaatgagcctgttgacctctgatgccacgtttttaaaatttctagcattttaatttgattctatttttagttttcacctttgctgaaattcctcatttgttcatacatgttgtcccctttaacatattaatcatagttattttaaggcctctgtctgatagttccaacatctgggtcatctgagtctggttctgtttatagcttatctcttgataaggttgttcccccccatcccacctcccaacccttcttgatttttgtgtttttctttccttttttttttttttgaaacagagtctcactcttttcacccaggctagagtacagtggtgcaatcttggttcactgcaacctccctcccggtattaagcaattcttctgccttagcctcctgagtagctgggattacaggtgcctgccaccatgccaggctaatttttttttttttttttttttgagatggagtttcactcttgttgaccaggctggagtgcaatggcgcaatctcggctcacggcaacctctgcctcccaggttcaagtgtttcttctgcctcagcctcccgagtaactgggattacaggcatgccaccaccatgcccggctaattttgtatttttagtagagatggggtttcaccatgttggtcaggctggtctcaaactcccaacctcaggtgatctgcccaccttgacctcccaaagtgctgggattacaggtgtgagccactgtgccccacccatgcctggctgattgttttatttttagcagagatggggtttcaccatgttagccaggctggtctggaactcctgacctcaggtgatccacctgccttggcctcccaaagtgctgagattatggatgtgagccaccgcacccagccatgtcttgtgcatttttttttttgaggtggagtttttcttttgttgcccaggctggagtgcaatggtactgtcttggctcactgcagcctctgcctcctgggttcaaatgactctcctgtctcagcctcctgagtagctgagattacaggcatatgccaccatgcccagctaatttttatattttcagtagaggtggggtttcgccatgttggccaggctgatgtcgaactcctgacctcaagtgatctgcctgcctcggcctcccaaagtgctgggattacaggcatgagccaccgtgtccagcccgtgtcttgtaatttttgattgaatgttggatattatgtggtagaacagagaattaggtaaattgtctttatcctcagaaatgggcatgcttttctgtcatgctgttagtttgtgttaggctgttagccagatttgagctgggtttgggctttctttttaatattaacttaaatgcatcacatgcttcaaatttctccagtaatgggtttttatcttgcacttagcggggagcctgagttgcatacatttattttttttctcagtctttctactgcttcttcagctctgaactgtcccttaatcctttgccacaaagggactctttctctacactcttgcccctttcctaggggtaagctgcagttgctttttagtggttcttggcttgaagtagaggtagggaggttctcattgtcttgatccaatctcaatctttttttttttttttttttttttgagatggaatttcactcttgttgctgaggctggagtgcagtggtgcaatctcggctcactacaacctctgcctcctgggttcaagcgattctcccgcctcagcctcccgagtagctgggattacaggatgtgccaccaagcccggctaattttgtatttttagtagagacagggtttctccatgttcgtcaggctgttctcaaactcccaaccttaggtgatctgcccgcctcggcctcctaaagtgctgggattacaggcatgagccactgtgcccagcctcccgtctccatctttagcagaccctgtgagtatagaccttgggtttggggttttcccagcattctttcccttcctgtgtatggcagccagactttgccttgtatctgcggcaggtcttgggcaggagaaagttttgtatacctccttcagcagttagtagacttttgctttctgttggtgttgagcacagctttaggcttagattcttcatcaactaggagaagctgtgcttcaatacagttattcgtttgcatggttcctaatgtgcttcactcaatttagcagaatttttttttttaacctcttccttgacgctagctgcttgtgcaaatcacatcttggccgcctactcttcttcacttgctgacagatgtgtaggtgagaaaagtctcatagtcattgttcctgaaagaagcttccagacccacttctagggccagtgacatatgcaggaaatcagctgcttctgggccaggacagagctggtcttttttttagtgggggatggcgggcagtggggcaggggacattcaaaatttattttccaacagacagatagcatcagcaggtacaactacaagggtatctacatagatcatacattcacaaggcattattagttcaacagtgagaaagccactcgtgggttttctgtaacaatatcccacttcatagtgtaaacaggtactattttgttcacttacaattccggaaggaagggcacaccttgcaggggggaagaaaaggggaatcctaaagtaaggtgcaacaattaagagacaacactttggctaacaatcttggatccacatttcagtcagggccttccacatagaggggaaagacttttctctcagaagttagaatctttcttcctcctttcttgttaaactgagagcagtgttttgtttgctcaatattacatgtacaaaaggagattagaagaaaatgcatcacaaaaccatcttgaacgttcagctcttcctgccaatacatcacaactcttaggttttagacggggcctgggaatacgtaagtgttttttctttttttttttttttaagtgaaagcaagtttattacgaaagcaaagggataaaagaatggctgctccataggcagagagcagcccagtaatcttaaaataggaaaatagacactatggctacaaaaaataaaaaataaatgaggtagataaaattttcacacccaggacttgcctgttccaacttcatagccttcatgaaatattcatcaagaagacaaaaaaaaaaaaaaaacctttataattacttggcataagtcgcaacaagaaaattcaacaaaaaaattagcatgtatacctgtgataggaaacacatccttccatgagtttcttctcaagaatgaaaacctagttcttcagtagagtaggcactggcaaactaagtcacctgagatttcctgctcaggtgccctcttcttctggggttcaggaagaggaaggcatctaagaagtgtgggaaaggacattggcactctcagggcagagctggtctttcacattgtggtgaaactactagaaagaagaaaaacatgcttgtggctactctgtgcctgcgaaataggtgtgaagcctttaggagtcagaagacctgggttcaactctaatagtcacttactctgtgaacttgtgcaagtcacttctctgtagtttttcttacagttaaaactttaaagttttgtccagtgctaaaattctctaatcctaacatatccttctgtagtgttacaaggatagaactctccaggtaaataccaaggctgtgcttttctgcaagcatagtggttagcttctcgtgttatatggtttgaagccctagttgttacttcttgcctgcatataaaccccattgacgatgatctcattttgtttttcctttgagaataaattgattgttttgtcttcccaggtctttgagaatgcgtaagttccggcactagaaggccctcagtaaagtaactaaaggagtatatacagctaagggcaatttaagtcaaaatgtgataataagtaaaaagtggttgtagaaattaaatgagagtgaaatatttttttaaaagttggaatcatctaaatgctaaatgcatatttaatattgttttgctactgtaatctaattagttaaaaagaataacatttgggctgggggtggtggctcatgcctgtaatcccagcactttaggaggccgaggcgggcagatcacgaggtcaggagatcgagaccatcctggccaacacagtgaaaccccgtctttactaaaaatacaaaaaattagccgggtgtggtggcgggcgcctgtagtcccagttgctcaggaggctgaggcaggagaattgtgtgaacccaggaggcggagcttgcagtgagccaagatgcaccactgcactccagcctgggtgacagagcaagactccatctccaaaaaaaaaaataataataataacatttgatagtatttattgagcacctactgtgagctagatgagtgtgggtgagctcctttagtctcctgacaaccccaagatgtgtttactactgttagccccattttactgatgaaaaacctgaagcttaaggcttttaagaaacctctctggccaggcatggtggctcacccctgtaatcccagcactttgggacgctgagcctggcggatcccaaagtcaggagttagagaccagcctggccaacatggtgaaaccctgtctctactaaaaatacaaaaattagccgggcgtggtggcaggcacccataaacccagctacttggaaagctgaggcaggagaatcgtttgaacccaggaggtgaaggttgcagtaaaccgagattgcgccattgcattccagcctaggcaacagggcaagactctgtctccaaaaaaaagaaacctctccaacttgacgtggctattcagtggccaaatagggcttcatacccagatagcctgactcccaggttcgggtcagggtacatttttatgtatcataaaagcatagttgatgaattctcagaaaccgaacacaccatataaccagccctcagatcaagaacagggcattactagcacccaggaattcccctccttccctatattagggttcaccagagaaacagaaccaacagcagttgtgcgtgtgtgtgtgtgtgtgtgtgtgtgtgtgtgtgtgtgtgtgtgtgtgtgtatgagagggttattgatgtttattttagggaattggctcatgtgattatggaggtctggtaagcctaaaatctgcagggataagccagcaagctgaagacccagggtagggttgcatgcggttcaagtccagaggcaggctaccagcagaattccttcttttgggcaggtcagtctttgttctcttaaggttttcaactgattggctgaggcccattcacattatggagagtaattcactttaagtttaccaatttaaatgttaatctcatccaaaaaacccccacaaaaaccaaaaacattttcacagaaacaccatggcccagccaagttgacacgtaaaattaaccatcacacaccccctcttagttacttccccctgaagggtaatcactttcctaatttataattgcaaagattagtgttgcccttttttgaattttctttccttttttttttttttttttttttttttgagacagggtctcattgtcacccaggctagagtgcagtgacgcgatcttggcttactgcgacctccgcctcccaggctctggtaattctctcacctcagcctcctgagtagctgtgattacaagcacacgccaccacgcctggctaatttttctattttttgtagagatggggtttcactatgttggccaggctggtctcaaacaactgggcttaagtgatcctcccgcctcggcctcccagagtactaggattacaggtgtgagccagcatgcctggccttgaatttttgacagatggaatgacatagtgtattagtctgttttcacactggtttataaagaactgcacaagactgggtaatttataaagtaaagaggtttaattgaattacggttctttatggctggggaggcctcagtaaacatacactcacggcataaggcaaaggggaagcaaggaccttcttcacatggtggcaagagagagaagtgccagtaggggaaatgccagacacttataaaaccatcagctctcatgagaattcactcagtcacaggaacaatgtggggaaaactgcccccatgactcaatcacctccctctctcaacacatggggattacaatttaagatgagatttgggtgggaacgcagagccaaaccatatcatatagtacatactcttttcgtgcctggcttctttcacagagcacatatacacattcctagaatttgatttcctataggtagttgaacagcctctcctagagtaacctgaaggattgaggtatgggaaggtatagaacgccttccccaagatgttgactggggctgtcccttgccactgggtctgcactgcggcgccccccccccgcccccccccaacacagatgggctagcctggggtggaatctggaagttggtaagctgtgcttttggcactctctgccttcctctttcaggtccattctcctttcctgtcttactactccttatacgcctaactctcaatcctcagccatccatggtttgactgttcagagacccatggtgccagttctttttgttctcatattgccccctgtccattgaagctcctcagcccctcaacttgaacacgcccccgttcttattctgtacctcctcagattactgtcacattgacggacttgaacctcagagatagacaacttttcccttccctcctctcctccttcccatatacttttcttatggatatggaactgaggaccagaaaggaaggtaacttacccaagatctcacagatgggtaaataggggtagaaggtgtggatcaagggattgtatgcagcctttatctctaggtgctggtctctcttaccttgggtctgtctcttttgcctctcctttcctctttccctgctacttgacttgtttcctaccctggtagcattcctgcttgccagatgccacaggggaaggagaactttacaactccctgggctctctggtaagaacacccacctgcacggggacccttcctctccttcctacagtgattggttgtcatcctcttcccttcctgcagtgtaccctcctggcagaggcaaggctgccatcgaggctagagcaaggctcagattgggtggcatgcagttgtggcctatttctgtttgctgtgtggcagtttggagatcccatttctttttctggatatcacccccctacctcctcctgtcattccttaggccagcctctaaattcagtgaccatcagggttgaaaagggcagtgtggggcctagaaaggagctctctcctaggagttaggagacctgccagcagtgaactgtgtgaacttgtccctttgggcctcagttttctcatctgtaaaatgagaattggataagttggtcttcaaggtccctccctgagatacattttatgctgctgcttgatttaaaccactgagccacaaatgaaaggttccagttgcaacagtgtaattaggcttagcagatgggtgagatgaaaggaaggacatgttcttgcccataggattatcctttcccacccatttccttgcacctcactggtgtttccaaaaagcaaatgacaacccttgtttttctctgcattcccattcaaacctttaatcttcttttatcttgatgaacttgtatttaccgttagacagccatgatgcagaattcacattacagtgtgtggttctaactctgccatggtgaatgtgatggaggttggagccgatcacagctggtccctggagagagggctgtgtgtgtcagatttattgtgctgcagctccagttttgttttggtttagtttttaaatccccagtgtcagttttgctgatttcagttaaaactaaagattgtgaagggagacagagacaggttcatgccctctgagttttagagattggtgatatagtcgttgggtgagggccctctgtcttatatcctttgcttaaaacatttcaccttggaaaggcagaaattagccttgttgaacttcaactccctctgcaagaggaagaaatactgaatactgtttcattattgatatctttttaatgagtactgaaagccactacaggatctttgtttcaccttcagataaaatgtttcatctttcattctctgaaaaaaaaaattgagtattttaagaataattaaaggaaaggcagtagtttctggatcctgccgttgctgccttggcctctcctgccttttctccacttccactcctctccctctatattagtgtagaaatgtgtcaaaaatttcttgcttcttccattagtttctattttgacccaccccagtgaatgaaataagcatagaattgttacttctattttacagaagagaaattcttatttttttgttgtttttatttttaagttcaggggcacatgtgcaggatgtgcagatttgttaacataggtggacctgtgccatggtagttttctgcacagatcatcccatcacctaggttttaaggccagcatctattagctattcttcctgatgctctctctcctcccccactgacaggccccagtgtgtgttgttcccgcccctgtgcccctgtgttctcaccattcagttcccacttactagtgagaacatgcggtatttggttttgtatacctgcgttagtttgctgagaataatgacctccagctccacccatgttcccgcaaaggacgtgatctcgttcctttttatgtctgcatagtattccatgatatatagaggagaaatctgaaatgtggcaaggttaagtgacttgtccatggtcacacagctggttgatgaacaatttgtgataagaatccaggactcttgaatactagtgatttgtcaacacgattccatctccagtcctcatccatacacacctgccattaggaaagtctttgccaccccagcctatagtctttgtcatttctctcactggccagcttctgaaagtacaggtcagaagccagttcattagctggtagggtgggtggttaaacggcaaggcataggaggtagaggagggagaaaggaagcacaaagctcaggcttagtttttcctccagaaggtgtaagaattacttatttcaaagagtcagaaaagtgaacagagtcagcattcccttttcctttgcaaattgattgaatttctatggcgagtattagctgcaaggcagtgttaatctgctccagcagatccatcatcagattgatgtgcaggggagacaggattgtctctggtgcaaaggcctttttgtgtagggcacaccatctttatgtatgattgaggcctggtgtgttaaatgcctcacactgggatcttacccatgtttgtcagttgcctcccttgaaagtattgagctttttgaagataatatagcatcatggttaaggtaagacattcgttctctctgcctgaatttgaaacgtggctgtgccacttaccagctctttgacctttgacatcttagttcacctgtctgtgcttgagtttgctcatctgttctaattaggggttgtggattaaatgacttaataaatgtaaagcactgaggagagttacacagtgttgtgaggaaagcagtttttcttccatgcagccctccttccattcccccatcatgcacagtgtgtgtgtgtgtgtgtgtgtgtgtgtgtgtgtgtgtgtgtgtgtgttgacaacttttcgaatctgcatttctagctggcctgctgagcctgtcaggcagctgtaacctcactcaggttttagctgtggggtccatctacatttgacatgtgtttctaaatgtggtcctcagtaagctcctttgtggggagaccttggagaaaggaaaccagagagtgtgcactgtgcacccccagccacacatgttctgggttcccacaccttagggactggggacactgcaagacatagccgaaccttggatgaaaatattgagtagctgcctcagtttgcttggactgctatgataacatatcatagactaagtagcttagacaacaatagtttattttcccactgttctggaggctgaaagtctaagagcagggtgccagcatggttgggttttggcaagagccctcttcctggcttgcagatagctgccttcctactgtgtgcttgcatggcctttctttgatgtgtgcagcaggtggggtggggggaaaatcagtgaggaaaatcagtaacctcggccttgcatcttctttggtcccatgcatgatgttatttgtaaggcagtgtcagatctcctcatacatggagaggcattaagtcttcatttccctgtcttctagaggtttgggatagagggtgtgaaggaagagcagattatgcttactctatcttttaagctcagaactggggtgtgtgtgttggcaggaacaccaacatgatgatgtataatgaaggcctatcttgtcacctgtgtcacttcagccaccccacacaattgtcactgacatgcttcacctcccgggacttcaatttgaaacccaatgaaatccagtgaaacacagtggaaactcttaccaccttcctgttaaccaactcacaggagtgatgaacacttttcagttccctggatgaaacactcttgagcaatgcccacagcatgctgaatgcactgcaggcaggctgctctctgccatacccactcgcttcagcacccactggctgaattatgtgcttaccaagagccagcttgttcccaaacccatttgttcagctgtagctggtattgtagttaagtaatgtatttaggtatcagataaactgatgaaatgtagctgcaaatgaagtgatttttttcccctatgaacactagttaaaagctgtggaaagactcataagtccaagtcactaaaacacattactgtcaaactagatgaacattaagattgggggaaatcataaaactctagaattttatattgtgattactctgcaagtaatcacaatataactttaaccagctttaacaaatcaggaataggaaattgtcgacaatgtattatgttctggtccatgtgcgaaggatgatgtggacctcttaaccagtgggtcctctttggacccttattcaaagagtcttgccctatgttaaagaatgggcgaatgaatgcagatttatatacattgagtaaaaataagaattttagatatgtaatttttatgattttttgctgtgacttttttgattaacctggttcctggacctgattacattgaaaatgaggatttctactgttgtgattcagtttaaagttggtttgatttcattttagtgaatttagggtattttattttgcgtatggtaaaaacaataaaaccaacagtagtggggctttttaaactggggttttaaagcaaattaaggtggctcattctggattttagtaggttcttttgttcctctcattgacttgcagcatactgagtgagaaagacctaattttttcactttataaatgaggaaattgaagccctgagaggtaaagcatgttggtgatagtcatcccgggtggctggagtgaagtgggcagagccacagtgggagggggcctcctctctagcctcccactttgattatctgtctggccccagacctggagctttctttccatgataggagtacttctttgggttgacttctctggtgacagtattgacttgtgctccccactttggaacaggaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaaggtgagtttgccttgattaacaggtaattggattatttctcagggtacttagaagcctggggaccagggtagaaggaagactgattttactcaatacctttttgtgctgtttgaatttttttttttttttttaagacggagtttcattcttgttgcccaggctggtgtgcaacctccatctcctgggttcaaacgattctcctgcctcagcctcctgagtagctgggattacaggcatgcgccaccatgcatggctaatttttttgtatttttagtagagacagggtttctccatgttggtcaagctgatctcgaactcctgacctcaggtgatacgcccgcctcagccccacaaagtgctgggattacaggtgtgagccaccgtgcccagccgtgctgtttgaattttgaatgcttgttatctatattagattatggataaacacactaatgactgtgttagtgtattaatccccatcccatctggaaaataataagtgactcttttttagccttctgtgtgctgtggaaggaatgccaggatacctgtttattacttatcaagtgctggagaagctgctttcattcacccagccccagcgatgcacaaaacaaggatttcaagttgtttccctcttgtgctccagccctgccagtgaatcccctttatcttcctgcattatagcatctgaactcctatcatagcatgtacttgtagagctggacttccctttcctatctacccttggtcctcttttggaatacagccccttgctccagagaggttgggctcttcaatgtttttttgcacatggtgttcactcctgtgcccataatttttttgtgtgctgttgcttctgtcttttcaaacagtgcccattttctaggtccacctcttgtctagcttttaccaggtgccccagcccacactggtaaccactgcatccatgttctctgacactcgctgtctgtgggatttttttagaagttcaaccttactacgtaactatttaatgtgactgtcacttgtctccccagctggaacaagggaaaatgttaggatgacataaggtagcaccttagactttggcttagtctcaaccacatcaggctcctgagctcaaggaagaatcttttgggcagcctaggttagcatacctgagttcctcatacccttctactttcacaactcttgagtgtgaaccaagtcctcaaggtcaatttcttttcatatctgagctccaaagcctctcttggagtaagccctcccttaactttgttcctgtctaggctcccaggagccgaggcacagctggaacagcctccagtgccaatgcctgccttagtacaatgacactcatttcttggttgagcagaaacttgtttgtaacaacttaacctgtttctcctccctctaccttaaagagcttaaacatttaacaagactatatctttcatcccttcctccctctttctttcataaaacctctctttcttccacctttctccagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggtatgtgacaccctctcagcctctggagcaatggccttaagagttgggtggctctggcctaatctttggtctgggaggtgaccagctacctccctgctgctcctgggatccacatcactatctggggcatctgggaagtctaactgtagagcttgggatattcacaagatggcaggcctcctttctaggtccttgcctctcttgaaggaagtgggcagtattcctggtgggtgtacctagagcacctctcatagtttttttgattctgattaccctaagatgtgatgtaagtaaaatctggtaaatacagtttaaatccatttcttgtgtacaatgctgtatgctaggtgcaaggctctggagttaaaaagatgacataatctactgtaagggcagcctgaagggtttctctgggtttctgtatgatgcacgttagtggaaggagagggcaatggagagagagggcattcatgggctaattaatcatatgcatgttagctgccaatcattttaccactatgttcttggagtccctccttttcttcagatataagtcttccaacacactgtgcaacttagggaattctgcaagtattagtctttgctttattctccctgggctgatggcttagagatgagggctgacgtgagtctgcacacttggtggctgttgtgctttcagtccagtattgtgtctctcagctcctaccccattttattcctgatacttgagacctgccctgacctttagaatagggatcctggtgtgcagccttaatgaactttagaagaaccctcctgggaggattctctacttgtgcctccattattttgaacctctcttcattgtaatgatcacgaagtgctgcatccactgttataggcatctgctgacatttgtgggtgccatatggaacctaaatcctaaaaacgtcttctgcacatctaaaggttagagaaagtgcttgttccttctttcctcaatgagagcagagcattctctgtgggaagcatatgaacatttctggcttggtcctagtgcttggcctggggtgctgattattttctgcttgggtcttggcttcccctcagggagctgtttcttatcccttgggtctcttgtgttcttttttttttttttttaatttatttttattttttagggtgatgaagggtttttttcccctttctttttttttctttttgtttttttagacagagtctcgccctgtcacccaggctggagtgcagtggcgcgatgtcggctcactgcaacctccacctcccaggttcaagtgattcccctgcctcagcttccagagtagctgggattacaggtgcgcaccaccacgccccgctaatttttttctatcattactagagatggggtttcaccatgttggccaggctggtctcgaactcctgacctcatgatctgcccgcctcggcctcccaaagtgctgggattacaggcatgagccaccgtgcccaaccaatctttttatttttcttacattgacctcttttgagatactaggaggcttcttcatttacattgaccttttttgagatgctaggtggcatccttattctggaattctttattcactttgaacttacagatgttgatcacatctcttgtgcccttgccatgtcctccccttccttcaagccttcctcctccttcaggagaaaatgacactggaaatgactggagttggtttcccattctcttagcccatttccagtgactgcaggtcagtttttccccccatggatttggctctctggaaatagtgagatgttcctgcacaagtctctggagttatcgtggagagcatgagactgggaggggaaaatgtttcaagggccaagcacagtgtctggcacctgttaggtggtatgtgttgagtgactgaatgagagtggccaggatggggaagacctggtcaggcttgggactcgatgggggagggttaggccttggagcctgccataggaccttttggccctgggtgtacatagacccagagggcagctagaatagtcagtcagtggtagtgaagaggctcaggtgctgccggagcgtctagatgggaccatgtaggaagcagctgtggcctgaagaccaggcagccatgagagccagagtggctttctgcttcagctctgggcactctcagcccttccttattcctgagcaggtcctgttgcaggaaaggccctgccctggcttcctctggatggaaaattctgactgtgggctgctgcttcccttggaccttctgctttgcctcagcttcagtttttcaaaggtgttgtcaggtagagagacctctgttcgatagccacatcccagcttctgaaggtctttggtcctctctctgtcacagtctttgcatgagttttgtgtcatgaatattattttcccaacactttattatgaaaattttcacaggctgggcatggtggcttacgcctgtaattccagcactttgggaggctgaagtgagcgaatcacctgagttcaggagttcaagaccagcctggccaacatggtgaaaacccatctctattaaaaattacgaaaatggccagacacggtagctcacacctgtgattccagcactttgggaggctaaggcgggcagatcacctgaggtcaggagttcgagaccagcttgaccagcatggagaaacaccatctctactaaaaatgcaaaattagccaggcgtggtggcacatgcctgtaatcccagctacttgggaggctgaggcaggagaatcacttcaacccagaaggtggaggttgtggtgagctgagattgtgtcattgcactccagcctggacaacaaaggcaaaactcagtctcaaaaaaaaaaattacaaaaattagctggcgtggaggcaggtgcctataatcccagctactcaggaagctgaggcaggagaatcacttgaaaccaggaggcagaggttgcagtgagctgagaccacgccattgcactcctgcctgggtgacaagagcaaaactccatctcaaaaaaaaaaaaaaaaaattctagcatgcaggaaaacctgaaggaagtgtacactcgtacacccaccacctagattctacaacttatgttttgagatatttggtttaccatatatccatttctccgatcaattttggggggcgcgtggggttctgtttttgtttgtttgtttttgagacagggtcttgcactgttgcccatgctagagtacagtggtgcaatctcagctcactgcaacctctgcctcctgggcccaagtgatcttcccacctcagcctcctgagtagctgggactacaggcacatgccactatgcctggctcatttttgtgtttttagaagaaatggggtttcactatgttgcctgtgctggtcttgaactcttgggctcaagcaatctgcctgtctcggcctctcaaagtgctgggattagaggtgtgagccaccacgcctggccctgggaatgtgttttaaagtaaatttgtgtcatcagcattggttgagccctgtcttctaaagcactcagccaggggctgatctttcctagaaataagctctgtgtgcactgcccagtctgaattttgagacccaaggagggaaattgatgctctctgatcagaacaggaatgcttttatctttggggaagtagattgctgctcaggttggtagctgagccaaccggagaactagggacccagagttaatggttcttgtgcaggaataaaagcttttgaactgttattttcataaagcatttgtctcttccatagaaaaccttcacaaaagcaccattgacttagttaataattggcttctaaaaataagcacaatttcagcagcttaaggcaaggacttggcaacagtgaattagaattagaaagttgtatggttagttgcaggcaaccctggggaatcctgactggtgtatgccccttacattttgtaattccatcgttcacactatactctgcttgaagctctgtggaggttaaagggaagagagccaatgtttcctttttgttttaaaattaactgattaattttacagatacggtcttgctctgttgcccaggctggagtgtggtggcatgatcataggtcactataactttgagcttctgggctcaagcagtcctcccgccttagcctcccaagtagcaggaggacaacagatgtgcatcaccatgtccagctaatttttattttttgtagagatggagtctcactactacgtggcccaggctggtcttgaactcctggcctcaagcaatcctcctgccttggcctcccaaagatttgggattacaggcatgagccactgcacctggtttgttttttcctttttaatagagatatttctcttaccaacccccaggggaagtgtaaaccaagacagttatctgggctgccccctgtcctaggctgcatttagggtcagttgagaggtagtgctggctgagcacagtgactcacacttgtaatcccagcactttgggaggctgaggcaggagaattgcttgagcccatgagttcgagaccagcctgggcaacaaagtgagactccccatctacaaaaaaaatcaaaaatagctgggtggggtggcacgtacctgtggtcccaactacacggaaggctgaggcaggaggatcacttcctcctctgagcatcagtagcattgtctgttctcttcattcaactgtttgttccctgccttgtttcagaggaggatttaaaatgccttacctcttatgaatatattctgtctccctaaggagagagtgtgttctatctttatcttaaaggtttaaaaaaagacaaaaaaaaaaaaaacctagttcttacatatacagaggcatttgataaatgatagaagatgatgataactgctcaatatagacaggatactttagaaaatttgttttgagttttcaggaattaggtctacatctgagagtaattttaagttgcaagtggtaactggctacacctgaagccataggggaacttaacctatttctgccttgatacatcaggatccccttagtgaggcatttcttcaagatcgcaggttaaaatgtagaaccccttaacgggagcccctggtatgtgagccctgcagagcctggcttcacaccatacttgcatcctctcttgtgctctctttccactgcctctgtccggcaccccattcatgtcatctcatctccttaccagtctctctgcctccagagtcttgtttgtctccctcagctgctgtgattctcatctttaaacactcaggttggattcttttacttctgactccataaagtcaagtcccggttccttggtggggttctggtcacagccggccatttctagcttgcacctcttcatgcaccaacagtgaaatgaccacatcatcccaggagtactcagcaacgtgatgcgtccctgctttgatcttattgcagtgctctgttcttctctcccttttctcctccccttttccaggtatagaaatcatgttcatcctttgagtaatattcagctcaaatgccatcttttaagtgaagtcagaattacttctcccttcttctgcatgtctgtatcactttcttaggcagttatggtttcattgtaatgttgggaaaaactcccagaccgtgtttttcctttactgtcacaccacaacaatcaacacagaagacttatgtgaccaaaagtgtggagggattttctctacactctaagcagtggacaccagctgggtgtcctcctgtttaattctgacactaccagatgatcatgtcagatcccatgggttcagggctcagtccccaagactgcaccaccaccagttgccagtctgggcctccaaaatgtctgactgactggctttaagttgggactcccatgatcctatctttgagttcgattaatttgctggattggcacacagaactcagggaaacacttaattttactggtttattataaaggacattgcaaaggatacagatgaagagacacataggacaaggtatgggagtggggtacgaagcttccatgccttccctgggcgcaccaccctccaggaacctccatgtgttcagctgtcctgaagttctctgaacgcagccttctggggtttttttgtgtgtgtattttttttttttttttttttttttgagacagagtctcgctgtgtcgcccaggctgagtgcagtggtgtgatctcggctcactgcaagctccgcctcccaggttcatgccattctcctgcctcagccacagccgaaagttatcacttgaaagaatagttagaacattgtcactaactggtctggtattctcgatcttaggatggaggttctctggatcaagtcctgaagaaagctggaagaattcctgaacaaattttaggaaaagttagcattgctgtgagtatgttatgaagtttttcttctaagttcctcattgataagttaatgagtcggtaagaaatggacaagagaggaagatgggaagtcaatgaggggaaagtttataagaaaagtggtattttctcactagactcttccctgtctggagtctatatacactattctctctcacattagaatgagaaaagtgactttctttatattaaaatctgtgtgtcttgaaaaacaggggccaggcacagtggctcgcacctgtaatcccagcactttgcgaggccaaggcaggaggactgcttgagcccaggagttcaactccagcctgggcaacatgatgagacctcgcttctacaaaaaaataaaaataaatagctgggcgtggtggtgcacacgtgtagtcccagctacttgggaagctgaggtgggaagatcacttgagaggctgcagtaagccataatccatgattgtgccattgcactttagtctgggcgacagagtgagaccctgtctcaaaacaaaacaactctttataccatgtaaaaagatggttgcttgataaggcaggttaagaaaatgaaacaaaagagtaaaaaataaggggctgggcgcggtggctcatgcttgtcatcccagcactttgggaggcggaggcgggcagatcacctgaggtcgggagttcgagaccagcctgaccaacatggagaaacccccatctctattaaaaatacaaaattagccgggggtgttggtgcatgcctgtaatcccagctactcgggaggctgaggcaagagaatcgcttgaacccgggagggggtggttgtggtgagctgagatcacggcactgcactccagcctgggcaacaagagcaaaactctgtctcagaaaaaaaaaaagcccaggcacggtggcttacacctgtaatcccagcactttgggaggccaaggtgggtggatcacctgaggtcaggagttcgagactagcccgacaaacatggagaaaccccatctctactaaaaatacaaaattagccgggggtggtagcgcatgcccgtaatcccagctactcagggggctgaggcaggagaatcacttgaacccgggaggtggaggttgtggtgagccgagatcgcgccattgcattccagcctgggcaacaagagtgaaactgcgtctcaaaggaggaaggcaaatttgtgatgatgataaatgaagtattttcctagagtattttaaaatagattgagtatttttcttatcaccagtattttcttttcttttacattccctttcctctaggtaataaaaggcctgacatatctgagggagaagcacaagatcatgcacagaggtaagaagttatttgctagttattttgctttgaattttagatataatccaaaggctgttgcttcctcttttttctatgttttgttttcgtgtaaaagccttttaataacatgttaaatcttttattaaaagtctttgtttagtttggtggctgaggcagcaactcctaccctctttttggtcttgctacacctattgcctatagctgtgatggacaatagtcatagtcaccctggaagcccagctaagagcctcaaccagcacttagttacccagtctccggtgtcactattcactggaacagtgaacagtgcatgtgcatatgcctaaagccaggactggccagctgcatatgagttttactataaaagaaactgatttattgctgggtacagtggctcatgcctataatcccagcactttgggaggccgaggggcggcggggggaggtcgggggggtggatcatgaggtcaggagttcgaaaccagcctgacccaacatggtgaaacccccctctactaaaaatacaaaaattagccgccagccatggtggcgagcacctgtaatcccagctacttgggaggctgaggcaggagaattgcttgaacctgggaggcggaggctgtggtgagccgagattgcactgctgcactccagcctgggtggcacagcgagacacagtctcaaaacaacaacaacaagaagaacaaaacacattaaaaaaagaaagaaactgatttattttaataaaggtacacatacacttaaccatgtgaccataccatcttaggcatttgtccaagataaaatataacatgcatccacacaaatgtttaaagaagctgtatttcttgtagaaacaactgaaatgtccttcaacaggcaaagagagaaacaaattgtagtatatctatacaacagaatactcttcaacaataaaaatgaaaagactactgataacacctaactttgaatttcaggaacatttatgctgagtgaaagaaggcagatacaaaacagcccaagctgtttccatttatgtgaaattagagaataacaacaaatccatagtggcagaaagtagatcagtggttgccttgaggggtctagggagagattaaaggagcatgaaggaactttttggggtgacacaaatgttacatctttttttttttttcaagagcacacatccacttctatgtattgacttctcattagtttaaatccttgaagggggctgggcacggtggctcatgcctgtaatcccagcattttgggaggtcgaggcgggcagatcacctgaggtcaggagtttgagaccaccctggccaacatggtgaaaccttgtctctgctaaaagtaccgaaaattagccgggcgtggtggcgggtgcttgtaatcccagctaatcaggaagctgagggagaagcttgaacccgggaggcagaggtcgcagtgagccaagattgcgccactgcactccagcctgggtgacgagcaagactccgtctcaaaacaaacaaacaaacaaaaaacattctggctaacacgatgaaaccctatctctactaaaaatataaaaaatagctgggcgtagtggtgagtgcctgtagtcccagctactcaggaggctaaggcaggagaatggtgtcaacccaggaggcggagcttgcagcgagcagagactgcgcaccactgcactccagcctgggcgacagagtgagactccgtctcaaaaaaaaaaaaaaatccttgaggggtacagcatcacttggattctgtttccaatagccatagtaggaagagtgcttcagaatttggcacaaactatgccactggttctgtgggcccgagttacctttctccagattactccagtgttgtttggtttaccaccaggagtcactgtgttgttctttgctttgtatacataagcacatctcttgcccaaatagaattctgtttcatctcgggcataaacactttcaattttaggaagaactgcctgctcccattggttccggataccctgcttatagccagcaaaaatggccttgcaccacagccttccacatatttccttttagaagtcctgttcccagcaggcctccatggcatccaagatggcgggaagtgcaaatgttatatcttgacaatggtgatggatacatggctatatacattcgttgaaagtcagctgtccactaatgtgactgcattttatagtatgtaaattatacctcagtatagttgcttttaaagaagatgaagccagaggacaggaaattggtaaacatagtgctgtcggccatgtcccttcagccacagcactgccaacactgactggtgttgagaggagagctgaagcggagatgagtggactagggtgggctgttggaactgactggacagcttacaagccccgtagattaggtgatacatcactggtgagcaagctgagcactgagtggagccacctttgacatggctgactcctggatgcattttttttttttttgacgtcccccttctctcccctagtgttctttttgttagtctaacttcttccagatactgatctttcaggtcttcagttagaggtcacttaattatgacagtgtttgcaagtgttggagggtggttctgattcagtaggtctggggtagggcacagggacctgaaaatttagaaataggcaattagctgggcgtagtggctcatgcatagtaatcccagcactttgggaggccgaggcgggcggatcacttgaggtcaggagtttgaaaccagactggccaacatggtgaaaccccgtctccactaaaaacacaaaaattagctgcgtgtggtggcgtgtgcctgtaatcctggctactcaggaggcttaggcaagagaattgtttgaacctggggggcggaggttgcagtaagctgagatcatgccattgcactctagcctgggcgacagagactctgtctcaaaaaaaaaaaaaaagtttaattgtaaaaaatatatacataaaatttaccattttctcaagttttcagtgtatagttcagaggcattaagtacattcacattcttgtgcagccatcaccaccatccatctccagaacttttttcatcttacagacctcaagctgtgtccatgtaacaactctcaccgggcgtggtggctcacacctataatcccagcactttgggaggatgaggtgggcagatcacctgaggtcaggagttcgagaccagactggccaacatggtgaaaccccctatctctactaaaaatacaaaaattagccaggcgtggtggcacacgcctgtaatcccaggtacttgggaggccgaggcatgagaatcacttgaacctgggagacggaggttgcagtgagctgagattgtgccactgcactccagcctgggcagcagagcaagactccatctcaaaaaaaaaaaaaaaaaaaaaacccactatttccccctttccccatccactggaaaccaccaatctaccttctgtctctatgagtttgactactctaggtacctcatatgagtggaattacacagtatttgtcctttagggactggcttgttttagttagaataatgtcttcaaggttcatccatgttgtatgatgtgctagacactggttcttaagtaagtgctggttctaatgctgtggtccatagccacattttgggaaacactgcattgggggtagagtgagtagctaggtgggctgtgtagaaagaggagtaatggcagcttgtcctagtgggatttgtcgggagaaaagaaatagaaaatgaagcacaaagaagaatattgtgcaagtgttccctctcatttccagggaaaatttctcaaaatattgaaagatttctgtccatggcagacttgtagttggaatttgcatgaccagcttatagcttgtacatatggttcagttttgtgcatctattaatttcaacctgggccaccaaactgcattgttaagaactagagactattggctgggcacagtggctcacgcctgtaatcccaacacttggggaggccgaggtgggtgaatcacaaggtcaggagttcaagaccagcctggccaacatggtgaaacccccgtctctactaaaaatataaaaaattagctgggcgtggtggcggatgcctataatcccagctactagggaggctgaggcaagagaattgcttgaacctgggaggcagaagttgcagtgagctgagattgcgccactgcactctagcccaggcaacagtgtgagactctgtctcaaaaaaaaaaaaaaaaaaaaaaaaaccaacaacaaccaaaaacattcagagagaggacaaccattttggaaaacaggtattaaaatttcttgttaaattataccaccatgaactgcactccttggcatttacctaagataaatgaaaacatttgctcatgcaaggacttgttacacaaatattcatagcagctttatttataattgcccaaaattagaagcaacaaaaatattattatcagatgagtgggtacattttagtgtattcaaacaatggagtacaactcaggaataaaactattgatacatataacttcgatgaatctcaaaaacatgctaagtggaagaagccctgtacaaaagagtacatactgtgagagcctgctaatacgaaattttagaacagacaatccacagtaacatatagcagatgagtggctgcctgagggtttagaggtagggatagtttaacatcaaagtgcataagggaacttttttggagtaatagaaacactaaatcttgtttgtggtaataggttcacaggtgtgaacatttttgaaaatgcatgaaagtatacacttaaaatggtaactgtaggctgggtgcggtggctcacgcctgtaatcccagcacttcaggaggccgaggtgggtggatcacctgaggtcatgagtttgagaccagcctggccaacatggtgaaacccccgtctactaaaaatacaaaaattaagccgggtgtggtggtgggcgcctataatcccagctacttgggaggctgaggcaggagaatggcttgaacctgggaggcagaggttgcagtgagccaagatcatgccattgcactccagcctggacaacaagagcaaaactgtcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacacccttcatgctaaaaactctcaataaattaggtattgatgggacgtatttcacaataataagagctatctatgacatacccacagccaatatcataccggatggggcaaaactggaagcattccctttgaaaactggcacaagacagggatgccctctctcaccacctcctaattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaataattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacccaatgctagatgacacgttagtgggtgcagcgcaccagcatggcacatgtatacatatgtaactaacctgcacaatgtgcacatgcaccctaaaacttagagtataataaaaaaaaagaaaaagaaaaaaaaaaaaaagctaaatatagaaagccacctgctttctaattgtactggctgccatcttgtcttctttctactgacaagaaagtatcaataagaggtagtgattggtttgagggggaaacagtttttctagcagtttagtccttaatctgtggcttcttaagacctctgagttccatgttagaatattttaatgtattagtttctaggaaataggagtagctgaaaggagaggaggagtgaacattcttaagcatggagttatgttctaggctgcgattgacatatgcagtctaccactatgcaaggacgaatgaggtcagtgttgtaggaacatctggtggagtaaaggcatcccatcatctgtgaagtggagtccgcctgcctactcagaggttgctgtgaggattaagaaattacatatggaaagcaactggcaaagtgttttgcttatagaaagctctaatatgctaattgccttccccgtttctttatataatttataaggaaactaaaaaccagcgattaaaaccttagctttggtttctatatgtgtaaaatatagttcttatgtttgtctctcattaacctgtaagtttcttcaaatctgggaacatgtctaattgctgtgtatatatcttcagtcctgaagatgatagtagaaaacagttcttctttgaaggtttgttacatggatggatggatgattaacttgtgccagaacacacaggagtcaacagtgaaactgggccaaggacccatgtctcttactcttaacacagtgtttctttctagtcctgtgtttttctgtactatgtacctactatggatcatgccctgtgttttgcaatgaagacctctaactttatttccattccaaggagagggaggtttcagcacactcctggaacaaccagctttcttttcccttccgcctagtgctgcccccacctgcttagggctttcttttttggcttcaccaattgttgctctttggcatgaagagatgctttgtgagccagatgggtctctgaacagatgtctttgatggagagtttaccacttgcacagccaagaaagggaagtcactagaaggacttctgtgtgggctggcctggctgctcagcatttcagactcctgttgtttacaagtcttctccagaagccctggaagaatgaactgtaaggcctggactatggaatggtacctgtgcaccagcaattcctgagcaagcagcacagtgagtagatgattcctggaaacctgagttcaggtgaaaatgagagagagcagtctccttgtccctgcctatgggcttcctcatggccagttctacctctgttctaaatatattcttcactgatgaaatttcaacttcatttattcttctgtccttgaggaaaagtggggaagagtaaagaggtcttttctctgcctcaaatttttatttgttcttatttgttgatacttatttgctggagatagcttagtggtttttttctctttctttttgagacagggtcttgctctggtgcccaggcttggagtacagtggtgcagtcatggctcactatagccttggcctcctaggctaaagcgattctcctgcctcagcctcctgaagtgctgagactacaggcatgagctgctaggcttgggttgattatttcaattaccatttgctatgtaacgaggctccaaaacttagtagtttaaaataataatttattaccttacacagtttattactttttctgtgggttggcaggtcctctttccccatcctctgtgaggctaaagccctggtttcttccagtagcaagagggggtaaaccctactacttaagtaccctttaagcctctgcttatgtcaagtttgttcatgtccatttggctaaagcgggtcatgtgtttcaagccaagatttaaaaagtagagtgaagtctccatctcttgttgggaggagctatgaaatatggtggcccgtttttttccactgtatcacagtgataaagttgaaggttcaaattgtgactgtgctacttgttgtgtaaccttggatgagtcatttaacttctccaaacctcaggaaaatggagaaaacagaacctacctaaagggttgtatgcagattaattaatacatacaaagcacttagaatagtacttaacatgtagtaggcacttaatacattttacctgttgcttagataaattggtagaggtttttatgattaccagcaacagaaaccagcctgacttggtttaagcttctaaaaatttattcattagaaggatctggctgggagcggtggctcatacctgtaatcccagcactttgggaggctgaggtgggcagatcacaaggtcagcagttttgagaccagcctggccaacatggtgaaaccccatctctactaaaaatacaaaattagctcggcgtggtgccgtgcgcctgtaatcccagctgctcgggaggctgaggtgaaagaattgcttgaacccaggaggcggaggttgcaatgagccgagatcgtgccactgcactccagcctaggtgacagagtgagactctgtctcgaaaaaaaaaaacaaaaaaagaaggatccaagggaagttcagagagtcctttgacaagctgatcctacaaaccacggtagggtgggaaccaaggctactctagttgggaggttggctcagtcaggcagagaaatagctccctggcgtacaactctaacagtgctattgctgctgggccaactgtcctctcctagccttatttagggggtaggcatgggctcagtgatctcccagaggggtccagagtcagtgcctctgaagaatccactctcaccacagtcatgcagatatcaaggggacagcatcctctcctgctcagtgttgggggctagttgatagtccattgcctagtccaggttgaaagtgatttctgagtgtgccctgctctaataaaaagtaacgtacaaaaatagtttataacacaaggtgctctgggtgcaatgttttgctctttcaaagcattcactctaggtaggattcttcaaatagaagttttcatagaatcttgaaaaaggcaagcaaattacatcaatttgattcatacatttcttcttaggaatatgtcagtgatttaaaggtaggtattcctgcacttaggaatttttaaatgagaagaagtgcctcgtggtattttgaggaagattagctgttttcaggtaccatttagttactgtttttccacctaggtggtagcctcttgaacatttttcagttatctttcttcagctgggtgagtatgtcctggtcctagtttggtacattgccttggttgtacacatggtagttttcctacatttctaatgtgtctgcaccaggtgggaacccaaaggcaagcatgttctcaccctcattcctgaagtgatttgtctctgccataatggagcaggacttcttgggcagaataagttcaactgacagtcccagtgccgaagctctggctagctcaactggtccactgtgatttgttctgttattatacagaacattgtattctatttcccctgggtgttcaaagggagaaacaatctgtgtggtttagcctgatgtatgtgatttgtgagctgttgatcagggggtgggtatagatctgtcacccctttggggagtgttaagtttctctaaaatctctgggtgacattctgacagtcatgggtaggtacaggtatatgctcctccgtgtctattcgcctacctcctcagtcttttcccccatcaaagagaagtaattcattttgtaaaatatttatagaatacctgccaagtgcaaggtattaggtgaattactcgttaggcataaagttggctcataaatgaattgtgtcctccaggagcttagagtctaatgggaaagggacatatctgtaaatgactcttgtatattgtggaacatagccaatatcatttttttgtgcgtgaatcactaccctgccaactttcagatagaatccgatgtgacatagtgacatagattattagtcagaattctttggtgtggcagaaacccacctcaagattacttaatcagaaaagagaatgtatggtttgggtcaccaggaggtcggaaggcagggatgaatatgaggttgaaatgatggcctcaggtcacctctcagctttgctcattcttgtgtgggcttccttttcagtcagattctcttcactggaggcaggatggacctcactagccccagacacatctagtccttagtgctccctatcccagagaaagtactccacccactctccccagcatccagatcagtgtttgaaccactgattggcagactgcctctgcttggagtgcttgcccatggctggaccattcactgtgtccaggggactagtgttgcctggtgggccaccctgggttatacactcacccctgtggtacaacagatggcgcctcttgatgaacaccctagcagaaacagttgatgctggggaggagtgtatcccaaatgaaaaggaggggctttgttaccaggagatggggagaatgaatgggtgctgaaagcaagcaaatttttaaaaagttttccgcttacaaattctgttaagcattgggtcagaaagacaaaacactaacataggatgaaaacaacaagcagttaacacaggtgtgagcaaactggtccatgggctaaatttggcctgctgcctgtttttgtatggcctgcaagctaagaatagttttcaaaattttgtgacatgtaacaattatacaaaattcaatttattattatttttattttttgagaccgagtctcgctctgtcacccaggctggagtgcagtggcgtaatcttggctcactgcaacctctgcctctcaggttcaagagattctcgtgcctcagcctcccaggtagcggggatcacaggcatgtgccactacgcctgctaatttttttatatttctagtagagacggggtttccctatgttgcccagcctgatctcaaactcctgggctcaagtgatccacctgccttggcttcccaaagtgctgggattacaggcatgagccactgtgccctgctggaaattcagattattgtgtccataaataaagttttattggatcacagccatgcttgtgtaaatgttgtctgtgcctgcttttgtgctataatggtaaatttgagtagttacttgtgaaagagatgactgtgtggccctcaaagccaaaaatatttactctctggtcctttttttatagaaaaatcttcctaaccaaaaggggaaggagaatcccttgacagaagctttagaatttaagcacaaaactgggcttttaagcacaaaactatggtggctgtagcctgtaatcccagcactttgggagatcaaggcgggtggatcacctcaggtcaggggttcgagaccagcctggccaatgtggtgaaaccccatctctactaaaaatacaaaaaattagccaggcatggtagcagacgcctgtaatcccagctactcaggagcctgaggcaggagaatcacttgaacccaggaggcagaggtttcagtgagccgagatcgtgtcactgcactccagcctgggtaacaagagcaagactgtctcagaaaaaaaaaaaaaaagaatttaaacacaaaactaaacttttaaatgtgtcagctttaagttctcaaggaaaacatgataagtgacgtgggtaggagacaggattatttttcctgatcctggagctctgaaaagaattagctgccaaaatttatgtcgagtcttttcatctgaagctgaaccaagtaggtagttgtgctgtgagttaaaaagggttggaggtgaagagggcgctaggatactgctctctttcattctatttaaagcaataatttgcattgccaccctgccgttcttaacctgctctaattatcaaggccttattttgactaagaccctgaaaaagcgttgtatgatttagatcaatacgcagttcatccaacttagccgtaaattatttctgccttggagttgttagctgataaagatcaataaatgttaacaacagttttaaattataactcaacttgtttttcttttccttctatctaatgaaaccatgtgtaacctagatttttaaattttacgtatttatgtgtgacatgtatgtgtgtatgtataaatgaacgaatgacaggtctcgctcactctgtcgcccaggctggaatgtggtggtgcgatcatggctcactgcatcctcaacctccccagctcaagcgatcctctcacctcagccttctgagtagctaggactacaaatatgtgctatcatgcctgactaattttaaaaattttcttttctagagatgcggtctctctctgttgcccaggttggtcttgaactcctggactcaagtaatccacttgtctgggtctccctaagtgtgggactactggtgtgatccactgtgcttagctgccagcttagatttttgaggggtacatagcccactgtaattggatacctctcttcagagccatagtagcttattataccttggggccatcctgcttggagtgtgcctcaaaagtgttcctttattccctaggttagagagttatgtaaaaacggggctctcaggtcagaatgagatttaaggcttctgcagagcctatatgaaagtgtttttgggccgggcacagtggctcatgcctgtaagcccagcactttgggaggttgaggagggcggatcatgaggtcaggagatcaagaccatgctggccaacacggtgaaaccccgtctctactaaaaatataaaaattagctgggtgtggtggcacacgcctgtaatcccagctactcgggaggctgaggcaggagaattgcttgaacccgggagtctgaggttgcagtgagccaaaatcgccactgcactccagcttggcaacagaacaagactctgtctcaaaaaaaaaaaaaaaatgtttttgggctgggcacagtggctcatgcctataatcccagcactttgggaggccaagatgggtggatcacttgaggtcaggagttcgaaaacagcttgaccaacatggtgaaaccccgtctctactaaaatacaaaaaaattagcctggcatggtggcgggtacctgtaatcccagttactcaggaggctgaggcaggagaatcacttgaacatgggaggtgggggttgcagtgagccaagatcacaccactgcactccagtctggatgacagagcaagacaccatctcaaaaaaaaaaaaaaaattttttttgtatccttttcctggggagagctgggagtctccaaagtgtctcacggtgtcccagtgacagcctccagcaaatggggtcttcagcaatggtcaggattacaacctctaaattcttcctctccattcagacttgttggcactgatagcaagatctgaagtggcttgtttggttttgttttgttgttttataagctgtttgtagcagactcacacgtaatgatttgagtggtttcttctgcaatttttgcaaggaactatgctgcctctgccaggcatcgctgagcagaagtcagagtggcccctgcctccaccagcctgaggctacacacaggattctgttctgagcatggttcctatctgtgtgtgactaaggactgttgtctgatccttgaaacacagaaggttgcccatggtatatacacaaggtgctcctggctacatctctctcccatcacagccatcccatagctgtgtggcttacacaggaagggattccttttgactgtgtcagactgccctgccttaaagatggagggagacagagtggctcattagtagtggaaaattcagtatgctggtctcttggttagaaatgtgagtctcgttttatctagaattatttcatctgctagattcacagtgatgattatagctccaggtgagtttgtctcttagctccttaagagaggcttagatctctttagggaagcatggaggagatggtatttgagctgagctttgaagcataggtagaagttatatatgtggcagggtcagggaaaggaattccaggtagagggaagcatgaatcatggcatagaggcaggaaaacacagacatgtttttacaggaaatagcaagtggttcaagttgtctacaacaaagggttcctgatggcaaggggtgagaattaaagtaagaaatagttgaagcagtgaggagggtcttcactgccatgttcaggaagtggattttatcatgggcaacaggaagcagtggaatgatcctgcacagagaagtgagatgtgctgtggtttaaggaagaggactctactgttacggctaaggtgagctggagaggggagaggtcaattaggaggccgttgctatgggccagtgagagataaggggggggtctgagttaggatagtggcagagtgaagggacaggatggggacagatgggagagagatggtgcaaagggcagggactggtgtgggaagatgggtaggggagtagcagggagacttggccttggcccttcctggggtggttgtggtgggaaggagcctgaggcccatggccgtgctccagggctgtacgtggagagctgtgttctcctcctcctcagatcacaaagcctcatttctaatggaaacctgaggctggggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcaacagaagcgagactgcatctcaaaaaaacaaacaaattgttaaaacctgtcaatagctcaaaagaaaagtttccgtgactctgaaaaacaacacaaagaatcagcagcatttaagcaaaaaaataaaaaagattacttcagtctcctgtaagttcagttcatgcagttaattcctgttctgcttgatattcatgaacatttcagctctccatgagtcatgaaagtttttcctctgttttgatgtcacagtctttaaagttatcagaagcctgtattcaggagcacctgttagagttttatagttgattataaaaccaccttttaaagagaaactgcagggctgggcatggtggatcacctgaggtgaggagtttgagaccagcctggccaacgttgtgaaagcctgtctctacaaaaatacaagaaattagtctgggtggtgatgagcacctgtaatcccagttactcgagaggctgaggtaggagaatcacttgaacccaggaggcggaggctgcagtgagccaagattgtgtcattgcattccagcctggtcaacaagagcgaaactccgtctcaaaaagaaaaaaaagagaaaccatcattgcaaaattataactgagacagtgaaaaagatctgaccgaactgactccatgttgcttctaatctccaagctgtccttgttcattcctgggcatagacagaactaactttgggaggaacttagtttatagttgagctttgaaacaaagacgataacagccttttccccaaacccccttcctgcctggggactaggctgcctaaagccacatgattagaagttatggttattttactaaataattcaagacttagctattttcactaaaccaatgtcagtctctttcaatatttacagaagcaaagatcttttttttttaaacaaagtctggctctgtcacccaggctagagtgcagtgacatgatctcagctcactgcaacctgcgcctcctaggttccagtaattctcctgcctcagctttctcagtaactgggattacaggtgcctgccaccacgcccaactaatttttgtatttttagtagagatggggttttaccatgttggtcaggctggtcttgaacttctgacctcaagtgatctgcctgccttggcctcccaaagtgctgggattacaggcatgcgccaccgcgcccggtggctcacaagcaaagatcatcctgttttgggctgggtttatagttttgtaatccctatgccaaattttgacaccttataatatttggcagggatacatatgaaatttcttgatcaaaaaatgcaaacaaaaatgtaccctggctgttcttaaggcatttctaatagtactttaccaacaattttaaaggtagcttatctatcaaagattttacgtaaacttgagaaaacatttgactagtctttcattttctgataaggtatttgatttgtgcttttatttttccttaagccaattaattagagctgttttatattttttagtagtaaatcattgtgtacacaacacataaatacgtggacatattagacatactgatagaagtacatcttaaaggtaagacagacctcctttttttttccccccttctgtctaagacttgcaaactcttgataacctgtttcattatgcttggcagttgtcagctaaatagctcctaaatctgcgtattgaaggacacaactctttggtgaaaaatcagatagcaaaatttacatcataaagtacagagaggaaaagtctggtggtgctagaggaagattaaaggtggatgccaaatcaaacatacaattatagaaatctatcataggattgtataaggagaccaatttatttagataggtactacctatcttaactggatctctgagttctgagtagagcccacactgaattctgggtctccaaaaaggaggctagaccacatgatgcttttaaaaaaaatttttttttggctgggcgcggtggctcacacctgtaatcccaacactttgggaggccgaggtgggcggatcacgaggtcaggagttcaagaccagcctggccaacatggtgaaaccccatctctactaaaaatacaaaaattagctggacgtggtggtgcgtgcctgtaatcccaactacttgggaggcttaggcaggagaatcgcttgaacccaggaggcggaggttgcagtgagctgagtctgtgccactgcagtgagctgagtctgtgccactgcactccagcctggcaacagagcaagactccgtctcaaaaaaaaaaatttttttttttggctgagcacagtggctcatgcctgtaacctcagcactttgggaggccgaggcgggtggatcatgaggtcagcagttccagaccagcctggccaacatggtgaaaccccgtctctactaaaaatacaaaaattagcaaggcatggtggcaggcgcctgtaaccccagctactccggaggctgaggcaggagaatcgcttgaacccaggaggtggaggttgcagtgagccgagaccgtgccattgcactccagcctgggcgacagagcaagactccgtctcaaaataaaagttttttaaacaaagacatttctaagtgtctaaactacactcttcattaaaaacccaagagtagcctctgttgcaataactattttagtcagaaaatcaggtaacacaatacaaaagcagtttaatagctgagaggaacttgtttatactcttggggagacccataaggaaaaacaggtttctcccccaaagggagtctggtgcctccttttttttttttttttttttttttttggtgaggaactccaggctattataaactattttaggtttctcatgcagcagagggtgcaagagaaaggagagagagcagaagtaaatgaagaaaacagaattctgtcaactgagaagaagaaaaatttgtctcaaaaaaagacagggtcctagacagagaaaaaacaaacccaaaacataaaatccttttaaagacacacacacacacacacacacacacacacatatcggatgttagcttttaattaagctgacttttaaccattgagctcctttaaaaaaatctgtttaaatctcattgccgtatttctgcttggacaaattgctgctgtttcagaagtaccaaatatcaaacctttcagaaagggcttgatttaggaaccaaacctaggctgtcatgaaaaaaagaaggcagaaccttatgtatggaactgcagcctgaggtgatagctattgctccttcagtttggcctggctagcaaaaacgtggcattgttttgtgaataaagccccttaaggagtcaaataaaaaatctttcctttttttcttttgctggccgtttttctccctccaccatgccacttttttttcttggtttttttttttttttttttttttgtgggaatttagccacttcagaggcctcgttccccataatttggaactttccttcaaatttgatcaagttgcatagagttggtcaaacccaaggggaaaaagaccgaaacaacaacaaaaagaaacagtaaagcaaaacaaatgatcacacaacctatacaagtactgagagctctaatggtaaggagaaattaagaccagctggttgttaatcataactgtagccaagacaaaccctaattcagttacttagggatgggtttcatgctgaagactgccctctaccatcctagaagcaggaaaagactcaaacctgtcctccctgttggaagcaagctcaaaactccgtaaaggagttacttgccttccattgtcacggaagcaggaaaacttgccttccttgtgtcggaagcaagtaaaactcagaaacaaaaaaggagttgtacagcaaaataaactttagatcacctccaaattttgggagatcggggattctctggaggaggtgcttccaggcgtcagcaaattgtctgattggtttgaggcacaaagatagctcaagctggtaccagccaccaataggagatttgtcaaaggtcaggggcacctccactcagaatcccttggtggttaccaaaatgtgaaccctgaataactgagacaggtctcagttaatttagaaggtttattttgccaaggttgaggaccctgtgacacagcctcaggaggtcctgatgatatgtgcccaaggtggtccaagcacaggttggttttatacattttagggagacatgagacatcagtatatgtaagatgttccttggttctgttgggaacggcaggacaacttgaagcagggagggggcttcgaggtcccaggtaggtgagagacaaacacttggattcttttgagtttctgattagcctttccaaaggaggcaatcagatacgcatttatctcagtgagcggagggatggctttgaacagaatgagaggcaggtttgccctaagcagttcccagcttgacttttccctttagcttagtgatttctggggccccaagatttattttcctttcacaggggccatgttatgtagaagccaggctgagaaggaatctgattccttatattggttatatttttttctgaaataaatgttagcttttattttccctccaagctgcaagagccattgaactctgacttctgtgcttctcacatttaaagcctcctgatttgagtacttagtacctgccagacattagcaggtaggagttactattcccacctgacagtcaaggaaaggctcagagaggttctgtaactgggctggggccacagagctagtagatgatagagctaggattcaaacccagatctgcctaacttcagatcaaggttagtggtgctgtttccacaccaccctaaatggcctacttaataatgaaatttatgatgccagctgatgataagaatcactgggtgttaagattcttggttgctaatgaacttgaattagctcaaacaataaagatgatttttttttttgtatcagctaaccaaaccccaggaaggatagaaatacagctggcctgatggataattgtatccagggactcaaatgccattagctcttatactttgattaaaatatactttaaaaagatgctgttagtggccgggcatggtggctcaccctataatcccagcactttgggaggccaaggcgggcagttcgtgaggtcaagagattgagaccagcctggccaacatggtgaaaccccgtctctactaaaaatacaaaaattagctaggcgtggtggcaggtgcctgtagtcccagccactcaggaggctgaggcaggagaatcggttgaaccggggaggcggaggttgcagtgagctgagatcgcgccattgcactccagcctggcaacagagcaagactccatctcaaaaaaaaaaaaaaaaaagatgctgttagctagcctggccaacatggcgaaaccccatctctactaaaaaatacaaaaattacctggatgtggtggtgggtgcctgtagtcccagctatttgggaagctgaggcagggagaattgcttgaatctgggaggcagagttgtagtgagctgagatcgtgctactgcactccagcctgggcgacagtgtgagacttcgtctcaaaaaaaaaaaaaaaatgctgttagatctctccctctcacttgtttccctttcgatgttggctttcttctctcgggccagctgtctaccagatggaaccatggtttcctgctttacagttttgttattagaagagtttttctcacttcaattagaaagttctgagtgaggactcctgattggactgttaggggtcgtgtgcccagacctatgagatcaccgtggccaggtgacagggagctgtaagtggcccagcctgggtcagggggctgccctgtagccagggacaaggttctcattgtgtcagtctccaccttaagctgcatttgccccaaagaagtatgtgtgatgaggagacaaggaatgcctgacatctgtctttaaattgtcaaacacattcttctaagtctttccattacgggttatcccaagctaggaataactggtgagtagtttcttgaccttttttccagaccttttttggtgaattatgttaagctgtgacccaggcacaaatggggaggccatactttggtggagcctgggtcacataaatatggtgaccttactagaaattctttcctacttactcattgtttaataatgaacagaactctggcctatcttcttttgtcattgtttaacacccacctcactacctcccacctctcctgctaaacaaaattagccttcagcaggtcaaaacagatttttagctaacttccgtttcttgaatagcatatgataagaactcaagttagccaggtttgttctcctgcctgtaggtggttgattgggtttgtgatactgtgatacattgcatatctgctcctctgaggtagcccaaataatctggtgggggaaatatgctgttttaatgttattttgtgacctttggcaagagattttatcctccagcctcaacttccatatctgtaaactaggactattctgccaaatattacgaagggtcatgaaaaatgagagatcaggctgggcgtagtggctcacgattgtaatcccagcactttgggaggctgaggcagtaggcttgcttgagcccaagggtttgagaccagcctgggcaaagctgggagaccctgtctaccaaaaaaagaaaaagttacttgggcatggtggcgtgtgctgaagtgggaggatcgcttgagcctaggaggtcgaggctgcagtgagccatgatcatattactgcactccagccaaaaaaaagagtgctgtcagggaatctgggattcataagcatttcccttgactgctcttctttcctttcttttattatacctctcttctctctgtaccccctataccttttgctctggcttttgttacatcctgtattaaaattttagataatttatgttatttttcttttttgagacaaagtctcgctctgtcacccaggctggagtgcagtggtgcaatctcagctcactgcaacctctgcttcccgggttcaatgagttctcatgcctcagcctcctgagtagctgggactaccggtgcacaccaccatgcctggataattttttttggtatttttagtagagacagagttttgccacattgcccaggctgatcttgaactcctggcctctagcaattcacccgccctagcctcctgatgtgctgggattacaggcctgagccaccatgcccggcctaaaaatttagataatttattggaatgttgtgtgccaatgaaaagcaaatcctaagctcctgcaacatcatctcatgtttaattgtcagggtttgtgggccctctgggtcaggggatgagcagtgaattggcagagaggggtgtagggagggtagagaaggagagcatttcaaaactaatgaggcttggaagggaaggaagaaaagaaacttaaaatgcagtttctgggcttggttgtaaaaatcttgaaagtgagggagataaaaatagttgcttgttaggacctggcaggcatgctctggaggctccctgtttgaattcagttgctaatcaggaggtgggaaacaacctctggttcctgctgttagcacctttcttgcagttggccttgtcaagaaggataatgggctggagctgagaaagaagcatcgtgctcactcgctaaactggagtggagaactattctctccttactgaatttcagggatttcagcctgccccaagtcaaatccttgttcccagaaataaagctcattacatctgtaatgtgaatgattccttccccggccacagctcaataagggctcttgtgaaactttggagtacaacttattatgggttgcctttagtcctgttgtctgggccctgattttttagatcctggagagaacgctccctcaggggtctgagttctaacccttggccctatcgttaactccctgtgccaccctaacaggtgacgccttcctattctaggcctcagtgtttctcatctgtgtgcaatggtttataatgcttacctcacagtgttactgtaaggattaaagaagatagtatatttgaactggggaggcggaggttgcagtgagctgagatcatgccactgcacgctagcctgggtgacagagtaagacttgtctcaaaaaaaaaaaaaaaagtatatttaaaaggcctgacatagcaggtgttccataaatcagagctgttgtaggatcttcttaggtctgctaggctcgcctgcacctctcattctcccacctagtctctcagctgcatcctggcttttttttcccaatgctcttggggaaggaaatttgggtgggggaaaagagcttacaggtaatggctaattgaagagttggggattttctcagaattttaattatctctgctacttaattagctccttgaggccatggatagctggaggtggctctgtagagggtgcgatttgactcatccaggtcagctccctttctctctgtttcttcatctttagtggggagagttattaaggctttgccaaggatactaagaagaggttgtttgaagcctaaagtcgccattttaaaaaatcttcatttgcctttttttaaaatcctttaactgttgcttatctacttttggattcagcctttgtcacagatgagcaagaatccagcttccctgtgtcactctgcttgcttctcagcagccccttgctccttccttccacctcttctctttcttttgggctccccacttcacccctccactgcctttctcttcccccaagccccaccgtcttccatcttgccttagggaattcagctgcttttaatattagcctaaaccaaacaaaatgaaggtattaggatatagtggaaacacatagaaggccgagattcaccttggttcatctacctgccgggggccttgtcagctactcaggctatcatctgatgggtggcacccatcccacctggttggaagaatttagaacgagtccacggggccttgaccacatcttcatctttgcccttacacgtgcacatgttcttgtcatttgttggattctgtctcccctgatggtgacaatccctgtgtcctttttactcttagctcagtgcagatactctgtgtttctagaataaataaatgactccctaaattgttttatccaaacaccttattttagaggggtagaaaatacttaatagttaaacttcaaaatgtgtgctcttgagggaaaaatcaggaggctttgaatagtgttattcctgggacagaaaatatcggagaagaacatactttctgagtttttcataaaacctccttgttcatttttgaggaaggaggggttacccatactcattgtcacagaagctgagcagaattggggttattagatctcagcctcctgtgggattcctagggaagcttatgagcctgggagcctactgggtggttgatgcttcctccagaatgtagcctggccagccagctgctggggaccctctcagcatcacctttcagttatcaaaggatcagaaagagaacgcaaggcccagaggtggcctcaggaagtagagaaggactgggcctgtgatttgaatgtttgagggctctgctaggagaatgtgagaggaagcccagttaatcctcccaggactccaggagcagggcattatcccaagttgggaaggggattcagaagaactaggcatctaggagtagaggtgacagggtgatttgaaaggaagactttttagatgcaaggaccagcacaagagaaggcgagactcttacacaggggcagttagagaggcaggccagccccaaccaggaagaagtggatgtggagacgtgttgtggtgtgaagttggagaggaaaggaagaaacagtggagggcatggaaaggcgggcagaggggctggggactgtgctctgaggcagagggcagccatggcaggctctgtgcaggggctgtcccgctggaggagtgctggtttctgtgtaggcggggggagggagaagatgctggagacaggaacagtgtgtgaagggcctggctattgtgggaagcaagtgtggggtgctgagggagatcaagaaatgaattctctctggacttgtctgccatcatgtacctcttttctgtccccagagaagagctagacttgggtgtggcaggagcaggggcaagagggatgtcctagcctggcggctccagcagcatgctctggggttcagtgatctcatgtgcccaggtttccaggtggcttcttgtgaggccctccgggatctggctcccaggaccaatgtggtctagcagtgaaaagcccctcagaatttcccttctcctcctctccaaccccttccatctctgctgcctcctaggcagtgtttttccctggagcgggtgggagaagctggagctgacagccagggatggtggcaagctgtgttatgtaagtttgaaaaaaggaggcttgcttgccatgtgaatagagatcagatacaaggacagctagaggcagcacagccatgcctgagcagcagctgtagtctgaagagaggtgtctgagccagcagaggaagaagctgctggactgggtggaggagactgttcttgtggggaaggagaggtgtctggttctgtgaactgccgatcttggagggcagcctgtgaagcaatcattgtctattcctataacatggtgtgctgcttatatgccatgccttattacatcaatcctggtctgtaacttgtgatggtatgagagccgccattgtgactgtttcaatcatggcaaaccatggcccagaaaagtcaagtgacttgctcacggctgcatgtagagtaagtggcagggtcaggatttgacacagggcttctgtctcactagccagtgctgctcttttactctaaaacaggcttaacagatcatgcctaaacagcccatggggagagtgtgggccgggtgagggagcctggtgccgtgtggcctggcatggatgagaggcaatggcactgggtgggaggagtggaagagggcttgtgttggagccccttggtgtgccgccccagcaggcgctgtcacaccccttacccttctcagtctcgttccattttcagcatcattttccaaatcctgaacacctgacctccaggggccaggtacccaacaccggtcctctgaggggccatgggcatggtgggatgaggaggtacacctccaacaagcaactgctggactcatgcctcggctgaagtgtttgtgggctctgtcctaacactaggcccagggaaagaacagagctcgcccctctcctcccgaagttcagaatctccccatggttctctgagaggctgcatggctcgctccctctctctgttcacatcgttgctcaaatgtcctctcctcacagggccgttccttgccaccctgtcacaacagtacccccttactctctctgtcctcacagggttttattatatatatatataaaaatctgtgtatatatatttaacatatatatatacactatatatacctgtatatatatagtatatatatatgttatatatacacacatatatgttaaatatatatacacacatatgttaaatatatatacacagatatgtgtgtgtgtatatatatatatacacacaggtatatatatatacaggtgtatatatagaggtatatatatatatattttttttttgagacagagtgtcactctttgcccaggctggagtgcagtggcacgatctcggctcattgcaacttctacctcccgggttcaagcaattctcctgcctcagcctccctagtagctgggattacaggtgatgtgctaccatgcccagccaatttttgtatttttagtaaagacagggtttcaccatgctgacctcaaatgatctgcctacctcagcctcccaaagtgctggggttacagacgtgagccactgcgcctggctgggttttatatttttctttgtgccacttaagaccacctaatgttacatatttgttcattgatttgtctgtctcctcacaataaaatttaagcttcatgacagtgggggacttggtcagtttcttgactgcccacacagagcccacaggtaaggtagcaggtgttcagtggacagtaggtgatgaccgttagagcatggcagcagggtgggtagaagaggacaggtgtaagtgtcagagggcctgggatctgctttcagctttacccagtttttgctgtgtgactttgaacaagttgctggatctcttgggccttagccttctttttttttttttggagacagaggagtctcactctgtcacccaggctggggtgcagtggtgtgatcttggctcactgcaacctctgcttcccgggttcaaacgattctcctgcctcagccttctgagtagctggggattacaggcgtgtgccaccacacctggctaatttttgtatcttcactacagagaaggtttcaccatgttggccaggctggtcttgaactcctgacctctggtgatctgcccacctaggcctcccaaagtgctgggattacaggcgtgagccaccatatcctgctgggccttagactttttgttttcatcatgaaggggaggaactaggtgccctctaaggctgcttttggcacctctcttctgaaagtctatgtgtaggagacgagggtcgcagaggggtttgcaaagatttgtatcctgtgttcctttactgaagagcctgacttgggtctgcacactgtggggtaggggagtgacatgatgagggctgggtcttaggaggactacaccagtgatgcagtgtgtgcatgcatgtatccatggtgcatttagaaccattcattcaacaagggcttttggagcacctgccctctgtcagatacagtttgggctcagggcttagagtggtgaggcagacagccaacgtcctgccctcctgcagctgattggggcagagagaggctagagctggcctggaatggtgattacccccaggctgaagatgaagaggggccaagtggagttggggcactgggatattagagggtcatgatttttttttattatttttatttttatttatttttttgaggcagagtttcactcttgttgcccagactggagtgcaatggcgtggtctcagctcactgcaacctctgcctcccaggttcaagtgattctcctgcctcagcctcctgagtagctgggattacaagcatgcgccaccacgctaattttttatttttatttatttatttaataaatatattttttgagatggagtctggctctgtcacccaggctggagtgcaatggcatgatgtcggctcaccacaacctcctcctcccaggttcaagtgattcccctgcctcagcctcccaagtagatgggattacaggcgcccaccaccactcctggctaatttttgtatttttagtagagatgggagttacgccatgttggtcaggctggtctcaaactcctgacctcaggtgatcttcctgccttggcctcccaaagtgctgggattataggtgtgaggcatcgcccggcttttgtttttcaatttgtccttggaaagatacttaaatagacctgtttgaatctgtttaagaataaatagccagccatggtgactcacgcctatagtcccagctacttgggaggctgaagcaggtgtgttgcttgagcccaggagttcaactcagcctgggcaatgtagtgagactctgtgtctaaaaaaaaataataataaatgcattcatataacagtatcgaagagaaaaataatgaaacgttattagtggctctgctgggttgtattataggaggtttgggttttttctgtgattttctagatgtcctatatggtgtctatattatgactattaatatagacaccatataggtttgggatgtcatggtttagcatgtttcctagatatggtctgccctcaaagtgagtgtcattgtttgctgatgtctgctccacaaagccctgctccaggggccttcaccaagtcccagccttggtttgctcacctataaatgaggataattgaccctggtctatgcacattacaggacagttgtatgaatcagaggatacagcggaagaaaaaatgtttggaaatttaggtctctgcaaactaagggccaatgtactggtatttgtgacagtgaccggatgggtgggatggggtgataataagagtgcaaggaagggggatgggggcatcgttttgactctgaggagcagctttaaggcctctcacattccagctccaggtagcaaggggttccccttgactggcagggtagatgtacctgtgtaggctgttaggtgagtgactccagtggaatggaatggaatcatgactcagctcccaccctgccacacatatttgtaagaaaaagacccacatgctccatgcctggtgcagaagtctagaatgggaattcccgccaaaccctgtccccttctagcctgtgtagcctcagcaagcagataggtcttattacttgtttttttctgcctccttcatgatccagccatagatactatatcttaccagtaggggtggttgaagcaacagactttgaaatcctgactgttcatgataacggactccttcctgtggatcatctggccaagtctgcattcttagagagtggaaatcgactgtctttctgttctacttctacagcagctgctcatttcatctcctgacagttgcttcttgaactcagaacaaagggccttggtgtacagtgtttgcaagccaagggctgcctctgatggcggacgggggtgtggtcctgggactcgtggtcagggctggtctgtgtggaatgctgatccttctcttccccaatctacctgtgtcagttccctccttttctattttctcttccctgcagatgtcaagccctccaacatcctagtcaactcccgtggggagatcaagctctgtgactttggggtcagcgggcagctcatcgactccatggccaactccttcgtgggcacaaggtcctacatgtcggtatgaacagaagtttccattgcttgagcttcttgtacggtcagggagaggagcccagtgggtgcctttcctgtggagccagagtcttgtgctgggtaggggacaagaagtgagggaggaggcacagtgctctgccctgaggagatgaagttgaatgggaagatggtcttggtctttcttaggccttggagcataactgggatattggggccttgactcactgaaaggactgtccagctccagagtgtggctttctttctgaaggattgtgagctccagctcccctctgggcatctctacatgatagtcttcagatccacaaacccaggatgctcagatatgatccaccccaaactacctcaccttctccttttctcttagcagtaaatagacagcatcatctccctggtttcccaaggtagaaacctgagcattggctcttaacctgccttctcagcagcccgtcctttcagtatcttgtagctcccaactcctgagagtctgttcagaattgtccagcctcttttctccctcctcactatgtctgtcagacatgtacccctccttctaactgcagcatacctggacccctcgccagagtctctgctccacttcagccaacaccctgtgttgagggtatttcctcctgctcctggctctgctggctcacactgtcaccagagcattgtgtggggccatcctcacactatggcagcaccagcgtgttttcttccctcctccataccaccggttccttggggacagggacaaggtgtctctcttgtccctagtgcctggcatggggcctggcatgtggtaggtgttcagggaatgcttggcaagtgggtagatgtttagttggctgagtgggagggtacatggataaaacatttctgagaatgatttggaaaggtggaaacgtgagtctgggccagtgctgaagtgcggcaaagtggaggagcgttggagtgagtaggcagtctttacagaagtggcggggagtgcaggcccgcgtggagagggggacaggcgcagaggctcagatcttaacttgtacaaagcattttatgtgttctctgtcaaagcacatgtcatgtccctggaaggtctcatttgatccatgtggttgtcccaggaaataaagattattgttcccattttagaggtgaggaagtctagattcagggaggttaagcaacctgcctacttaaccttgctgagccaggattgaaagctagctgcccccttgccaggcagacgccctttgcacagcacaccctcatttgcctcttggggaggatttggcacctgtgcccagatcccagtgtgaacacatcctcattccttcttgctggcacctaccccccactgtgactccagccactgtcaacatcactcacctggcactgacccacatccccacccctcccctccagtgacccacagtggaactctctttctctgtcatctcctcattgcttcttccctaaatgtctaataactgagcagctggcatcctgggccatttgactgccaactctcaagttcaaaatccattaacaggccctgggagttactaatcaagggtttaatggttggggtttttgtggttatatggtcagttacgaaatagtccagtgttggagttagtgaaaaatgctactggagaagttaatgtctacgtgaatatactatgggcagaataaagattttttcggtagggttcttgaaatacatgtgctatttcaaataatgctcattaaaaataatgcttttgtatagcactgtatactttttttctctttggcttttcccaccaatatcaaccaatatttgtattgcattttacaacatttgacatacattttctttttttttttttttttgagacggagtctcactgtgtcacccaggctggagtgcagtggtgcaatctcggcttactgcaagccctgcctcccaggttcactccattctcctgcctcatcctcccgagtagctggaactacaggcgtgtgccaccacgcccggctaatttttttgtatttttagtagagacggggtttcaccgtgttagccaggatggtctcgatctcctgaccttgtgatccacccacctcggcctcccaaagtgctggggttacaggcatgagccaccgcgcctggctgtacattttcatttgatttgatcttcttagtaatcctaagtagagttttcttatgtcattgttactgtcattttcatcatcatcagccaccacccccccccacctttttttcttccgacatggagttttcgctcttcttgcccaggctggagtgcagtggtgcgatcttggctcactgcaacctctgcctcccgggttcaagtgattctcctgcctcagcctcccaagtagctgggattacagtcatgcaccaccatgtccagctaatttttgtatttttagtagagatggggtttcactatgttggccaggctggtctcgaactcctgatctcatgtgatccgcctgcctcagcctcccaaagtgctgggattacaggtgtgagccactgcgtcccggcccagcagcagccccattttatagatgaggctgatattcaggatcttttagcttctaagtcccggaattgggatttaagtctcaggcccactgaccccagatcttttgttctatgtatccacggcaccacctcactcccaacccgcattccacaagcttcatgtttcagattcagtgacaagatgagcctctcatgctgggcttcggacaggctgccctgcgtgtgcaagactgtggccaagctgggtaaagctggaaccacaggctgtagtggcagccagggcacagctgattacatgtggtctgtcaatttaggccagattataggagaaatagagcagggatgaggggttaaagccacagaagccagctaggatttggtaaacacagtgttgggggtaggcaggaggccaaattcaagaggttagtggagctcttgaaacaggatatgaactattgagaagggacagaagagaaaatgcattagcagacccaggggtccaagttaggttaggtgattatcactgtctgtctctcctgcagccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctgtgagtagcctggtgtgtccccatcttggactgttggaggggagggtcccttactttcaggggtttctggagggctgattctctgtacattctgccaagactgattctctgtccctggatgccaggctagggccaggggaagcagcaagggtctccaggtgggtgttgttactaccaacaacttcctaccatttgttgagtacgtactatgttctaggtactgcacttaggactttatacattatctaaccttttgtatttattatttttattattaagggtcttgctatgtcgcccagtgcagtggctagtcacagtcttcaactcctgggctcaagcagtcttcctccctcagcctccagagtagctgggactacaggttataatttatttgcgggggttgggagggaaggggctcactctgtcacccaggctggagtgcaatggcatgatcacagctcactgcagcctcaacctcccaggcccaagtgatcttcctacctcagcgtcctgagtagctgggaccacagtcacatgccaccatgctcagctaggttgttgtttattttgtagagatatagtctccttatgttgctcaggttagtcttgaacttttgggctcaagcaatcctcccgcctcagcctcccaaaatgctgagattacaggcatgatccaccatgactggcttctaatttgtgggttttttttgttttgttttgtttttgatactgggtcttgctctgtcacccagggtggagtacagtggcgccatcatggcttactgcagccttgacctcttgggctcaagtgatcctcctgcctcagcctcctgagtagctgagaccacaggcatgcgccaccatgcctgactaatttttttaatttttttgtatagatgaggtctcactatgttgactaggctggtctggaactcctgggctcaagtgatcctcctgccttggcctcccaaagtggtgggattataggcatgagccactgcattctaattttttaatcatgacttttggtagatttattttttattgagatatagaattcacataagacaaaattcacattttaaagtatgtagttcagtggtttttagtgtattgttaccatgttgtgcagccatcaccactgtcttattctggaacattttcattaccccagcaagaaaccccatcccccactcccccctgcctgatccactgacaaccactaatctactttctgtgtccacggatttgcctagcattatataattttaatagcatttcatttgtgatcacgactataatctgaattttaaagatgaggaaactgaggcacagtgcacttgtcaaggccacataggcttgcaagtagccaagtctgactcccaagatgataaacactgtgcagtaccacctgcctctctgaatgtgaatactgggaagtaaacctggtactcagggaatagcctgacctagccaactgttttttatgtagctcctgtctggccagggatacctgccctgtacctccatgaggtccacatgagagagagcttgtataaaggggaaagcagagggggctagaggtagctgatggcaggtcattggaggggctggtggctgtggcctctgaggctcgccagtgactctaggagacaaaaggaagaaacgcaacttcatggagaattaaaactaagtcctttagttatttagttgctatctcatttgtgcctctctcaatagaaggaagggggaaaggacagacataattattatgtctctgctttacaaaactcagaactttgtttggctcagcagtgaactgatttgccaaaggttacgaacttaagatgtggcagagcccagacttgtaccctggcctttgctggtcccctctgtgttcaagccttatctgtggctgtttaatgtttattgtccatgaccctgttctggtcccagggatccatgcccaaccccttgcctcatattaacaagtaatctgtttctgagaagtattttttctttttataaaatttgtagcatacggaatggacagccgacctcccatggcaatttttgagttgttggattacatagtcaacgaggtaagtactgcctggtttccttcaccttggaatttacttgctcatcttaagaaaacacccaggtggccgggtgcagtggttcacgcctgtaatcccagcagtttgggaggctgaggcgggtggatcacacgaggtgaggagttcgagaccagcctggccaacaaggcaaaaccccatctctactaaaaatacaaaaattagctgggcatggtggtgcacgtctgtagtcccagctactcgggaggctgaggcatgagaattgcttgaacctgggaggcggaggttgactctgggaaaaacaaaacaaaacaaaaaaacaaaaaaacacatcgctgtcacaggttcagtctactagggagtttaatttaacctctctttactgtatgcacagctttatactaagcaccatgggctgtagaaaagcagtttcaggattagttcgtcgctgcttaaggatttgagggaggcagagcatgttgcatttgtaggagtcagaaaaaaagccatccatcctctactgctggggacctaggctaggtggttctgggtggtagtcatattaagggaagggatatctgaggttagatacgccattgcgtctcctagtgtgcactgctttcttccaaattttcacattaatttcccatgcaattctcccaagcattgctgaggtaggccaaattggttcctcttcaaacaggtgaggaaattgagcctccgagatgaaaagtagcccaggtccttcccacccagtgctctttcttccttgccacctcccacctcccattcttacctcctaggaggcttggctgcatggcagttgttctactgcagcctctgctggcacacagcccctctgctgcctagctctttcctgttcagaaggaatggatgctgcctctggaggccaagctgctggtctcctctcttccttgaatggtcccttgattccctcagcagtggggacagtctgcagaatggggcttgctctgggtcactgttctaagagctgagttctagtcctcacctaagatcagactgacatggccctcaaaggaagagcactaggttgggctttgtggtggggatcagtgtctcatttttagtcccaaattaaaaacgagattttgggctgtacatcagagcagtgacatcatggacattatgtctgtgggtcagcatgggtacacacagctcccagcccaggtacataagtgggcccacatttcctggactgcatggaacgccatgagcccagtgctccagagccttgtactgtatagtgctgcatgatcaccatgggaaaatctgaaaacagcctcatttctggaatgtacaggtaacattcttccagatccagccctctgtcagttaatgttttattaacttttcactgcttctctagggctcagaaaagggatttttaaaaaccggtttgcttctgcaggtgctgtcagacctgggctatgcctggtggtttgcacgtgcccctagctgttgctgccagtaaattgctggttacgttcccatgccgcactccaagatttaccattgtagagtgtcagagcttgaaagggtccctgagatcattaggcccaacctcttcatgtcatagaagagtaaactgaggctcatagaggaatagtgattagttcaaaatcacccgacaagtgagtggacttgacttggtcccaattctaaatgtgctatttgagatcagtggttccaacatggttacccaacaggcagcactggccttctacctgtgcctttccttgactggatgagagtagtactgcctttggactgcagagaagactttaaaaaaaagtagcactggctggtgggaggggtgggatggggagaggagatggctggagcaaggagccaggcatttttcttatctcaacatgtgtttgcagcctcctccaaaactgcccagtggagtgttcagtctggaatttcaagattttgtgaataaatggtaagttggctccttgttctctggaagcgtatactctggatttgtcaggctccccaccccatttctggaagcaccagcattgcttctgcaggcagagttttgccctttaccctcccgtctgatgattcttggctgctgccataagcccttttttagagtgccaagacttatgtggcatgtctaactacatcatggatgtagtagctgctccttttggtacttgctctccagggattggcacgttgctttttgaccttagtttaactcagcaagaatgtattaacttactgtgggcatgatactgtgcttagaacaggaggatgaatcaagcccaggcaatcctcggcctctagtgtgcagagaagacaggcatgcaaacatgttatttgagctagaaccagtgccaggcaacagctcttaccttgtctttcttcctttaagcttaataaaaaaccccgcagagagagcagatttgaagcaactcatggtgagtctatttattccggattcttacagtacctgtttattcatttgttcttctctgtcagtcatctgtgcagtacttccagagcccattcattccctgcccactgtggtccagctgagcctggggctgcagaataccaaacaccagtctcctttgctctcccatcagtttaagggaaagctggggtgacccccgcagcctgagtaagcatatgccagaggaaatgcctgagggggccatgggaaagaaaaggccagcccacccccttcatggggatgcggcctttccctaatactgactgcctcatcttacattcagcctccttccagagtcactctccgcctgctgtctcgtttggtggcagtggaaatagctaagtaatactgtaaatatctggacagccatagacggtgtatatagtatataatatgcactaagtccatcattttctttgtcccttctaacaagcctgtgaggcatttaaggcagagttactgtctccatactgcacgagtaggctccaagaggtgacttgcccaaggcctcacagctgctgtgactggtggagcaggtctttgggcctgcagctggccccactgttgctcaggggcaggtgccaggtgctctttccaagtgcagcacaagctctagacctgaaactcttggattttccttcctggtgggttttgtttttttgtttctttttaacaccacgtcctctcgtttccttacatgcaggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgtttagatgtgcatttcacctgtgacaaaggatgaagaacacagcatgtgccaagattatactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcttgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagctacttttgcttttgtggtaagcttttcagtttctttagtacacaagaaatactggtttagccaagcaacactggtgagggggaaaggtgaagatgaggaggaggctggaaggcagaaacaggacaccgagttcagtgctttggactaatggggcttcctgtaatttcaatctctggactcagtccagctcttctcacccaacacccttatctgtgactcttccaaccaccttccttgtgggacctgtgaatagatcctgtatattcctttgatctcttttatacaagggaaaagcagctgatgggggactgggagcaaatctgagaaaaatgacaaaacatttcttatctcacagaacatttctcattttccatataccaatagttgagctgagggcctgcctgcacttttaggctgtcatgctcataggagggccttgctggtggccagcttgcctacctggtgtgggagctttctgcacaacataggacagtctgtctcctttgcgacattaagcaatggtttcccttctttcaccacttacacttaaccacaccttcctggaaaggaggaatgtgcctggcgctggctttgtcatgcctgtgaggtggcagtgatgtcacaaagccattgggaacttcttttaggtacatttgaggctgctggtcaatacctctccgctcattattttctttgaaagggcaggttacagaaactaaagccaacatatatatttataaataaaaggcccattcctttttagattaaaaacaaaacttgggtaaataatcttctaagtaggtagtccaatctagaggtaccagagcttgggatattgccaggattttaaaaaaatgttgtatatacattgttgtatatacagtgttgtatatactgctgcctaagctagtcaacttttttctctcactgtgaagtatagcttttctaagtcaacagtttaacttatacattttcaacatataaacatttaggctgggttttaacatttacactgtgtgtcttttacaaatgacaggataccatcactactgagaatgtttcattaaaatgagaatactacatccttagaagaaatgttataacctggtatctaaaacctagatctgaccactttcatgctcagtgtcttttgaggggtgtttagattttttttttttaatttttagccaagaattatgatccccgcatgaatcttgcagtgttttgagctcccaatgccagattcttactgagataccaatgatagttggatttttaaatgatctcattagcacctcatagcaacctgtgaaa

SEQ ID NO: 13835 - DNA, 88245 bp, Human
gagtcttgctgggggattccacacccatgagatgtgtgaatcttgagacttttttgctgacagattttatcgagtgctcaccttgcccatgctctgttagggtctcaacaggaagcagatgacataattccaaatagggtaatttgaggaaggttatttgcaatgagactatttacaacggtgttgggggtaggaaccacgagggaggatgcagtaacttgtgggtcagcagcagccgtgatgtcatcacttccagacctgaggcacaaagggaagggctactaccgcaaactggagggagggccagggagcagtgaccttcagctgagggacctgccaactggaggtgaccttgccagtcaggatccaggggcttaacctactctaaccaacctttctttttcctccaatcttctgtggggttctccactgggcacgccccaaagccagggggcacagggagcgcgaagtaatttgtagaggtcagcctcctggggcagagggcaggcaggagaagtatttggagcagatgagggtatctggaggggaaaatgtaagacatcaggcacaatattgccctgtctaatggacagagtgattccaggttttgtagggactgaagctcacataattttgggggatctactttaagaaaaatcagctgggtgtggtggctcatgcctgtaattctagcactttgggaggctgaggcggggtggattgtttgagctcaggagttcaagaccagcctgggcaacatggtcaaaccctgtctctacaaaaaatacaaaaattagccagaagtggtggcctgtgcgtgtaatcccagctactcggagggttgaggtgggaggattgcttgagcccaggaggtcgtggctgcagtgaaccgagatcgcgccaatgcattgcagcctgggtgacaaagtgagactatatctttaaaaaaaagaaaaagaaaagtaaaatcgacaaataaacccccaaagctatgtaaactcattgagggacctgcgcaagtgaggtcctgaagcttacgcttcattggcttcattgttaatctccctctgcctgtgacttcagtgattttgacctagaacaatgacccagtgcccaataagctctcagcctcataggtgatggagacttagctgattataataaacacaatgcggccgggcgcggtggctcacgcctgtaatcccagcactttgcgaggccaaggcgggcggatcacaaggtcaggagatcgagaccatcctggctaacacggtgaaaccccgtctctactaaaaacagaaaaaaattagctgggcgtgatggcgagcgcctgtagtcccagctactcgggaggctgaggcaggagaatggcgtgaacccgggagacggagcttgcagtgagccgagactgtgccactgtactccagcctgggcgacagagtgagactccgtctcaaaaaaataaataaataaaaataaataataaacacaatgcaaactgtggcatacgttgattacagatgaaacactatagatgattaggtagacattgagatatgctttgaaataggcttcgaaaaacaggtaggatttagacacatatcaatgagtgggcagaataatactaacactatctgctatttattgagcaccaactaagtttaaagtactgcctatagattatttcatttaatcctaacagaaacaggaaacttattttacacccaactctctgccaatacacttaataaatcaagctactacgaacaaggctgtaaaccacatttcctagaagaccagggagcagaaggacggggatctccctttgccgctaagagactccaactcccaggatgccttgggagcgctggaccacagctcccggcattcccggggaggcgcggggctagcgtagcctccgccccgcgcctcgcgttaccactcgtcccgcccctcctcgtcgcctccgagccaatgggaaggctccatactgcagggtgcgaaggggccggcgccgctgccgagttacgagtcggcgaaagcggcgggaagttcgtactgggcagaacgcgacgggtctgcggcttagggtagggaggccgcaggcgacacggctcgaggactcgcgcgccgagccgggggcgcggaggcgggcggccggggctggggccggcactgggccttccgggcggcctgtgggtccaccggggtgcgggagtcgccgtcagcctcggtcgccccgcgggaccgcgctccgccgcgtggcttccgcctgcgcgggcgtccgctccttccttgtctcgttcaggccccgcaggcgcccccggggatgcctggactggccaggccggcccccatctgagctccacgttctggacgcgcgtggtgtcgcggccgagctcgcaaacgccgcctcgggcctcaccgggaagccggttctgtcaggcggggctccgggtgaacagcgcaggcgaggcccctgccccgcagagctcactctgtagaagggaaacaacacacgcagctgcgatgttttgcggatacggaaatgctttcttagaaacgggacaggcagttgcgggctagaggaatgggggcgaggctctttaggttaggtgatccgggagggcatctcagaggatgtgacctttgacttgagacctgagaggggaggccgacccctgaggatagcagccaggcctggggaccgcgaggccgcccgttatttccctgtcacatcgcggggaggccccgtgatcctgtacttgagggtctgtctggtgcaaggcagttagagccgcttgtgtgttttgcaagggactttcataaccgtttgacagttcctcctcattctgtccttacctggcagggtggcatcctttactgttgcagctccattcaggggcaacgcatagtttttcctaccaccgaaatagtattgtggttctcgtctcaaaactcttaggtggtagaattaaattcgacagacagcagcagagtcagacactataggttcctgttgaggccacccatttttctgatgtcctttctttcaagtcactcatttttgttttcctttgtatagactcttcccttccctttcctgtgtccctttcttggaacaacttggaaatacaatttgctattgggaggatgttggttttagggaactgttgaagaacttcattaattattgtgtgtgtgtttttcttttcttcttctttttttttaaactggaattgcccatctgttgagactgaaattcaagagtaaaaaaaagtagggcagcatttattttcaagagttgacaataaaggcacctttctttatgacatgctgagcatgatactttgggggagaatttaatctagaattttgaagcattttcagaaggaagcaagggttctttatatagtcattttatgtaggttacgtttatgttcttcaaaatggcatgtagtgattggaattaaatttctgggtagataagattatgttcatctgttacctatagaagggaatgtaacttaagtagtcacttaataatagctttctctgttgatgctaccacagatggtattctctacatctcaacattgctgatcagattctgtgttaatacagtaacacaacttgaatttaataacaataaacttgtgttaggcgttactgtcaatttagttctggtatccagtacaaataccagttttatagtgcaatgtcttcttgttatgttcagtgctgcaaaaattatgagaggatatttgttaaacaaatgagataatggagtaatgtgttaagcatagagcctggcatatagtaagttagtaagtgcccaggaaatggttatatggaaagcttatgctaagttttattccagtatgcaagtgtgtattttaaaaataacagtaatgcattcaaaatgttgacagaccctaaaattaaatttcttaaaggaaataggccagcttttttttttaactttgagaactaatgtgaaataataataaatatataagtgaaatgtcccagatgtctagaaatgaaaaaacaagattttaattttgacagctatatttttttttcttaaaagcatccctaataagatataatgtactatgattaggattatgatttgaaaaataaaactttaaaaatatttttgatttgaaaaataaaacttatttggaaatgaagcgaagctttaagatttaccttatatcaaatgaaggatgtctcctgaatttatgcaaatgtgcaaatgcttatatctccgtagatcaggcagtgagcctaatgggaattaaatgctgcctctttgtgcgtgtgagtgaggctttcatgaaaattgctcttgatgggttctgagaatggattggtagctgaataggactggagaatatttttcagactggtaggatattttacatgcttgccagggttatttttcggagtaaggagaaatggactcatttattcagcagagatcacgtgccccctatttacaaggaattgtgctaggtgcaaagtctattgctattgtagtgttttgctgaagcaagttttctttgttttaaattagtgtacgtctttttttttttttttttaactttatctagcatccagcacagaataatccaataaatgtgtagggcgcatttgaaaaactgcactattaatgttaaaatgtagaaaatgtttaataaaggtacaagattaatttaaaagggtgatagaaccctaataaaacatttaggtaggtgttgtaaccaagatgtatttttactctaggataagtttggctcttttgatcaaaattcctgtgaatatatttctacttgccattataaagatgcagagggctctgtcctttgaattttttccctttggtgcttgaatgatatttaagcacccagcattctgaagttgctgttttgaagtaatttcatgcactttcccaattactcctgctccatctctcccaatgttgtcttaaatctttgcactcaaattcaagcacatcctactcctcctgttctgagtgacatatgggcaacactttaaaaaagaaaagctctctagaaaatctagagaggtacgagcgatggcccttctcccatattaggagttagatttttagtattcatcaataaatactgatgagaagaaactgctctacttttaccaacattcttcaggaaatttattaagatttttattagccacagtatctttgtcagcttggaaacatatatgtttgtgaatcacatttatttagtctttaggtaagtatatggattttgatgattctttgcagttactcctatctctctatgggtttcttgcccataggatgggaaccagtactctaggatttgaaaattaaggtagatactgttcacactggcaaatatttaagatgaatattaaacgtgtatactaaaatgtttattggtaagtaattcattaaatgggaagatatactagatgaagtaaataattaaattgcaagcacaagcaaattaaatttgagatttgggaatggtctgtcatatacttttaaagcaaatatcatactgataatggaaggacacgtgtcttgtggagctcagtatcaggaacaatatagttggtcctgcaggggactaaacatgagaactgaaagtcattaggaacacgagcagcctcattccactgttccagggaccttataatttctttctgtgtatttattttattttctttttgaggaccgtctgtctggctgtttgtatgtcggcagatatgtctgctctagacttagatacttgctttaagaatccaaaagagattgcattatctaattgtcatttatatctaaaattaaacaaaccatgaagttagacatagctaagataaccacagctttatttcaggttaattgcttttcttagattgtttttatcaagtgacagctaaagaaaagtcatcatttgatgacactaagtattagtgcattgtgattgcgtttcacaatattaagtgttagaaagaactattagaccttaagtatttatagaatgtgtctggaagacacagggagagaaactgttaatgtttctactgtagtctttagagttgcttttttcacatcttattgcagtttactatgtaatttggcaacagctatcaacatagagattatatgtaattacagtgtacccttgaacaactcaggggttgggagtgctgacccccatgcagttgaaaatccatgtataagctttgactcctcaaaagcttaaccactcatagcctgttgaccagaagccctaccaatagcataaacaattaacacatatttgtatatgtactatatgctatattcttacaatacaataagctagagaaaagaaaatattattaagaaaaccctaagaaagagcaaatatatttattgttcatgaagcggaagtgggccatcttaaaggtcttcatcctcattgtcttggtgttgagtaggctcaggaggaggaacaagaggagaggttggtcttgctgtcttggagtggcagaggcagaagaaaatctgtgtataagtggacctgcacagttcacactcatgttgttcaagggtcagctgtatgcatttttttcttagaggtaatctgttatttgggaatcaggaaaaaagttttaaaattcattttttaaaaataagttcaggttataacatttaagaagtttaatcttgttttttcagacttgcagaaaatactttagaaatgctgactctaaaatttatctttcatatgttgctggtaggaatgtaaaatgatataaccactctggaaattagtttggcaatttctcgaaaagttaaacgtacatttgacacacaatccagcgattgcactcctgagcctttatcctagagaaataaaaacgttcacaaaaaaacctgtacatgaatgctcgtagaagccttgtttataatagctaaaaaccagaaacaactcacatgtccttcagtgggtgaatggttaaataaaatgtgatagtcttgcggtagaacaccaccatcaaaaaaagaaacaaactgttggttcatgcagcaacttggttggagtttaagggcattgtattgagtgaaaaaagccagtctcagagattgtatgattccatttatataggattctcaaaatgacaaaattatagaaatgcagaacagaccggttttgctggggttagggctgactttctttgagatgatagaacagttcagtgtcttgtttatggtgatggttacatgaatctgtacacatgacacaatgtcctagaattagacacacaaaagaatgtaaaagctgacatttcaataagtagttcagtgatgaatattgtattagtgtcactttcctgcttttgataattgcacagtgcttgtccattttatggctgtatcacatttaaccatttacccatggaaggccatgtgggttgtttctggtttttggtgattgaaggtaaagctgctatgaacattaatgtacaggttcttttgtgactgtaagttttaattgttctagaataaatatctagaaattcaactgctgggtcatatagtgataaaaccttgagccctcttattctgtcccaggtggggtgtaaatcatccctttgtccagcatatccacactgtatacactacccaccagctagttagtcactcttggttatcagattgactgtctggtgtcttggtgcttgtgtttgagaatcccttattgtacttagtagtgaccccaagtgcaagactagtgatgctggcatttttttttttttttttcttgaggcaggtctcttatcttgtcccccaggctggagtgcaatggtgtgatctcagctcactgcaacctccgcctcccagggtcaagcgattctcttgcctcagcctccctagtagctgggtcacaggcgcctgctgccacgcaccgcaaatttttgcattttaagtagagacagggtttcaccattttggccaggctggtctcgaactcctgacttcaggtgatccgcctgcctctgcctcccaaagtgctgggactgcagggagtgagccaccgcatctggccgctgacatattgttataattactcttagtattgttgttaatctcttaactggctccaatttataaattaagcttcatcataagtatgtctatctaatgtatgtataggaaaaaacgtatttatgtagggttcgatactctccatactctccaccatttaaggtatccactgagggctttggaatgtatccctcacagatgaagggggtgctgctgtgtttgagagatacagtttctccacaacctcactaccatttggtattggtgatattttttgtgcgtactggtatcttgtcatggctttaatttgcatcctaatggctgatgatttcatgtgcttatttgccattcatattttttttggtgatttgtctgttcaagtcttttacccgttttgtgattggtttgttttcttactgattttagagcattctttatatgttgtgtatacaaaatcctttgccaaatatatgatttgtaaatatattctctcagtctctggcttgtcttttcattctcttaacagtgtctttagcagcaaaaaagtttcaaattttgttaaagtccaacttctcaatatatggatcgtgtttttagtgcctatcttagaactctctgcctaactctaggtcaggaggttgttctcattttttcttctgttttacccttatatgtcttacatttagatccgtgatcctttttggtttcatttttgcacaggatgtgagctttagatcttggtacatttttcttttccttttgtccatggatgtccagttgttccaaaaccatttgttgaaaagtctaccctttctccattcaataagttttaaaaatcaaaaatcagttggccatatactgtaaattaggtatcaaaacaaagacaggaagaaatgaatgagcaattaactattaataaatacaggtttattgaaggtataacatggctggagtctggaaaaagtgggaaaacattttagagaataacatgggcaaagatctgttctagagaaaataagtaagaactggctgtttttgggagtcatgcaagtgaagggaagtagagaagtaaaggaaggatcattggttcgtgaaaaagaaagagtatataaacttctggctagattgaagcatttgtaatcagtttcattggctattaggaaggtgctgtatattcttaatcaggaaaatggtatgatagaaatggtattaaagagaagttgttttaggaccatttgtggcagtgatacgttggtaggaagaacaggatataatcatgacccttgacttacaactttgttttacaaatatctgccagaaagctaaaaaagtggtgttacttcagaatgttataaattcctagtattttctagaaggcagtggtagatttcaaacttttgctgctgtcctcagtgatggatatggagaagtcagcaggacttccaaactgtttcgtatttatgctactgttattaagttgtacatttgggaaaaagagtagtttccgttggctcattgttgatgtgggtgacatttcttaccaggcctgaaaagagtccaagcgttgagcaactgaaatgataaaaacatgaagagttcataaatcggtccaatgaggaaaagttaatgggatcagatttatttatcatggcaaagaggagactcaggggttatttaatcagtatgtcctgatacttgtatgtgaagaactatacagagaatgatgatgaccagctgttcttcaaaatcctgaggactgcataagaacaaatggctcaaattgcagctttaaggttttggtcttagggaagaatttccggacagtaaagacattatatatttcatgtgagatattaaaggatacactagaaacctagatgtagtataggaacattttgcttgtagtcagggggatgtgaaagataacagatctatgtttttgccctcgagtcctattaaattcatgagcaaaagtactcactttccattttgttagtgcctacttcagttgttagtttctttctccatgcaaattatactcttcccctcccctgccgtttatctgtggggatctctttggtttctgctttcttttgtgcatttaaaagattatcatggctgtagattagacttaagtcattttaaaaataatcagtcaacaaatagaacctgtatagtgtcgaactactagaaatcaatgcatttctgttcctatttagaacatggaaaaatgtatcattccattaagaaaaaaatcagtgatgacttgttgaggcaaggattttacagtgtaagaggttaccattgacacatgttaatgaaagaagggcagtgttaaaagctttcatgcaacatctcacatgtttttaaagtacctgttctgtttgatttaacttccttattctgattcttttctacttgtctagatctttttttccactgaaatgttgagattgaccaagaatatttcacttgtgatttgcagcccttcagtattatcacagagaatttttctttttttttttttttttctgcagaagagcaagctcttatagtgctatgcaagctgcccatttaaaactatcattgcttggcacctatgccctagtgacagtttgaccaacatgtgagcaggcatactgccatcctgacagatgggcgtgagtataggcagccaagaaaccatgtatctgcatctagtgtatttgttaagggcaggattcccagtcggggatgttcaaacgtctgtccattctgagctttcacgcctatggataaaaggatgtcatcattaatcccatcctccatgggtatataagagcttcttggctcttacagaagtaggcaattggggacaatcaggataattgttctcttcttcatcacaggactacttcaaataatcctttcctctttctcctagccagctaggtttacagtgagtacaaacctgttcagacattgtcctgatacttgtggaatatgtgcttgttcatttcttttccagagtgtgaaagctttgaaagtcatttgatgtttatgctttggacagtgacatataaaattgggtcaggtagatctagttcaaatattgactgctgtgtgacattagagcaattcaatttagcatcaaatcaaggtaaaataatacctatcttagagttgttgaattaactgcaaactgtatacatgagtcatttggtgtaatgtctggcccacagtaagtgttcaataaatgtttgtcatcatcatcattttcactttgatatacctgaaggtatttttctctggagaggtatctgaaacaaaacttttttcaattcactctcacttcccatcattcccctccctccctccctcccttccttccctccttcccttcctctcgctctgtcaaccaggctggagtgcagtggtgcgatcatagctcactgccaccttgatttcctgggagcaaatgatcctcctcctgagtagctggaatgacaagccaccattcctggcccaccattcttgtgacatcatcacatggtctggtctatgatgaaatgcctccaacgacagagaactcactatctctagggcagaatttctcaaccatgggactgttgacattttacatgggtcactgtttgttctctgcactgtgggatgtttagtggcatctctggctacagagacaaaatcatctctggttgagaaccactgctctagagacagcctatcctatttttattaaagttttgaccattagaaaattctttcttacattgagtggaagtctacttaatttcttctactcacttctgccttttggagaaatgtggaacaggctgaatccctcttccacgtaacatcctttcaaatatgtgaaaatagtcatcaagtattctcagtctttttgatttgaaacatctccagttcattagctattccttacatggcatggtttcatgtcagtttaccacattggtggctttcctctttttaaaaaaatttcattttaaactgtagtgctttgaattgaattctgtgctccagacatggcttgatacgtgagaaatagagttgtatctcttgttctagatataacacttttcttctgtgagttaagggaagaatatcaccttccttcttctacataattttattaatattagctatatccttttgtgaccacatcatacattgaacataaagttgaataaaatccctgcatctatctaagctatgtcttttcatcctgtttgtatgcattagttttggggtccaaccatgggagcttatgtttgtcttgttaaatttctttttattgaatttaactaactgcaacttttaaagatattttggaatcctagttcttggtttaattggcagtttctagcctaaaagaacatgtatgtgatgatgctatgcactgagattggaaatacaagagaaagaagtcactctctctgtctctctctttctctgtctctctctctgtctctccctccctctctctctgtctctctccctctctccctctctccctctctctctccctctgtgtgtgtgtgtgtgtgtgtgtgtgtgtgtgtgtgtgcatgtgattgaaaagagattgagtatggaagcctgggtaataccaatattaagaggcagctgggcagaaaggaagtaagaaaggagaccaagaagtggtggtcaaaaagttgggatgaaaataataggagtatcttgtaatgctggagtgactctgtgttaagtactgtggtagatacttgaataaaaaatgaataggacatggtccctgctttctgcccctgtttttgtttaattgttcagtttatggaactgcctagtcagtcattcctgaagacttggaagtcatcctttatttctccctcatacccttgcctctttgggttaccaagctccattgattaaaaaaatttttttgaagtgtaacaaaaaggtgcacaagcatcaagctcaattatttttaaagttttacaaagtgaacaccctgtaatcactactacccagatcaagatactcattttctagccctcagaagcccagattatgtggggatatcttgcagacagtagttactcccacccaaggtaaacacgattctgacttacataactatagttttacctggttttgaactcatgtgtaaatggaataatgccctctggactttttttttttttttttgcttgacttcttttactcgatgttgtgtctgagattcattcatgttgttgcatgtagtttgttatttttaaaaatagctctgtagttgtggttatctatccctgcataacacactagttttgattattggttattgcgtaacacaccactccaaacttactagtgtaaaataacaaccattttattatgctcatggattctgtggattgggaatttggtggttatggcttatcactgccctacgatgcttggggtctagaatcatttagaggcttctccactttcctgtatggtaccttgactagaacgtctagaagactgggatcatctgatactgttgaccaaacctacatgtggggtcaggaggttttggcttttcacagcatgttggctgagtaccttgactagaacgtctagaagactgggatcatctgatactattgaccaaacctacatgtggggtcaggaggttttggcttttcacagcatgttggctgagtgtccagaggaagcttcctgagagtggcttatcttcagaagtcatataatctcacctccaccatactctattggttgacaaagacacagcctgcctggattgaaggggaggggacatagacctcatgtctttatgagaggtgtgtcaaagaatttgtggtcatttttaaaaactaccacaaattacatagcaaaattcatttattcattccattttaggtatttgaatagtttctattttgaggcaattatgaacaatgttgctataatcatatacttatgtatatgtatgtatcttttggcatacttttatattcattttggttgggtatatatgtaggagtagaattcctggtcaaaatgtatatgcatctagcttgcttgcttgcttgctttctttcttttttttttttttctgaaacgaagtctccctttgtcacccaggctggagtgcagtggtatgatcttggcttactgcaacctctgcctcccaggttcaagtgattctcctgcctcagtctcacaaatagctgggattataggcgcctgccaccacgcctggctcatttttgtatttttagtagagacagggtttctccatgttggccagactggactccaactcctgacctcaagtgatctgcctgcttcggcctccctaagcgctggggttacaggtgtaagccactgtacctggccatgtgtctagttttaatagacactgccaaattgtttttcatccttgttgtacctatttatacttttaccaacatatgaaagttccggttactctgcagctttgcttcccttgatattgtcagttaaatattacaaaaaattaatcactagtggctgtatagaagatcttagtgtggttttcgtgggcatttctctaatcactgataatttgagcacttcttcatatgcttgttggccatttggataccctctgttataaagttcctgttcaagtcttttgtccattttcaacagattggattgtcttttttcttattgaaatgtggagtttataaggtatctggatatgaatcctttgtcgaatatgtgaattataaaaatcttcctgtcttacagcttgtcatttcactctcataaagtttttgatgaactgaaattctgaattttaatcaattccaatgtatccatcttttcctttacgggtagtgtttttttgtgtttaagaagtttttgctactctagggcgatgaagctattttcttatgttatcttctagaagctttagtattttgcctttcagatttaggtcaaagtccccaggaatttgtttgtgtgttatgaggtagggatcaagccttcttttacttttttcatatggttatctatacaagtagtaacaggtggcattgggtctgttggacacaagcctgggagttaggattccagtattctccaccttagattacctttaatgagccttctgcacttgggcatattcttaaatccgtcttgactcagcttcatttgtgaaatgaaggatttgaatggaatgttttctgattttcattctgactgtggtttgttagatctctacctacttttgtagttgtattgaggcttgttagaatcttcttatatctggattgtgttatctaaaatattcataacatctcccagctttatgttgttcccagttcgaatgtgctatctagaacttagctgctgatgaaagatagttttattgatcacgttggcaagtccaagatcacctgttcttctgatttttttttttaatttttttttgagatggagtgtcactctgttgatagtgcagtggcgctatctcggctcactgcaacctccgcctcctgggttcaagcggttctcccacctcagcctcccaagtagctgggattacaggtgcacgccaccacgcccagctaattttttgaatttttagtggagatgggatctcaccatgttggccaggctggtcttgaactcctgacctcaagtgatccacccaccttggcctcccaaagtgcagggattacaggtgtgagccaccgcgcccagcctctgatcttactaatatactgtgtcccttgccaggagctcatcatgctttgtttagtaagtcatggtagaagacaccaattccattaacaaaaaaattagctatctcctgcagaagggagcaaattccatttttgaaagtcatctgcacatactattcatcttacttgtccctaccttcagtttcgtacttgaacttttaagaatcacatacacagcatagagtttcatgaatcagcagaagtcattcaagatcagtgagttgtagtcttggcaaattctctcttccatcttggaaagtggcatacattccaaattactgtataatatgtttgtgtctctaagaagagtgagtcaggaactaccctggatgacagaacagaaaatctaccatttgctggtttctttgtgttcttagtggcctgctttgaggtgcttttaacccttctttgaaaagatttagtttagtttccacagaacgctataatccagtgtagctatttttctttgttatccttgctatcacattttccctctcattaaccttttttttttttaaagcaaacagctttagtgagatataacttacataccatacaattcattcattaaaaggtataattcagtagcttttagtgtatgcacaggactgtaaccatcaccataatctaattttagaatgctttcatcagtactaaaaccccctactcattaacagtcattctccattccctacttgatccctaagaaaccacgaatagttttgtctataaatttatcaattctggaaattttacgtaattggaatcatataatatgtagtgttttgtgaccagtttcttaacgtgtgttcagggttcatccctgttgtacatgtgttaatactttatttctttttattgctgaataatattccattgtataggtgtaccaaatttgatttatccattcatcagttgaaggactttggggttgcttttgctttttgactattatgattagtgctgctatggacatttatgtacaagttgttgtgtgggtatgtgttttcatttctcttgagtatacctaggtaattctttaagttctttagggactaccaaactttcccaaagtggctgtattgttttatattcttactaacaatctgtaaggattcagatctctctagatcctaccaaaacttgttactgtctttttgtttatatatgtcctagtgggtaggaagtggcatctcgttgtggtcttgactttcatttccctaacaactaatgatactgagcatctttttgtttgcttgttggccatttgtttatctgttttggagaaatgtctgtccaaatcctttacccatttttaaactggcttagttgtctttttgagttcattaaccttttaatgttcactctgatttacttttaactcaaaatgttttttctttttcttccattttgttcagagactgttcgttctgtattaagcaggatggttaagagggttttcaagcccttttatgttttcttggcaacaggttccattagcaacatacatacatgtggattactttagattggaaaatgtacatctactggttattggaatagatcatttgtggttcatactggttatattaataaaatgaactctgctcctttccctacaaaccagtaggtaaaatgcttggctttgactttaatcctagcctttcattttacaggtaaggaaaaaagacctggagaagttgggtcttgtcttaagttcacaacaggtagacctggaccatgactttaattcagcccattcttaagaactatcagttggtttcacatcatgtggcagatatgttagattgaagggataccaaggtaagacagggtccctgatttggcgatcctcacaaactgtgtcacaagagattgacatatacataactaatggtaatacagtatcacaattgctgtgaattgtgaacaagggtgtgtagtcagtccagtgctcttaacactgctcggtgctgactgggattttcaccttactttcttttgcatataggcagaattagattcttgagtagttgattttgtttgggtcatttagtaagaaatgataacacaaatgccatcattcaaaccctgagattacagaagaaacagactttagaatcttcagggttttggactagaatctagaagatagtctcattaagtgcatattttatatgtattattttcttagcttttttcatatattcttcagtggcgtatacatcaagtttttttcagctgaatttgtgttagtatattaaaaaaacaaaacttttcggaagacgttttatttacatcagtgatttatttcattactacgtttgtcctttggatttttggaagtcatatttcttttcacttgacagagttaggccatgggatatgtatttatagtaatgtgtgagtatgtttaggtttgatcttttatactatttttatggcatttatatttatggctgtgttattagtcattaaagcaaatatttttccaccttaagacttcttgttttgcacatgatttattctgcagtatgtgctctcttttaattagcaaaaaggcatttttacaaaaattacactttccttgcaacttactggttgtaaggccgtggacaaattatttaatttcacttatccttggtttccttatataatgatacagtcagtatcattatacctttgttttatggttatcctaagaattagagataatgtgtttaagttacccagcatatagcttgccatatagatgcttgaatattgatggtattaattgtaatatattagttcatttatacataagagctataaattctagttaatggttaatcgattctttgtgatatagattactcatttaggattaattgagcaaaaataagtgatcatattaatgtaagaacttgatatcagtattcattttcagttacttgtcttttagagactgtagtactttaaagactagagactattgctctttaaagactgacctcatctttatcttcaaaacatgaaggtatgatcctgtctgcagattaaggtattgagagttatttttctatgttgtcaattgcagtgttttaacttgtggcagttgacagggctgactgtgttgatcctgatgctttagaagcactggtaaattctagactaatattggaaagaattacttgacattttatttactaaagttctttttgttattcatgaagaattcttaaaaaatacctcaattgaaaaattaatacatgcacacaataataaatttagacaatataaaagagcaaagaatgaaaattaagcttcccacccttaaggcattctctgctactaattgattatatagcctcctagtaatgtgctatatgtacacgcgtggggatacattgttgcacagctcccaggggtgcagtcatacatattcaagcatatgcagcatatgtataatggtccttttatatgaataggaatgttctcatacaaggttctttccttgtatttttcacttaatgatatatcttggcgaatattccatgccaatgtatgtagagctaccttatttttaaaactgcctaatattccattctgtggatatgccatgcttcatttaatattatgttggtgcaaaagtaattgtggtccaacctaaaagtcccctcttgatggtaattaaggatctttctagtcttttattgtatataatgctgcagtaactatccatgtatatttgacagtacgtgagtatccctgcatgataaattactggaagtacactttgtgagcaaaagggagtatgcatttaaaattttgataatgccaaattgttatgcctttttcctcatactcttaccaacccagtgcattttcttattttttgaatatgactaatgtgataactaaaaaatgtcattttaattgtaaattaagtctcattgtaattttaatttgcattttattaatgaagctgagtctatttgttattgatttccaggatatattgttagtgaaagaaatcatggtgaagaacaaggtgtataatattctatctctcatctaggaaatgagggatgcagataaatgtattttatttgttatttaaaaagagaaaacaggaaggataaccccaaaactagtgaaagccattatttgaggggaaaaataataaagacggaggggtagaatctaggattctctgaagataccttatattgtttgggctttggaaatgtaaatgttttatacatttttaaaacttaaagaggaaaatatatcagttaaatatttaggttgacattgttaggaaccaaggtttttaacaaatgagaaaaaaagccgggtgcggtggttcgtgcctgtaatcccaacactttggaaggctgaggtgggaggatcacttgagctcaggagtttgagaccaacctgggcaacatagccagacctcactctactaaaaaaaaaaagaaacagaacaaaacaaattcgtgggcatggtggcactggtctgtagtcccagctgcttggaaggttgaggtgggaggattgcttagggccgaggctgcagtgagccatgattctgctattgcactcagcctgggtgacagggagaccctgtctggaaaaaaaaaaaaatcttcttgctctgtccactcaaaaaacctagaaataatattttagtgcccagattttggtctccgagtaccactttcaactaaaaggaaatagggccccttgtagaagtggctgattgtaggcttgagacaggaaaatgtacagaaggaacctggaacattttgtactaggaaagcaaggaaaagctccaagactagtagggttgtatcaggaaacagtggccacattgaaggggcccccgttgtccagtgggaaagaaaaaagaaatgagcagcccctgatgttcagaagcctcaccggtaggccatgttctcctactaaacataagcggtctcacagaataccttcaacaaagtttctcagagatcataataaaatgaggcaaagcatagacaaaaaccaagaccactgtgccacctacaaaatacttagccaaaatgaatgactaccgctgctttacccattacagttttatcttcattctcatctcccctcccttaggtaagatttattgagatacgtaaccacagaattaccctacttcctgacagcatccaatgtagagaaactcctccttctttagaccctcccccaaattactaaactgaggcccaaattgtgtaattgattttaacatcctcttactgagatgccccatggtgccctgtggtgtgtgttctccctcactgcaatgagtaataagcctgtctcgtttaattattggtggtcttggctgaagggcattgataacaggtagagtaatttgagcaacaatatcagtaacaaaaaatacaaggaacagattaagtgacagtatagggtcacaatcagcaaaattcaaaatgggaaattttacaggacaaatgacaagaagaaggacaaaaaagagaacagtggcactcaaagagactcaaagacacatcagccacgtgcattgactagtatttgggtcctgagtcaaagtcaactgtgagaagacattctttgagaaaactggataaatttgaacccttcttattagatgacattaaggaattactgttaattttgttaggtgtggcaataatatatggtggatttatttttaaaaagtacctgttaaaagtatttacatatgaaatgatgtgttgtctgaggtttgctttaaaataatcttggaaggggttagtagaaacaaacaaattggccatgtgttgttgatagttgttgaaattagctgatgtttaggtggacactcattatatcacttctctacttcatatgtatttgaaaattcttctaaggagaagtttttttctttaaagccatatttatttctttttctgtgagtgtgcctcttcatattcttccatttttctgttgggctttagtcttataatttaaagggttctttaaatactaagaaaatttgcctttagtcatatgttttgcaggtatttttaatttgttttttgaatttgtttatggcttttttttaatctgtggagaatttctatttttattttgttaaatttatcagttttctttatggcttgcgtgttttgtgtgtttagaaaaatcttcttgtctctgagattctgaaaagttctttcatgttttcatgaatttttttaatgaccacagtacacttctgttatactttatttagtcaccttaatttcctcttagagtatttggaaatattctcccatagagccctgccccaagactatatagggaaaaatgttgttcagtagctgttctatcagatctattgatagattattatatagtgaacatccagagaattaattgtaaaagtttgctcactaattttgctccctaaatagaatgaatgagaaatctatttaccagattttgaaaatatgctaagtgttatgtaaaagtattagctatatagttcacagtttctaattttagaaaagtttcagtgtttgctttatataaagaagcattcctttgagctcttctcatgggccataaggtcaaggagccaggtgtcaccgctttttgaagttgacatcttttggcttgctcctttcctaggtctgactctcttggataggcacaacagtgattctgttttctggtctctgtaggaatggatgttactgtagtgtcttcatcactttcgtttctgggagacctgttgagacccaggaatggatccttctacctactatctcaaaagtcagaaacggaaatacagttaaggcttcagggaatgcttcccttgtaggggaaagtgatagcagtgaggtgtcttgggcttgtgtttgcaaatgtaccacactgtgcattctcagttgaaaactaactctgcagttagtgtttctcttttagaacttttagaagttttttaaggaataaaagttgagaaagtacatttgatactatattttaagcattttactcactataccaaaacattttataacctaacgttgatcacttttctaatacaagtaaaaaaatttctgactaggaagaaattttttcttttctgaagatagccactttctttttcagagttagaaacgtgagtcttcacctagttctttccagcttaggtgtgaaaacatgactagtgtgacaattgctgctaaagattgtatcacagtttgagtttagcttaatgtttttcagggataaatctatgaatttatgggatcattatctctggaggttcacttctatatctcatggtttgttgtgttatattttgatacttatttttttaatgttataaaggtaccatatagccatgaatttttttatactttcattgatatgcataattctcctctgagtgaaacctggggacagattgggtgttcctaacaggaacctgggggcagtttccttaggttttttatgtttagtgattttggtcataagtgaattttaatatctaatgaatatccttacagttctgtctcaatcataggatttttgggatcaaaatgaagaaaatatatgaggaccctctgtgtcactgggaagtggctttataaactcaagattctgtattttatttttcaaatgatttcttagcactaatcaaatgcattaatcaacttctgattagctggcacatttataagaggattgtctttagatgtattgctttcaaattgttcctgatgtaatttagcaaaggaggtgatggagttctttgttgactgactatctttcgtttgattttattctgacttactgtagtttggcaggaggccagttataccaaaatatgtaattacttcttaatcccaaataagtttgaaatataaatgagtcattttgtcttagggatatgatgggttgggaaaaaagtggtgtttttggctcctcctaaatcactcatgaatttattttttacccaacttctaaaatgaactggaaaggtcttttattaaaatcctcagatacggtagacttgtatgtaatagagcaattaaagtgaaaatgaatgacttaatgaagaaagtaagatgtaccagaatatctaggtcagtgggtcagtctgtgcatcacagtaccctgtgtagcatgaaaatataaagatgctggggctgttgtggagtaaggcctttactgttccaaagttccactgataattaggttggtgcacaaataattgcggttttggactgtgaattttaaatcattataactaggctcaaacacatctttatcaaaataggagccattgcagtcaacacatttttgccaatgagaagtaagttagtttattcctgtagtgtaaaaatccgtgttttgggattcgatgaactcttggaaagcattttctgcatcctgctggttgtgcaagcgttttccctgcaaaaatttgttgatatgcttgaagaagtggtagtcggctggtgagaggtcaggtgaatatggcggatgagacaaaactttgtagcccaattcattcaacttttggagtgtttgttgtgcgacgtgcagtcgggcgttaccctggagaagaattgggccctttctgttgacgaatgctggctccaggtgttgcagtttttggtgcatctcatcgatttgctgagtgtacttctcagatgtaatggtttcgccaggattcacaaagctgtactaggttagactggcagcagaccatcaaacagtgaccatgacctttttttggtgcaagtttggctttggaaagtgctttggagcttcttctcagtccaaccactaagcttgttgttgccgattgttgtataaaattcacttttcatcactatccgatcgagaaatggttcattgttgtagtgtagaataagacaagatgacacttgaaaatgatgattttttttttttaatttttgctcagcttatgaggcatccacttatagagctttttcaccttcccaatttgcttcaaatgctgaatgactgtagaatggtcaacgttgagttcttcggcaacttctctgtagttgtaagaggatcagcatcgatgattgctctcaattgatcgttgtcaacttccaatggccagcctctaccctcctcatcttcacgcctctcatttcctttgaaaaacttcttgaaccacaccacactgtatgttcgttagcagttcctgggccaaatgcgttgttgatgttgtgagttgtctctgctgctttacaacccattttgaactcgaataagaaaattgctcaaatttgctttttgtctaacatcatttccatagtctaaaataaacaaaataaacagcaaacaataagtcattagccaaaaaacataaagtgagaaatgtccattaaaatgatgtataacataaccacatttatttaagaatgtattataatatcaaacagcaaattccaacaatgcaaaaaccacaattatttttgcactaacctaataattttaatgtatagttaagatagatgttactgccttagatgatggatcgttaggcatttggctttataattttgttctgaatttcctagcattcactgcaaaagaggtaacaggagtttcatagctcttgatatcttaaacacttgcatcattggaagagacacttttttccctaccatgaaccctagagagtttgattttgtagatgtccacaactgttcactatctttaataaatacttttattaaaggcttcagaaacattctttccctgggaagttttttattgatccttgtttgaagttgatacataatattatatcataactgtgtgatgctgtttctgcatatagctgaatgcagctttttgagactaaaggttgcatttccttcatctttgaatttccagcccctagcacagttcctggcacatattttggaggtattttataaatgcctttggaaaaaaggagttcaagtgtttaatttcctggcaaactaaatagctataaagagagagcttagaaagtctagagtaagagatgattagcatgcttcctagaccatctgtcactaataccaattgtttctacttggcactgcagacttgttttttgagggggagggcagcttgtgtaaagttaaaaaaaacaaaacaaaacaaaataccagaactcttaggttattctatacccctctgtttagtggctaaaaagtcattgctgttttctaaaaaacattgacattcttattcagtaaagataaatgcaattattgctttttccaatagcaatacagttgtaataactggtagctgtttctgccttgcccccttacaatctattcttgatgcgtcaaccagagtgatccattcaaagtgcaagtcagaacatgtacactcctctgctcaagaccttccaagatttccccattcagagttaacgttgaagtccttacaatagcctgagtgttgggcatgttctccacctctgtgcttctttacatctgaccccagccattgctctcccctggctaattcttcctcagctgcaccagtccccttgctgtttctagaacaagctggacatgttcttgccttaacgcctttgtagtcgctcctccctcaatgtgggatgctattcctctagagcatctgtgtggctagattctctcacttttttttttttttttaacaagtttttgcttaaatgtcactttcttgtgaggctttaccagaccatctttttaaatttcattccctcccgcccccaactccctgtccctgcctttttttttttttccttagcccttataccattggacatatgacatgttttaatttttagaaaattatttttctctactgaataaaatataagctccatgaaggcaggagtttttgtctgctttgttcactttttattcttgtcttgtagaacagttcctgcacagagtgtgctgtcaataaatacttgttgagtaaacaaattaattaagcaggcagtatgtattgtaataatgtagaattccaatgggactcagtattgtttttattttaaattttaagaggggtgtagcatggtaaagtttttgtatttcttgtcaaaaagttgcagaccattcactctaatagcactactaaattactgatatttacattaaagggaaaatagggtctagtcctattctctactttttaggcacagaatttgattcattgcaaaaccattcctatcgtgaggtgacttgtgacagaggcactacagaagcacttaacattttggatttgtatcaagcttatatagtttatagatggaatgtatttttagaatggactaacacattagcaaaaaatataacaaatgtaaaatctttggtgagaattaagtcagcaggagaatttttcttgacttaggtgttcagtgcatgattttcaatttgattgaagtgttgtgaactacaatgcaagtatacagcaagttccaaaccttgtagaaatccatttaccctgtggtgaaattcagagtcctgacagtagccttcaaggccctacttgatctcttgctcctgtgctaacctttgggacttgatctcctgcttcccccttgctcacgccacaccagccacactggcattcttactctttggttgccaggtgtgctcccaccttagggtctttgcacaactcgtccctctgcctatactctctgcccagatactcacatggtcctcttcctcaactccttcaagtccttgttccaatgagcaaagtcctttcagaggaggctgaccatgaccactctgtttcactgcaagctttccccttctaccttctactccctatcctctatctccctttacctgctttatgtttttaaaacatgactggattttctgaaatattaggtaacatatgcattatttgttctttttatctgtctcttcctgccagaatgtgtcaaaagagaaggacctttgttttgttccttgaggtatagcaagtgcctagaacagtgcttggcacattgtagattatcagtgactatttgtagagtgagtgaatgaacagactatgtcattacccttcatgaatttacataatccacagttaacatttatttattgctgtgataactagtagatttatgtaattagcatctataagaataacctctgaaaaaaataccaattgtaatgcttttccagttgtgtgtgtatgggggcaggaatgattctgtagtcatcaggaacacgttggtattatcttgattcaacttaatttctgccttttttatctgctgcatctagaaactgttttcttttttaaaaaattgtgataagaaacatagaagatttcccatcttaaccatttttaagtgtacacagtagcgttaagtgtattcatattgttgtgaagcagatctctagaacttaatttgcaaattcgaaactctatataccactaaacaacaactctcttttctccctccctccagcctctggcttatttcacttagcataactgtcctcaagattcatctgtggtgtagtgtgtgtcagaatttacttctatttttcaaggctgaataatattccattgtatatacatgccacatttattcattcatctgttaatggacactcaggttgcttccacctcttactattattgtggatagtgctgctgtgcacatgggtgtacagatacctctttgagactacaaactttttcctagagatctgttaacttaaaggaataaacatcaattattttttcaaataaatgtcctgaatttccaaagatcttaattttattgagtagcacatttttaaatatataatttattttcacataataaaatttgtattttggtgtaagctgtggaaatgtaggtggtctgcttttttaacatgataaaaccctggaaaactgtatatgataaagtggaacaagctccctgaatgaaagctcatttcatcttgaaaaaagaatttactgtattcctcaaattgcctaggactgtgagtagcctaaatggtagactggaatccaggatactactgtattttgaaagcaaaaggaagagaatgtttcaagaaagaaagaatgagcagtgttgagtgcttctgggcaggcaaatgagatgattcagtgtcagctagatttcatagcatggaagtcactggtgacctcagcaagggttattagagaggaatcatgaaggcggatctcggagtgagttggataagtaggtgaaaggaaatattggcaagtacagacgattattgaaatggcaagtacagacatttggcattgaaagggaaaagaaaggatgatagcagagatagcagagggggattaaaaacattaattttttttttttttttttccctctgtcgcccagcctggagtgcagtggcgccgtctcggctcactgcaagctctgcctcctgggttcacaccattctcctgcctcagtctcccgagtagctgggactacaggcatccaccaccacgcctggcttattttttgtatttttagtagagacgggatttcaccatgttagccaggatggtctcgatctcctgacctcgtgatccacccgcctcggcctcccaaagtgctgagattacaggtgtgagccaccgcacccggccaaaaacattaattttttaaaatggcagagccataagcatttttaatagctgatgggaaggatctagttgagggagacattgaatatattagagaaggattaattaatagtgtaagtcttgagaaggttggaggggatgggatccaaagcaaaggtgaaggacttgatgtttgataggaggaggatagtttctttcaatgtgataggagagaaggaagctaggattggcttgaagtgggtgcaggtggtttgtaggtgtggctcttagaaagatagggaattcccatctgaagtttctgttttctctctaaactagagtaggtcatctgttgataattatggcttaggaaggggaattagagttttgaggaagaataaatagagtttgacatagtcattgtagagggtggttgctggacttttgaggaatgacattgtcctttgcagttgggtgatgtatattaaacataaagttagatatctggtagttggggaaaaatactaaacttttttgctgtttaattttatggatttagtgaattcctgctaactacaatgtattgtgactaagacatttctcatatacgaggagcttataagcttatagggaaagttatttgtcacatgcaataagaggtacaaacagtactgaaacttcaggtcatatctgacttcagaagagataggtctttaggtatggggaaaatgtcaatcaatgtataaggagaggttaaatgagagaaaaggctttgtgctgggaagaatggagataaaaatatgttggttccatgttaatagaatggtggagtccagtttgtccagaattatccttgaatcagagtgtctctatacagtgtaaaacatatcagagaagtttatgactttaaagaaaatttcataaaaatacatgaccccctaaaggagtttacatgcagaactattttggggaaaatttatgagtagtcattcagtatataacgagctttattcagcattgtaattttccagtttgtgtatgatgaattcatagagctcattaagtgtaagtgtcattgttgtgattcattcaagcctttttcctctcttcagcagaaggttaaaaaaaaattccaaatttgaatccaggacttgaagaatgccagttgtctaaatacagtaccatattgtgataaatatagctattgaaatttttaaaaatctattcacaaaactttattttaatattcatagcagaactttttttggaatgttatctgaaaaacagaggaccattttatcatcagagctgactattaattagggtattgttgcagatataaaagttgatctgccactgaaattctatttgaatatgtatagttccaagcttgctttgtgtatttaataactttagtaccataattactctgtttacaattaaattttggtgaatatgctaatatggaatataccaatgagtgatttcagcaaagggcagtattgatttgcatcttgatgtgcttttcagttgcatctgcatttcatttaatatcagaggaaaagaagtggtcagattatgtaatgctaaacttttttttctttgaaacctctctgttgcattggctactataaaagtagacttgcatagagtcagaggggctgaaattatgtggaaagatttaattttgttaaagtttgtgcctttcagtatattcattaatagaaaccttaatgcaagcatcggtttcattattagaagaaacctataatgtactaaagtgattgtttaattctaattagtattttaagttcttcagaaaactcactaacttactgaagcaaatacttgtgattattttatttctttgagcagggacttctggttttaaataattcctcttttaagaaattgcctgaaaagcaacaaggagattgagaaacagtgatttcatattctgagaaactgagaagcttctgtagccctgaactagaaaataaggagctgccaaattcagtgaaggtcaaacagggtatgggaggatgctgaaagggaacctgagacacagatgtcaggaaagctggcagaactgtgttctctaaagaaaggggcacaccctgagaggcacattaataagcctttgtctgggagaacaggaataggtgttggcaggcaggggcactagggaactttatggtgtgatgaaaatgttctctgtctggtggtcgcacaagtgtatgtacgtttgtaaaattttgtcagtttactttgtgcaagttagtaatttattgcctctcaactccaaattcacccctttttgctctatttatatactcgagccagaccttttaaatattttttcttttcctggacagtgttagattttgtcagtagaaggtgaggaagggatactgcaagacttagcagagaaagtgcttctcttgttgccatgtgcttgtttttttgttcgtttgtttgtttttcttaatctcttaaggtgtggctgtcagctctactaactctcctgtaagcttcattagcaccctggtaggcagcttcttgctcccaccagtatctcgtgggcagcagattcctgtggataagctgtagctcactggccctacagagaactaccctaccgctcagtgggtcactgccacagtctgtccagtgaagtgttcctttcttgggcactctcccttagccttggagacagtaactgctccctatatttgctagttccatattccttcaaattgtcttttacatctattagcacttgacaactttttacaaattaataattttttatttatgttacattttcttgttttaattgattgtttgttttctagctcctgaatggacactgactgttatcacacacttgtgatttgtgtaccttacttactgtgttaattttacataaataagcaggatgaaataataagtatacttcttgattactttctataacatgaaccaattgtttaaacaccaagattgggatatagaatgccaccagatccctaggaaccatccacctccagccatttcttctgacccttagtccccaaagtgatatctgctgtttgacttgtatcaccattgatttgttttattattgaaattcatgtaaatggaatatagtatgtactcttctgtctggtgctgctttttcttaacacagtgtttggtatgtccatccgtcttactatattcattttcctgttgttggacatacaggtttccagtttgtggctgttgtgaataaagctgttatcattcttgtacatgtctttgggtggacatgtacatgcatagaagttgaattgctgggtcggttagcaggtactgccaaatgaattttcaaaatgatcgaaacagtatacagtgtaggagagttctgtttgttccaactccttaccaacactttgtagtgtcagacttttgcagttgaagtcttcaaaaccttaaggaatagatcaaatgctgcttaaactccttagattgtggtaaaggaagaaaagcttccaaaatcttattatgaagtgagcataatattgatacttaaacagataaatgtagcagaaaaaataaactacagaccattcttatgaatatcagtcttgtctatggctataccaccctgagtgtgcccgatctcgtctaaatatcagtcttgttcctaaataaaatattagcaaatagaattcagcagcacactaaaaaaattataactgccaccaagtataatttttttttttctaggaaggttgtgttaaatagctctatatgagtatgtggtataccagctgtatttaagtcttttgtgtttctcaagatgctaaaagataagtattgaacaagtatttattagtacactgccattggccctgcttatacctggctgaagcaggccctaaggattgacagggcctttggttgcctgaggccacctgagattataggggccagcaagagcaagagggaatcctccacatctttttccattagaagccacaggagggagtttcatttagatacattttaaagaaatatttctgtcatagtggcctcttgcagagcagctgagtatatttcagtgacttcttaacgtttatgcgcaagacacagagctactctgtttaatatacaacatataagatgtgcctggaaataaaaagcaagactaataattcaaaagaaaaatgagccgaggttactcatagtttacaggaaataaagtacagattttgcttaggagtgttttcttttaatttttttttttttttttgagagggaagtgggaatggactgggcatgctcattgagtatgagaggatttccagttttgatcccttggtgaatattaattataggagcaataatcattttgttaaggaacctggtttcttttcatgggaagtggtattttaagactacaatttgtttgctagggatgctctttgctgctgggttgattattgtttctaagctttttagtgaatggggctaggaaatacaaagatgtgtttctgtgtatgtgtttattttaaagatacattctgaactaaaaatatttccaagtacagcatttttacctttacctattctatcttttatctctgtctctttcttccatatctgaatcctgatgttcagggacacaagagaatgatagaataataatatcacataattactcatttgcatcattccacatgtatgcacacaacagtcttagttaacaaaatcaagtatcacaatatgatttctggaaagttgccttttttgcgtatgttatcccattttttgatagttgtactatatctacagtgtcagtacatttgcccattatatactcttttctctcttttataacccttgttgagtctcagttctacaagtatatatttactgctcactgatattgacatttctttagtcattttggatattgctatgggagtggcagaccccttctactgggcttcttctctagtagattcttattgctgttttctatattgataacacttagcagtctttatactcgaaatttagctgggtataaaatctttggttcatgtttcctttcttagagtcttaaatatgttactttttttccccggcataaaatgttgctgttaaagtgatgacaatttgattttattttccttataaaatatctgcagatgctcaaaaagtattttcatttactattaagttaactaaattatatcttggtgatggtcattctgggttgatttttcaaatgtatgtgatatgacctttcaaaatgtagttttatgtttaaatgaagttcaggaaagttttcttgaattaaatgatttttaatattctgttcccttgctttgattttctttgttatatgtatgttggtttttttgtgtatgttttcttaaacattttttggtcctttttgatttttttgtttttttccttttcactttctatttctcttgtcattaaaaagttttatttactcttatgttccttctcatgtagtttttatttccgaactgatttttgtctttcattttcaattattctgtcatctgatttctgaatttttctaattctgattgatgttagtctgtacataaagtgttttttagcttgttttgaaatactaatttatagctatcaaccttttgggaggcatgttttcttatgtacttttctaaagggattttttttctctttaaaaataccaacttagtgtggcactaggctttgatccatttttgttgctgagtttcgtatgcagccagttttcccttatatgcaattagttttagatagtctggttcagggtgagtgtatgtcattctctagatcccactcttcacttgtttttgtgtagtattccaaaatactgaggctaacttatagatccactttcatttgaactttctttttcctttcttcgtattatccttgtgatgttcactttggcttcatccctagcagtttctcctcagcctgaggctttgacctagaaggggctttggctggttagttttgagagttgtagaggcaacaggcttcagcctcttgagacctcaccaaggaccccttgcacttcctggctgtgggagtggcagagcccttcttctttcagttgcttttctcacagtgtcttgtgtgcttctaagaagtagctcctgataatttttggatcctaagatttatcagaggcaccatactttcttctgcttccttctttacagttgctgataccacacagatcttactgctgtttgtcatggtctgtcttcacctgctcaaattttgtagagataaagggatactgtccctccgtttggttggagaggttgtccataggtgttgagttttgctatccagttgtcctgtccagttttatgggggaattcagggagatgaaacagctgtgctgctgcctccaccatgtccagcgttaaccttcaggagctgtgatttagaagcatattgaagatactgacagcgatgacgctgttctgtgggactatttttaggaaagaaagtcattccaagccttaattaattattacaattagtttcaattagttggccacagaaataaaactaaaaataaaagcaaacagctttatttggaggaaaatcactttttattgaccacaatttacattgaatagatgctgagccagaatatttcatttaaaatatatttttgtcacttctggaaaggaatttcagaaaaacacaaaagattgtccagtcactattttgagatatataaagataaaaaacatgttgtccactcattttaaactattttgattactataaggaaccagtcaaataagagattactctgatgatttgataaagtgggttgaaattcagaagggcatctgttttaatatttggaagtactatgtgttttagttgtttcttttatttggtttactaccataggtgtaaaagtaacctttcttggtgttttgagtctaggctagcttggttggcacagaaattccattttgcaagattttaccatgagtaaaaacacattaattaagagaactaattgacatgaagaaataagagacacttttatttattttgaagatgtttttgttaacttagagaagatttagacagcgaagatgcattagtattctataggaaaaaattcaatttaaaagtccccagtaaattaataaggaacattttcagataaggagtttgtgtatttggagtgatagtgggtgagttggtgaaaaattccagttgaatctagtgtgtatgtatgtagcatgtctaggctcaaaactgagctcaaaactgagctacagacttctttcatctgaatagccatttcaagtgttgcatactgtcttaatcattcttattaaccttctttcttttctatatctccagtatgtttttagggaactgtggaacctaacaaatacttattttaaatcttttttgattaacatttatagaaccgagagtttgaaatcacacaacaaacacatgttcacatgcatactagtacaaattgagttccttcagtcaacgaagtgagttacacctgagggcacttgaagcccagtgtgaagtgacttgatcaagattacccaaccagctggtgtcatacctgcaatccaggtcttttgattccagtcagtactcttttcacaataaaacactgctttctctgaatgttatgttaaacttatgtgtcagtgagaaaaatgaatcaagattcatctcctaaaggatagctaatgggaaagaaagcttaggaattctgggtgtcaccagccttgcccagatgattaagccacagtttttcctgtcactcttgaaagttgtgctccttcctcacagtgacttccataattgtggagcatgttggtgaggtcttggagccaggtggtcaccggtgcaattttctgttgttccaccacttaccagcttgctgagccttagtttcctcgaaatggaggtgataatgtaatcttcacagagtcatgaggatggatgggaacctgtgtaaagcatttactagcatgtcccgggaacctttgccccttccccttgtgctcagttgccttatgttttcaatctctgcactgtgttctatcatatcggtattgaccttaataaactcttcattttgttcctataaaatgtgcattctaattggatgcacctttccctctcagcttcatagagcaattctttgttgttattaaatagcatttttagttgtagttgatcattatgccattggacttaaacctaattatttccttgaaaatagttgcatatatgattttattgtttcttctccaaagttaagagataatcaaataggatttgagccattataagtcagaattaacaggtatcctttaagttttggagtaagtaggaatttgaacagcatctccgtacggaagttttccttagggaaaaatgttttaaacacttctaagattagaattctgaccatttctttgttttatgttatagtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttggtaagtgtgtgactgcttctaatgatcaatccaaagatttatatgttttcttatgaaaatggtttctcatttatgagctgttatgggatgttcctaataatctgcagtcaacttaatagtttctgattaagcaaaaatgcatctctgacgtaggagtggaaattgttaatgcagtcacaacagaaaaggaggataaaatagctgtaatactatcattagtgagcactaggactttagatttttaagatactttatataatcttaatctcttttgagacccaaagaaacccatttacgtatctttcccctcccacctccacctatgtgggatttattccctccgtgtttgtctgatttagaggtttgcaaatcttttacaagtgtgagtttcttttttctttcagtgcaaccctcttagccatcatactggaactaggagaattacctagaaactgcatattaggcctgattaaatgtgcagataactagcatacttattctgaaatttttggggacccgttgtggaatcctgaaattatgttaggttaactaaattatggacttaaaaaatattttacctgattgcttctaaagctgtctgcttcaccaataaatatatttgcttctgatttttctaacttttccattctgtgttctcactctacttccaatctcagattaattaattaatttctaccatggaggtttataaaattttatttttagcaatatcttactcagaatactaataatacgacatagattagtgtcacttgggaacttgttagacctgcagatttttgagccttacctcagactacgaatcagaaactgtagggagagggcccagcagtgtttgttcaaggtgattctgatgcatgttgaagtttgagaaccactggttggtaaaagatcactggtcttactcaagaggagtcccacttcacctgctccaggagcagtgggccgcccttggtcagttgcagtttctggagctatctttatgaaacatagcttgaaatctagtgctttatcatattttatgcatatgattcctgttggccagtggcaccctttttgtgaaatatatgttgattctctggttttgtttagagccaaacccattccagtgaactaggctgtatctctgatttatggcaaaaatccctgtaaaccattaaagagtagtggctgtattagccaggtatatatttttgatcttgtgatggaggagagatggtagattagataagctgtctttactacaggatatgtggacttatgccatcctgtattaatagaaacctgtctctaaaaaaataggttcttcattttatattaatttgcttttgtaaccttttgcaaagttaaaacttgccctgtgtgtgtctcatctgttttatctgtatttatcatcaaaaggtgccatctaatagtatttttaataggcaatgatttgacctctgtaataaaactttacttttgtaaggttgggatgactaatctgtaaaaggagggacttgcttgagtattgtcgcctccagtctctgtctctatgatacactgaaacagccagattcaagatcatcagcagtttgttaatgaattaaaaagattgcttttgaattttctttgcattttcttttctgtagcatttgatactgtttatctttgtttctcataacaattgcttccattatcttttatggtagcatacctttttcctagttttctttctgcttttctggctgtacttggtcatctttataggcacttctgtgtgctccggcttttcttcttaggttcactttttattctatatattctttctgagtgatatcaggcttctcctgctgtctctttaccgttgatttccctgtcttttatctgtagcctaggacttgatttcctgagtccaggcctgtagccactggcctataagggatctctacttagatgttccacaggcatttctaaaacttgtatcatcatcatttatctcctgatcctgtcatgaggattgtctcaatgaatgacagccttgaagccagaaactgggaaggcattcttgagcattccttcactaatatcctagttccttttctagtcctattgctttacctgggtgacttctcagatccattcatttctctccatctttgcagccactgtcctggtcaggtcattatcatgtcttgtctggactctgactgtagcactgaatcttctctgtcccagtcttgccaccttgcacaccattgttttcagtatggcttttatgaccaagtatactgatcagataatacgatcatcctgtttaaacctctctgatgactctccagtgtccttcaaataaggtgccagacttttaaagagtggcatacaagtcccttcttatacaacgtttatcttcatcccttttgtctcctcaaagtctgtgcttcagccgtcttgctgccctttggctcttgatctttgtatatgatgctttaaaaatttttttaatatattttattttacattgtttttgtaccaagcctttgaaaaatttttagtagctttactgaggtataatccatatacttagactattggtatagcctcttaactgatctgcctgcttctgccccttgcccctatactccattctccacaaagcagcccaaagaagtctttattaccatagtctgattttgctaaccctcttccaatggctccccatcttattcatagtgacagccaaaacctttatgttacctgttaagcccatcgtgtttgttccctgctgctttctgatctgtctctcctcttctgcctcactgtttcccccagctacttttgcctccttgttttccaaacatgtcaagcacactcctacatcagggtctttttttttttttttttttttgagatggagtctcgctctgttgcccagattggagtgcagtggcatgatcttggctcactgctacttctgcctttcaggttcaagtgattctcccacctcagcctcccgaagtagctgggactaacaggtgcgtgccaccaccatgcccggctaatttttgtattttaagtaaagacggggtttcaccttgttggccaggctggtctcggaactcctgacctcaggtgatccacctgcgttgacctcccaaagtgctgggattacaagtgtgagccattgtgctcagtccagatcagggtcttggtgctgttctccctggagtgctcttcactaagatacatacatggcttattcccttcctgctctcactgctcaagtaacaccttgtcagtaaggtttagatccctcttaccatgtagccactctgcttacctttctttcctgcttaatttgtcctctatagcacttcacactgtcaaatgtacttcatattttatttctggtctgcatcttaccactgaaatggtggctttgtaagagtaaggattttttcctgttcattgctaaatctctatttcctagaaactgacgtttagtatgtacttggtaaatatctgtttaatgaatatgggcaaccttatatttctaactcagtattctggggcaactgtacttctttatttacatgaaataaaatgatagccacattaaaattattctgatggcagttgaaagttctagtgccaacatcctgaactattggttcaggtgagtttttcctaaactagtgctttttagaactttagccccctcatttcttactcttcagatgctcctctcctcttaaaagaatttcatagtttattaaatttaagaaatgtattacttatcctctggggaattcacaatatccactagcatatcaaaggctattagtacttttgaattaaagaaatctttaacttatttaactcagtttcccatatgtaattgataatcatatagaagaaaccagaaattgtaagatgcattctcaattcagatatgttaaaacatgaataaaagtcttaaaatttatgaaatgtactgtaatgatatcctgaaacacatacttgggaactgaagtgtattctatcaagggttacagatatacaaacctaaatattaatatatttataatattacttgttctgatatcaaatattttacttttttaaacagctgatatgaattcttcagagtcagttggcagtgatgcaccttgtgttgtaaaagtggtaagaaatattttagctaatttgtttcttttctgttgatttggtgtagtattttgtaaaatgccttttttgattaactagaattaattaaaccataagatactacatttttaataacttaaaaaatatttaataagacacaaaagtagctttatagttttaaatcacttgagtgtgaaaagttcctctcttgaaataaagtggcactggtattcgggggtaaatgaaggaaagcataaaggcatgcagatgtggaataaaaatattcagctcatttaagaaatttcagctacttttacggatactttttatatttatatcctataagactatactaatttaatataattttattgtattttattttgcatttgcttctggacttctacttggtcaattttttctgttcccaattttcttccattttagtaaattaaattatttattttattgtgattattgggccttttttgctataataatgttgaaattagtttgtaatgagtaaagattggcaacatcctatctgacataagcatacttctaatagccagatccatttatatgttggcgaactagaagacattttaccgttttttaagtcaattatgtgcctttttgcttaccaacatttgttactccccttcttcaaaattacttgatacatgtgaagaatatgttttggttaaatagaagaaccaacaggatgtattatctgggcaaattaacatataactcctcccttactttttctactacgggatacatgtattagggttctctagagggacagaactaatgggatagatgtacatatgaaggggatgcccccatgacttaattacctcccaccagctcccgcccacgacacatggggattatgggagctactatccaagatgagatttgggtggggacacagccaaaccatatcaaccagaactcaggaattagaattactctgaaggttttcattttgtttcgttttactctcttttatattttatctcttaggagttaggagtcagcttttttggacctttttagtgatttttaaacttttttaaaaaaattgaggcatgatttttacggggaaatacatataaaatgaacagtttgaagacttttgacaagcacatatacctgtgtaatcctcacctcttaaaatgtagagcatttccatcatactaaaaagattccttatgttcttattcagtcaaaaccctactcccttgcacccttggaggcaaccacttgtcttgagtttttttttttttttttttgccgtgaatgagttattcctgttccagaaggttatgtaaatggtattaaacagtatatattgttttgtaacttcttatgctcagcataacgttttaatggttcatccatattgttggtgtatcaatcatttgtttcattttattgctctcttgatagacattgaggttgtttccagtttttggtattatgaataaagcgtctataaacattcttgtacaagtgtttttatggagacaggtttttatttttcttggataaatactttgagttgcggtttatagggaagatgtctatttaaacttataagaaagtactaggcagatttccaaaatggttgtgcccttgtacacattggccaataatatatgacagttctgtttgtgtcctcttcaacatttggcattgtcagttgtgtgtatttgttttttagccattacagttagtatgtagatgtgacttatagtttcagtttgcacgtgcttgatgcctaatgattttgggcagttttttgttgtgcttattggccattcatgtattttcctttgtggagtgcctcttccattctttttgcccctttcctcttatttttatcttttaaaaataactgggttgttttgctttttataattgaatagtaagagagtttttttctggatgcaagtcctttttcagatacgtgttttaaacattttctactagtttatagtttgcctattcattttttgaatgctttttctacatctgagatgaatcacagggtttttctcctttcctctgtcaatgtggcaattacattgattgatatttgagtgttgaccgaactttgtattcttaacatacaccccacttagtcatggtgtattatagtttttacataatgctagaattgatttgtgaatactttgttaaagattcttgtgtcgttgttcgtgaaggatattggtctttcgtttttttccccactgtttctcaatttaaaatttccaatctcattgttgattttggtagcagagttctgtacctggcactctgtttggtcttcccccttttgccctgcaggcttaagtctcctccattttactcctaggatctctaggggaaaaaagccagggctgccatggactcactttgttttctgtctcttaggggtcacagtcctgtcctgtccattgtctaatttctgaaaatagaaattttctgtttttaagtctgtttttatctttgtttgcagtgggagggctaactgggtcccagctattccctcgtgcagggaagcggaagcaaagcgatgcctttcaagttgtgtcaaagtgctttatttctcctgcttcttttcatgatggcctttcattgtggatttttcttcttcttcatttatggaatagcattctttttggaatattcagcctgttgctgaatcagaggaactaaagttcttagtattaaattgggtcatttgtatttaattgcagaatattgtgtgcatttgtttttgataatacaaattaaaatattaaaatctatgggtaagatgagtttcttcttaggctcattaggagttctgttgtgagaagaaagcaagtctccttctgacgtctcataacgttgaggttcaaatgatatggttacctctgaccccttgcagttagttggcatagctgtttctgtgtcttggaaggaaagtgtgccagtgtcatatcttaaaggtggaacagtgtataatcatgtcttttttgttctgtataacttgaactttttttttttttttgagacagtgtctcatcctgttgcctgggctggagtgcattggtgcaattatagctcattgcagccttgatctcctgggttcaagtgatcctctcacctcagcctctctagcagctgggactaaaggcacgcaccaccatgcccggctaatttttttgattttttggtagagatgaggtcttgctttgttgcccaggctggtgtcaaactcttaagctcaagtgatccttccctctcagcctcctaaagtgatggggttacaggcatgagccatggcacatggcctctgaacttaagttgtattttctcttagaatgatgtgcttccttattgtaattagaaatatttctgttgttcttctttattgtgagtaattagaagtatttctgttgttagtcaatgtaactttacttttactgcctttttaacttatatagttaagaaaaaacatggccaggaacagtattttctatatgcttaaggtaatgaattatatttttaagtttaagaccaagtacctagttcaggactgtgtatctcctgtctcctaatttagttctgtttccattatcctttattacttcttctctttgtaattaggacagtgatactcagttgatttctcttttgcatttaatattttagtaactttttggatgttacagttatcctagaagaatgtcataaacaaaacaatactactgaccaggcgcggtggctcacgatcataatcccaacacttcgagaggctgaggtgggtggatcacatgaggtcaggagttcaagaccagcctggccaacatggtgaaacccctagccaggtgtggtggtgcctgcctgtaatcccagctactcaggaggctgaggcaggagaatcacttgaaactgggaggcagaggttgcagtgagctgagatggcaccattgcactgcagcttgggctacagagtgagactctatctcaaaaaaaaaaaaaataccaaaaataaaacaaaacagtaatattactgactttctccttccctttgaaggggaaatttgtaacttctatttgcttcttttcccctagcactctctcctgaataaacacctacagcactcattgtattaacatttattttacagtttcattcttcttatgccactagttgtttttagtttttttaaatgtgtttattctgtctctctaactgaattttaagttatctgataaggaccttgtcaataaagcttgttttccctatgcagtctttagaagcttatttcatttattcttttgaatactttttagccattaattgtccattgcctttatactactcttttcatttactctcaacttcctcatgtcattcactttcctgtcttgtctgtaccatagagagcaggcccactcataatttgccttcttacaactttctaatattaatagttgaaatgtttcaccaaataacaaacatgtaaaatgagcatcagttctttctggtattaaaatcagaactgtttatgaacatttgtcatttaaaacattatggactattaaagatcgtgttttcaaagaacatgtactactctttggggaagttttataattatttctaaaaaagcaggatacaaagttctatatatagtatgaaggttgtcttataaaatggctatttatgaagaaaatacatcaaaatgtttccatattttctaaaatgagcattattttatcattagagaaaaaacttgcaaatgttacgaaataaaggcaaattgattttctaatgtgaaattttacttaataatgtaatagcatatcacacagtggttctcaatcctggttgtagagtatgatcagaatctgggtgtagggcctggttattggtatttttagtaaagcttcccaggtgattcttttgtgcatcaagattgagagccactggtagaatctggcacacagagcaccttaattattttaaatggaatcttgtggctggcacatttttatccttgatttcagtaagggtgtgcaggtaccctctgctgctggtaagggtttctaacttaatgtggacgctttgtcaaaaagttggttattgctgataatacatgtatctgccttatgaaacagctccagatagttaacccacaaatctcttatttggcattggagtgaagttaagacatacccattcaaggtagatgttaggcacataataaaaatgttctcacatgtaccaaatgttggtctctggttttggttggggctttaatccttgacctacagaacagacactgtattttatttctgaaagtaactgtgcaggagaaatgttggataatgcaaggagaaagaaattttcttttgtgttttcttgctgacagacttaatatgaaattagtagttctttgaattgcacttacccttagtcatgtcagtagcagaactagaggcagaggtcaggcttttggatggtatcctaacaggtcattgtactgtggtccttttcagatgtgaactgataagaatctgtatttcacagttccttggaaagaagtttgcagactgatgtttgattttcctcactgatgttatgagaagtgacctgaatttttaattcatatatcataattttttggtaggaaggagaaattttgtacagcttcatttttaaatggcagccagttgcttttagctggtgccattgaaatatatcacattttaattttttttctgttgtcatcttcattttgacacttagaagtcttaaagaaacgtttagtgatattctagttaaaatgtcagtcccaatttcttttctaaatcttggctattatagagttggcaaagtattttagatttgaaatatgttaataaaattttagttatgagttaaggtattttcttcaacaggaatagctagctttggctagagtgcaatgccaaggaagtagctcctttattttgtgataatggaagtttattggattagaagaagtatgaaatgagctcagagagccttccttgtagtgggctttcattataatagcctgatttatatggttgattctcattattataggtttaataaattattgcctgaaggaaaacttgaaagttaaagttgatatgacataggttgaaactgaataaatcagaattttatactgatttgtcttaggaaaacctctttcaaacctgaattatataaatgagctattccaaaggtaagctttggagaggaactttaccagaatttctccttttgaatttctttttcttaacgctgattctgtgattcctaccaaagacctattcttagccattggctggaaacactgcaagtgtctcttgcaaatgcttgcaagtgtcaagctattattgctgctaggaaaggagccataggttatagaggaacttgggtactgagtccataagttaaggaatcagcactcatactttcagtatgttggttagttcctccttcttaaggagttgttgcatgccaagccatgatactactgtcttccaaggttaaggtgaaaagtatacttacctgtaacaaataaggcacgcttgttttcaggttgtgatccaagtgttaatgtgtgttgcccatttactgttaaatgctcattaataactgcctgagtctgcagattggctaatccgttttcctctaagtactttatttttatttttgagacagaatcttgctttgttgcccagggtggagtgcagtggcacgatcttagcttactgcagcctccgcctcctgggttcaagtgattctcctccctcagcctcctaagtagctgggattacaggtactcgccaccatgcccagataatttttgtatttttagtagagatggggtttcaccatgttggccaggctggtcttgaactcctgacctcaagtgatccgcccgtcttggcctcccaaagtgctgggatgacaggacaggcatgagccactatgccaggccttcttctaagtactttaattggggattcctattttctgaattataagaaatctgagataattagagcagagagtatggagtggttttctacagttgagggtatcttgagtgaagaaaaggtgaacatattttaagtgcttgcaaaagtcatctctagcaacccaaaactataagttgtcactcatttaaggtagtaggcctcattactcacttcccccaatgctctatttaactttgaactccagttaaccaagatattctgcccaaaataatttttttctcatacctcctaaaaagaaaagcaaccctaaaattagtttagaaatgttagcttcctcatttgaagttttcactgctttaaaaactttttttttaattcccaataaataatgaccaacacaaaataccagacattaaataaatactaattttaatcagatgaaatttactatttaaaaagtccacagaattataagatcttttccactcttacatatttatttaacaaggcaaaactgctgacaggctgttatttcttgtttgtgcaaatacgtttttgtgaatgtatgtctctttagtaataattttaattgttaatatctctaaaaacataaaatgaatgtagtccataacattggtagaaaacaattgttaatgagccccatgtttggtttgacaaatgtaggaatctgtgtcagaaaggaaggatgcaggttagtggacagtgcatgcttgttcaggagatgcataatatgggctcttctttgtggtaaggtctgtttttgccagtcctgataaagtagatataagtgtaatgaaaacaggaaaggaatgggattttggcattaattggttaaattaggtattgaaattttattaaatctgagaaatatcttatagccccttggtgatacagttaagatgattgctcatctttgcttaagggaaagcttaataaagatgaaaattagtttaaacatttttcttaaacttctgcaggctgagccatatatctgattttgtataatttatcacttatagaaatggaacttgagcaatataagaaatatagactaatatttctctgaacatttctaaggagtttgacttaatcttaacacagttataaacttaagtatcaaaattacattggacagaaaaatagatttgttggtcttttttgaaggttcattgaaaatatctcagtaattttaactactgctagtactaattaactcttatattttaaggaacccagtgacaatggacctctttttactgaattaaagttctaccaacgagctgcaaaaccagagcaaagtaagaaatacagtacacatacgtttacacttttaaaatgaccagttttttgttttaagccaagacctagagcattgtatcttattttatgactctttgttatttttttgctttataaattccacttacatgggatttgtatgaaagaattctggtcttttaatgggtttgttgcatcaagattttatctatatagatacatagaatgaagttaataataaatgacctatgatttaggaaatattgttaaacattgagaattattgatgaaatagaacaggatatcaaggtagagagccagaacctctcctagtcactttggtcccttctgtccttcttccatgtctcttagatcttgatttcctggttgaggacttttatattgaggaagaaaaaccttttagattggtatgaaaaataggtcttcctgtagaagcaagtaaacattacataattagagagagaaactgcaacttcaggatagtccacccccgtattctcagattccacatcctcagactcaaccaaccagggataaaaaatattccagaaaaaaaaaaaagctacaataaaaaataacaattcaataataaaaaataatacaaataaaaaactagtacagtataactattgacatagcatttacattgtattacatattataagtaatctagagatgagataaagtatataagaggatgtgtggaggttatatgcagatattacaccattttatatgagggacttgagcatctggattttggtgtcttgaggggtgggggttcctggaaccaagcccctagaacaaaggaatgactgcactgtagttttgatttaaaaaaaatgctttttgtagatttttcattttaaagacaattttaagggcaggataacaattttgtaggttaataaaaatgttttcatcgtaaaatgcttttcgttattcgttatactgtattcttcattttcttttttatgaatacaggtgaattcttattgcatgtataaatacattttgctcttaatgattttttaaaaaattatcatttatgtataacaattgaaatcacaaagatctgttttaatttgtagttcagaaatggattcgtacccgtaagctgaagtacctgggtgttcctaagtattgggggtctggtctacatgacaaaaatggaaaaaggtaaaaatatgtgtgatttgtctttctccttcccttttgcaacattcactatttagttggtttagtcagtaattatttactgatcacttacaatattactaggcctccctctggagtatgtggagtgtatgtgacagagaggaataagatgttatctctgtcctctgctttccatagcagcaggctatgatgccttattagaataggagtgcctctctagtcagggagcttctgcagagcagtatcaactgactggaacccaactgacaaggaggaacaaagccaaacaccctgcctttttttcctccttgcctttagaaataaacaaacaaaaacgcctctgttcttcatgcaaaagggaaccccttcaggattccatttggtatttctgcccacacagaaatgttggatacataatctgcccacacaagattaggctcaccctttatgagggttttagtctagctggtgagtgaaaacaaaaatgtttgaaacaattagagaacaattaagtgctaagttgtataatactgacttacgtgtcttaggagttcagagaatggagagaatgaattctttgggatagtttatttggagaaaacttctaatactttggttcataagcagcacttgatacatatttgaatgaatgaatggaacttcatggagtaaggctttggtagctgagacttgacgggtagatttagtttggaactggggatatattgcttaggatgatttcagctgcaagtaaaggaaaactttgactcaggcagtcatcaagggcccaggttccttatcttgcacctttgccctcctcttcttggttttgttctctgttagttctccattgtgtggtcgccaggtggctgctccatttctaggcttcacatgcaggcacagtacccaagggcagaaaatggtatctatcgtgtgttgtgagtttcactttcctggcaaagaaagctttcccaggagccctgtggcagactttctctcacgttttcttggtcagaattttatcaatacttaaaccattgactggcaaggacaaagtgatcacagcgatccatgtggaaaaggatggaatgccggaaccaaattggtgctccgttagaaaagattgagaggaggggtaagtagttgggtaggcagccagtgttgtttacttgggatccatgcctctcttagggagtgtggggatccctgaagtcacttttaacattttattttatatggttttgctgggatagcaaaatatattatagtttttataatattttctggagaaatactatagaataaggattagttaagttagttaagagcaaggattctagagctagactgcctagttttaaaaccttgttttgccccttaaaatgtgtgtgaatttgggcaattttttgctttaatttcttcatctgtgaaatggagtaacagctacccacttaatgatgttttagtataaagctacaagagtatatgtaaaacatagatgttagcttttgctctcaaaggggtctttaatcgcttaaatgttaaaacctactggtttagaaaatcattgaagaggcagaacagcatcttaagtgggagatgaacgtgagcacaggcaggatagacttttattctactgtatgacccaatggccgtcttcctgtagcagaggaagagggcatgtgtgtaagagagaaggaaataaacttggagaaggagtcggtggcagataatgaagacccatagaggaaagaacagtttggaacccatgtatagtaggtagtcagaagctatcacttgctcttgagcaagggatgaggtgacatggtggtgaaagtggcatttgggaaatggtttacatggtgaattaaagactgtctaaaggggagtaagacaagaaaaacccttagtgatgacttgctaggaagcaaatctgtttgactgtgtgctccagtatacaatagttatattcctaaggaacagtacattatgaaaaccacatttcatagagatgattggaagaaaagtgtacctggggctagagcatttttagacttggaataacagccttttcctctttccataatttgagtataaacgtcttaaaaaaaaaaaaccaagcacggtatattgcagcaaaacctaaacaccaaacaaatctagcactagattgattgtacttgactccatcaggtgtggtcatgggctagttaactttctgtctctcttgtttccctatgtgtgagatgaggataatagtgcttactttatgaattactgtgaagatgaattgaaaacatgtaaattgtaaggggcacagagtaagtgctgaggaaatgtttcttgcagtcatcatcactgtgattatcataattggtttcatttgtttgtctatgatttttgtttgtcagtggtggtattttgcttgagaatgatggtctttttaaaagtagcccacactgtcatatcacattttaccatatacattcttatcacccattttatgataaagttcagaaccagttaaacagggcttttgtttgtgtgactcctgtgaggtgaccagggactaagtgggtccaaggttgactctgtaagctgactgacttgggcactgctggaaagaacttccctggtgtggatcagaagtgccttagagtgtggtgacaaatgagaacacagtctaagtcttaactcaccacttactagtgatgactttacctcccagcccatttcttctataaaatgaggttgctagaaatgtctcctttaaaaagatggcattagtcatatatcaggcattgatttactttttaggttgaagctcttaaaaagaatcattataggtcttagaaagtaaagaaatagaaagtagattattcttccagcccccttccatgccagacatgcttagttttccttgtaactcatttgaattaatatgtatgtagggcttagagcaatgttagctgctaccattattaaattattttacactgatttatatttttcttttacttgcacattttatccaagtctccagaaaagtatacatcaaaggttttactttagaggagttacttagaaatagctttcattttactactcaatggtagagccgtctttccagaagaatgtggtaatggtttctgtgaaatttgtggaatcatgtttcagttgatgtttatgatttaggtatggtgacaagattaaggtcttattaagagtagtggtagggtgatttgtgaataaaaacaaagacctatgtaacagaatttattaatagaccccatgttgaattaagcagttgtgttttagccacctttcaggctgttacagaggttgtatttttgttacctgtgtattacaggttaagtatgccttatctgaaatgttggcaccagaagtattttagatttgggatttcttaaggattttggaatatttgcgttaatacctactggttgagcatcccaaatctgaaaatgggaaatccaaaatgctccagtgagcatttcctttgaacatcttgttggcactaaaaacactttctaattttggagcacttctgatttcagattttcagatttgagatgctcatcctatgttataatcattacacacatcacctatttagtaaaagccaacatgtatatgtgccctggtctcatctctcaaccttgcaaaatctgttacacaaaggaaaccaggaagtcaaagttaccattttcactttattatcttacaagccaaggtgctaggaaatcttacatgaatgaatatattttgtcacaaatttttttttttttttaattgaggtggagtttgctcttgtcgtgcagctggagtgcagtggctcaatcttggctcactgcaatctccgcctcccaggttcaagcaattctcctgccttagcctcccgagttgctggaattacaggttcctgccaccgtgcccggctaatttttgtgtttttagtagagacggggtttcaccatgttggccaggctggtctcgaactgctgacctcaggtgatccaccagccttggcctcccaaagtgctgagattactggcgtgaactaccaggcccggccaccactgactaattttataaccttggacaaatcactttacctccaaagaccttagttattttatttattaaaagatgtttagacaagatgattttctaattttcttccagttcaaaaatgaatagaattctgagttacttgttcaacatcttgtcttttaatgttagtcaactcttccttccctattgaacttgtcatattgttatcatagaagcctataacatataaatgggatttttgtatcctactgacatttatttcagttaatatgtagtacaggggttaaaagcatgattttgccacatactagaggacaaattatcagttttcttctgctgtaaaatgggtatgataggagttacctactttatagagtgatgtgaggtttaaatgcattaataacgttttaagtacttacagtagtgctgtgtgcataccaggtgttcagtaaatgctagatgttatggtgttgatgattcataatcttcctcattggagatgtcctgatacattctgagtgtggttttgatttttattgatttactgaatgatttcaccagacaagttagaatctggaaaactattgaagataaaagtggtcctcagagcagaagctaagcagtgttattgcaaataggtgatgcttttctgtacatactgaaatataacgtgattattgaatctgagttttgggtgttgaaagtgaccttagaaagggtgagtccctgctctctcattttacttctgtggaaattgaggcccaggaagtaatgtgactcagccaaggtgacatagctgctttatgcaaagccagttatcttcatgttttttcaggatatttgtttttccccaaatcttggccattgagtgtttaatgtacaatccttttacgccatttaaacaatggtattgaatctggcttttgttaaagcatctcacgagaatcttgattttagcagaatgttgttactgctgaaatataccttaaaaataaggagaaacagtcacaggaaggaagctgatatccagaaacatgaattaattttaactatgagaaaaatcaatgctgtcatttttattcagcttgttttatttttaccgtgaataaacttgttgggttctctctgtgagcattatcttaaattgaatagtctcttgaaactagctgcgaccaggaagaggccctccaggtaaaaagcaggacctgaaagcactctgaactctttgagatttctagttgggagaaattgtttcaaatgtttgtatttcttttttaaagaatacttctttactaaacattgtcttgaaaaaattactttgagagtactcattacaaagttggttttcttgcattgtattttgttcattggcttttcatatttgtcttcagttacaggtttatgataatggatcgctttgggagtgaccttcagaaaatatatgaagcaaatgccaaaaggttttctcggaaaactgtcttgcagctaagcttaagaattgtatgtgagctatgttcttcttgtttttaaaaaattgttttgagtacagtaaaggctagtttatgttgaagcttggtcctctgctggctggtgttaggtactgcattaacttattctgtatgatactttcatagctggatattctggaatatattcacgagcatgagtatgtgcatggagatatcaaggcctcaaatcttcttctgaactacaagaatcctgaccaggtagttttataactttaatttctactatttaaagcgtgttgtttgaaaataaatatggttgctttgaacttttgaacctgtgtagaagttttactttttgaagtagatatggtaataatatttcttcttgacactttgatctagttaacattctacatttttgatgtgatttgttggcactttatcaagttggctattttgccctaaataatattcagaagaagtgcttgtgatacaaaatgaatttcaaatagctatttgggggtggaagcttaaaattatatagtacaccaatgaattatgtttgcctgtctgctttgtcactttttttattcctttgttcaagaaatccatcaaatgtaagtgttctattacttggaaaatttggtctttaacatgttgattattcaaatcaattggtttacagaaatatcttagctgtctaaatttgtatacccttagtgtttggaattcaaatgtgcattttttttttagcttattacattccctttgtaatttttactttctaaggaaaggagaaaagctaatgttattatacctttatttaggtcagtttagttgaagtagagggatctatacaattttcctgtataactgtttctgtgatttcggtgaaagtaaggtttagttgacattcatacttaatgtatgttctcacttcttacttgatcttacataaaaaggaagatttaaacattttaaatgtgtttgggtactttgattattgtaattatttgtcagtactctgtacttcattctttctctcaaatgtacctttaactacctttgcttagtttttcctttttcctttggctctcttttctttttctgtcgtctcgtatttgcttcccttcctccaatgtcagttatggtggatagaagggaatctatataagtataaaagaagaaagttactatactattaagatagtgtgctaatggagaaatcttaaaaaggcaatcatcaaattcatctctgctctttctagccatttctttttagatatttctaggctaagaacaaagaaaacgcagctaacaacctgaacaataagggttccattaattgaaatagtctggacttgtacagtataataaaatacaacttatatcactttgtaggtgactaaaacatgctgcctttgtttatatggaaatatttttgcagctctgttatccttcagacatatgctttggatgggattatttttccagtgttagatgtatgtgctagatctagccacatatttttacttcagtttcctcttgtgcccagatgcatgcatttgtgacatttactcagaattagagatgtaatgtgtggctatggaatggaagaaagccaagtttattagctttgtatgctaatcagacccacatgtatatgcccacgaataagtatgtatataatattaaaatttacttttaatcatgaagacttggctttagaatatagtatttagatatagataaaagcctgatctaacagttctttagatcattattatgatgtatgaaatgtttttataaagtaaattgaaatttgattattttacaagtgaagaaacagaggaatagaaggtaactaacatatcatgtgtcagcatcattagcagtcttctactgggtgtgcttttctgtgtggaaagtagcagttgtattgcaacaagtattgacggtttgctctgtgctcaattttagagtctgtaagataaagtataaaatgtataattttcgttcaaattgagacaagattaattacaagtataacatatacttatcttaaaaaagtatataaagtcaagtgattacactgtagctatgtggtcatttaacatttttattaaaaataaaaagcctttcagaattaagtatttgctgttgtttgcattttggatctaaattgtttggagtgttatggaatgaccttgtaggtgaacccaccttcagatgccagtattttgtttctgtgctttaaagggttatatgtgcagtgattttgactttagtttgtcttggtgcttggaaatttataggtgtacttggtagattatggccttgcttatcggtactgcccagaaggagttcataaagaatacaaagaagaccccaaaagatgtcacgatggcactattgaattcacgagcatcgatgcacacaatggcgtgggtatgtcagtagtactggagtgagaaatagactgctaatgttttcacccagattcctacatagttcttaattatgcataagtaaatgaatagataaataaaaattgaaaaggcacagtggcatgaggaaagaaggcagaggtgagactcctacaattgtattccaggaccatctgtgttcttctgtcctgccttttcctcgcagccttcaaagataaccaagaaggtggtagtggttcattcagctgccatgaggatttctttttggttttatttagtttaattggaatgtttgtttttgtgttttttctcaagtttcttatgtatctacaactttgtaacagctaacttttattttgttacctgttaagttagtttatttcttcagcagtcatttcttctgtgctcaaagctgtggaagaactcaaatacccagttctctgggcctcttaatagcatataaaaattttaagaatatcttcaagttttccaaaggaaaactagttttatttctagactaacagtctccgcttgaaaccctgaaatttaccaatttgggttttaaagtagattattagctagaagttaattgggaggtaagctatttcttttatactgtccaatgttcagtacctaggtgaaatgcagtcaaaattttatgatgaaaaacagactgtggagttgacttgttttatgttattactttatatatactttaaattatacattaaaaattatttcagtctacctaatgttcttctcttgcatttgtagccccatcaagacgtggtgatttggaaatacttggttattgcatgatccaatggcttactggccatcttccttgggaggataatttgaaagatcctaaatatgttagagattccaaaattaggtaaaggaaaacttaagttatttctagcaaaatcatgataagccaaatgtttttagtcacaatttcttgataggaactatagtttcaactgatactgatatagaaataagaaagtacttgttaaacagtaaggttccttggtcttttgtttattttagaaaaatgtctgtaagcatatttaggatgtagcacaatatagcttaatgtgctatatatttttatttcatattaacatatgacatcaagcttcagtgactcattctttaatttttaacagatacagagaaaatattgcaagtttgatggacaaatgttttcctgagaaaaacaaaccaggtaggaaatgacttcttcagtgttaatagggattttgttttctggggataaaaaggcatgatatccatggaatagcccttaatgtaagatgttaggtggtggccaggcatggtggctcacacctgtaatcccagcactttgggaggctgaggtgggtggatcacgaggtcaggagatcaagaccatcctggctaacatggtgaagcctcatctctactaaaagtacaaaaaattagccaggcgtggtgacgcacgcctgttgtcccagctacttggaaggctgaggcaggagaatcgcttgaacccgggaggcggaggttgcagtgagccgagattgtgccactgcacaccagcctgggtgacagagtgagactccgtctcagaaaaaaaaatatgttagatggtttgttaaatgaatacttgagcctcattcaattattattcagtgcttttagcaaaggaagcaaatttcattcatacattaagttagtaaatattgaggctttattgtgtgccagggactgggggtacatcagtgaacaaaacaaatatccctgccctcatgaagctagcattgtagttggaggattttagacagtaaacacatgagcaaaatttatatgttccccctggttagtactgtggaactagaagaaaacagggaatagaattagggggatggggatggggtgggtagtaaagtagtgaggaggactgtaattttaagtaggctgtccagggacagcctcacttggaaggtgacatttgagcagttgtaggaaggaggtgagggagggagtgagctgtgtagaagtctggggaagagagttctaggcagaagggacactagtgcccaggagatgcgaggactgtgtcttcataggtaaacatgagggctttggcttttacttcaaggaagagtgtgaggtttgtagtagaagagtgacatgaactgcttatcctgaggggaagggtctcctgcttctggcatggggatggactgctgaaggagcaaggatgggcctaggcagaaagcaggttaagaggccactgcagtaacccatgcaagagaagtagcagccaaagagtgagaattggtcagtctggatatattcagaagtctttctaagcctttgctcagttgtctccttttcagggaggtctatcctgaccttatgctatttaaaattgcaacctactccccatatcaataaatacaatgtgggtttctcagaattatcccatggacctcatagcaatcagtagcctctccctcctggccgaatgagtcacttaccttaatttccaacaccaaatatttgtgtttaaaatttatagaaatggagttaatacagtgaatgaaatatgtaacaattcctgtcctcttgaaattattgtttacttctgttagtgtccttttctttcacttagtaatgtatttgtgaaattcatccccattatcgcatgtttttttttgttattgttgttgttttgtttttttgagacagggtctcactctgttgcccaggctagagtgcagtggcacagtcacagctcactgcagccttgacctcctgagctcaaagccttgacctcctgagctcaagagatcttcccacctcagtctctgaagtagctgggactacaggcacacgccaccacacctggctaattaaaaatttttttttgtggacatgtggtctcactatattgcccaggctagtcttgaactcctgggctcaagcagtcctcctacctcagcctcccaaagtgttgggattgtaggcatcagccactgcccttggccctattattgtatgtttaacagtagtttcctcattgtcatttctatatgatattctattgtagttacataccattatgtatttattctgctcttaggtcgtctccaatttttggcagttgcagcttgccaattatgcatacagatgtatagtctacctgcagttggtttttgggtattatttgaggaggggtcatgtatctttcctatccccatatttatatctaattgacccagcagcctttcttgaaaagaccattctttccctttgttgtcatgtttgtcatcagtcaagtgtggatgtgtggatctgtgcacctgtttctggactctcttttttcaattgtcctttttgcctgttcttggaccacactgtcttagttactgtagctttatttaaagcttgatatctggtagttgaaattctttggcactgcttttctttaactggactttgctactttgctattctttgccctttgcatttctatttaaattttagaatcaccttgtcagttacacacacactcacccacctccaagtttgctggaaccttgggattgaatttgactctgtagaccaatttggggagcactgacatctttatactgttgagtcttccagtccacttatatggtatatattttattaaatttggtctgtcttaatttctctcaactgtgttttatagtcttctctaggaaactcttgctcatctttcattgtatttgttgcaaagtatttaatgctattttaggtattttttgatagtttattttccaattgctttttgctggtatatagaaataagatagatttttatatatttaccttgcattttacgaccttgttaaatgtatctactagttctagtagttctttgtagattctgtaggattttccacatgtagtattatgttgtttgtgaataaagactggtttacatcttctgttccactctttatgccttctatttattttcctatcgtactagctaaaagtacacataactattctgttatactgaagggatatggcaaaagtggacatttttctctcccaggggagcattttcaatgttttatcatacatggtgatatttgttttaggttttttgtacatctcctttatcagatgaagaaattggaagttagggattgttgtccgtttttttcttggtatattccaagtatttaggaatagtgcctggcacataggaggtgcttaataaatatttgagttaatgaatgtgtgtatatatgcacacgcttgtgtgtgtgtgtgtagaactgataagatctcttgaaggactggtgtgagaagaaatgattcaagggtgactaactcagattttggcttgaggagctagaaggatgaaaatctcagtaactgagacagagaaaacctcaagttttagggataggtcaagagtttagacgtgggtttgttggaattaatggtgatatttacacatccaaggaccagtatatgaaatgatggatatacaagtctggaggtcgggggaaaggtctgtgtgtgagtcattagctcaaaaatgaatttttaatattgagaagtgttgatcttgactagtaggatttcttttttatggtgtggttctgtctaagtgtacagtacacttttatcatttggaagctgatttttctcttttataggaaagccagatcttatttctttcttctttctttggcctctttttggtgtgttttatttctcatttacacgaagaatatagctatctgctatagagctaatggctttgatggcaaaaacatattggctatgatattcattgtatttaaggacattttactttctaatctttattctagatccctttgtatttttttataactttaatactataatagttatttttatgagtatttacattttaagttgtcttgtttctcacaattacaaaaagtgtgttttacattgtatctcaaaatactttttaaatttcagttatctgacaattcctgagttcaaaagcatacttttcattgaagtgattgaaaaaaataggtatcttaacaagatgtgtatttgcattctaactttactataaccatgaattattttttttagaggttagagagaaatatattgaaagttataaaatgattgtgttattcttttaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaaggtgaattttgttattaaattattctttggtcttcttgtgtttataattgcaataaatactaaaagaaagtatagcagtagttcaatgaagaacaataacagattgcatggcaattaaggcaaacattttttgtaatacagaaaatgtgtagagggttgtagaaaaataaatatttatatatttcttatgtttagtagcaagttactaaattcctgaactgattttaacttggaatactgatatctgacagggaaattttgatggtgcactgaattcataatttatatgttcttttctcccaagtcaccacttagggttcatcttgtcttggttgtttcttatttgtggatatggtcagagtatttaccagttgaaaacgggcatttgaaaaattaccatttgaaaatttccttgtttgttggtgtggtgcattttaccatttgaacattattttgctctgtgaagaaatattatataaagctatatatcagcatataaggggattaattgtttggagagaaatgttaaataatgaactttatggtagaagtattatacaagcatgtaaagaacttctggcatcactttagattttacaggtatgcattaacttactgatttgctattgattatttttgataattaacttactgataaacttactgatttcccttataatctgaaattatttaatacaatgtgttagctatttttatatgaggaaggaaaacaacttttagaagaaaaattttttttacattattaaccatttttactgtcattaactttgcaaattctaatagatttatttggaaatctcgtattccaaactgagaaaaagcgttaaaacaaatttttctctctttaaaatcagacgcagcacattgaaaagtttttatcttttcaattaacaaaggagataggaattttgaaattggaccaaaaatttaactttgccaaatagcaggtctctgtaatttcatcatagaatctgaaattatatacatgcatctacatatacttttttttctttgataagttttatcttaattgcatctgctccagttttgtggtcaacaagtgtgctgaaaactgtatctgtttgaaatgaagagggtaaaatggaagcctgagtggaattttttagtaaggtattatagtaaacttactctttgcatacatgcataaacaagcagcatgtttcttattgctcaggatagatttctctgcgttaatatttataggtagcttgtatagtgtttttctctaaaattttggtgattgagaagtaaagatctctgctgctatgtgagaacttgtccagagcaaccacctccctccgcccaacccccatccccctgtccccgcccctaccttcctttgcaaatccctttgttgtttggacttacatgctggagaaaatgtagtttctgcaggttggctgactttacagctgagtaggtcagtctgctgcagagctaacatctgtgaccttataattctgtggtgtccttggatagttcagaaggctggaaatttcctgttggatcatccctgacatgtataaagcttcatttaggggaaaaaaatgaatactaagttgaacaagttgaactattaggagatttatttcattagtttactactttttgtacactcattgctgacacagggttattctttgtattaaaaagaaattaataaaagttaaggttaggtaagatcatgagctgcttgatagccatgtaactgaagtgagttattaattttgttagctttttttttttttgtaaagtgaaagaactggaccagaccagttttttttcaagcttttcttttaaactgcagaacattttcttcatataatttgtaaatgctgtcactgaaaacagataaaagcagagctctgctggatgagaagttgggggctccctgcaatgaaaagctttctcctttgagaaactagcttgctgcctctgtttttcagcaagatctataacccagatgtctttttttgctctggatgtcaggaggctcaaaactaaatatgatgcttagttctagaaactgttaattttaataattagtacatttgtttcctctcttttcgtttgtcataatttttgaaagtgtgaagtatattttctgtgtatatatcagactcagatctcttttggaaaggggtaggtttaatcagtttaatatatgtttgtatttaggttcctaagaaatattctttttggtaaaaacctacaggaattgatgaacagtggaatgaagcaaggtttcttgtctatgtttttgcagccatgcttgattatggtgcagtatatttggaaactagagtgaaacatgaatttacccacttggaaatgttttctgcttaataatcaaggagctttatttaaagcatagaattttgggatgacataaggctgaaggagaacagagagatcaagtatacatctgcccttaaaaagtacaaagtcaaatatttttattgttgattagaactaaacattttcagtttttagaatctggcagtacagtgcaacagttattggattcagtgtatactcataaattaacattcaacaattacataaaaagtctagtttatgtacctgatctaggctaggtctctagggctacggagatcaatgacatgtggtcccattcttaaagaattccttcctgttccatctgggttaagaacagcttaatttactggaaagagctcagcaagttaaaaggacattaacacttccatgaactattttagggttttaagttgcctgcctaagtcaacaaaaagggttgttgactggaatctcatccctggaaagtcgttgagtaaggtctagatcatggccttgcaatttgtattttagtttttcattttcagacagcctatattgttgctccctatgaatgattattcacatacctttctttccttctctattttacctcctaattttaaaattttaaaattttatttttctggctgcattatgctaattggtctttctagagtttctcttatttaaccattgttaaataaacccttgctggcacttagcctggaacagggtacaaagagttgaataagtgcaaagcccttccattgcaaatcagtagcctgcagctgctccggtggacagctttcttcctttctttctgaagggattgcacctcgtacagcctttataccattgtagcctatagtttcagtcgggttgccctgaatgtgctctaaatttggtgaaaatctatctagctgttttagcctgatacggtaataaagataaactgtattttaattatataaattttagattgttgaagtacattcctgttttctaatggtttgatcatagtactgtagttaagtcgagtcagcatttgctaacaatttttttctttaggtctgttattgaattctttattttgaacttcttatttggctgaattttgtcaagtggacttttttgccctaattaagtgaagttgttacgtatgtatagaaaagtacatgaataagtacacttttacacaatactcatttaaacatcacccagatcaagatgtggatcattgccagaattagttttgcaatttttggggaaatttatagtaatggtatcatatattacatactcttttgtttctttcatttaattgtatctctgaatttccatgctgttgcatgtaacaaaaatttgttgtttttcattgctgtgtagtatcccatatgactataccgtaatttattgatggacattcaaattgttccagtttccggcagttgtgataatgctgttaagaacattattttaatttttggggggaaacatgtacatttatttcagattgggtctgtacgtactggggttgctgcagcctagggcttacttatgttgagggtttgtagatattgccaattttccaaagctgctctctcagcttacattcttatcagtagcatggaggagttccagttgctcactgacactagctcttgcattatatttaatttctcctattttggtggacgtgcactgatttgtttatggttttaatttaatctccttgaaaaatattgatttgaaacatttttgtatgcctgccagccttgataatcctttttttttggtgaagtacatttcaaatcgtttgcctatttaaaaaaaaaaaattggggtcgttagctttcttttgatttgccagagttgaatactttgtatgtaaacaatgtatgtgttgcacatatcatcttccagttggtgtttaatcttttcactcttaatatggtatcttttaatgaatagaatctcttcattttcatgaagctcagtttatcagtctttatggttagtgctttttatattctatttgggaatattttgtctacttaggatcatgaagatatgttattttcaagaaagtttatcttatccatcacatttaagtctacagtttaacagaaattgattttgtgcatggtgtgagtcagtatttgttttccttcttttggatatctagttgatctcaaccatttgtggaaaagacgatcgtgtccttacagcattgcagtggtaaccataggtattttagtctctttctagataccctattctgtaccattggcccgcttgtccatctctgtgccagtgccacactgtttgaactattgtcttcataatgatacctgatagcatatattctccaacttttatttctttagcattgtctttgctattcttcgctctttgaatttacatacaaattttagaattggcttattagtttcctcaaaaatacttctaggattttgactaaagttgactttactctatagagcaattcggaaagaactgacatcttctcttccatagccatagtaggcccctatagttacttagatgttcttccatttatctcagtcgtgtttgtagtcttctgtgtctgtagagggaatacacaacatccatgtctattttcttataactgcttaattcttctattttttttttttggattatctgtgattatacaaagtctttcctttatgtcatctgattgtcagatatgtttgctctgttttttactattcctaatatatataagttctgtaatgattgttttgtttagctgtgtggtttcattgttatccttttgtcttttaaatcatttcctctattttttaaaaaaagtaagtatttttaaatgtagttttttaagcctctgatgcattttataaaattttcttccttgggggaggactgttttctttcagaggtggagtcttcagctatcttttggatgctatgagcttctttttcagtttcttttcttgtctcctggtattctttgttcgtgtgcttattctatcttattcatattggataaggagagctttatgtgaatttactagattattgtatttgtgaatctttgactttcccatctttgagaatgttattctttatagtttggattttagggcttgatatattgccaattcattttctttacctatgaatacatatttgggggtggatctgatgagccataggccaaattatcagtcattttccagtatttgcttcggttctctgcctacccagaagaagcaaaaatgtgagtttattaatttgggatgttcttagtgaatccacagtgaaagaaagactatattggcgatctcttctccatgactttagttctttatgtgtttcttatttatgttctcttttctcaacagttgtggcagttccctgtttactgttgaggataattagtgattttgattattctgccgtctttctccaggtttcttcccagccagggaagaaacaaaattacaggtcctgcttttggggagtcactggggagtagggagggtttcctcttttcaacgggcttaagtcttttctcccccaagctgcctgacttacatcttctagactgggggccactggtgaaaaatttcagaatggtgtttgctcacattcttgaagtgtctgacaaacttcatggtcatcacttttcaaaggttatgctgcaaagctatgatacttctgtttgctgctgaaatatttcttaattgttattttgggttcattacttcagattttaggtggagggaagttgtgaagtcttaacctccaaaatgtctccactcattttttaacacattttaatttgtttatgtgtgtgaacatttaattagaatttatgttcttttctcacgagtaaacagagcttgtttttacttttaccctctgagccctccacaaaccatctctcatactgcagtcatctggaatttttagttctagttttttgtgtcatttgtatactatgtattattttttagagttaatcatgagtctaacgtattttgtgttttttgtttgtttgttatccatgtcctttctcttgactttatgtttcagagtatatgctcaatctttttttaaagaaagcttctggatggtaaacttgtaaatcttgggaagtccaaaaatgtctgttttttccccagttgaaaactaatgtggctatatagtttttaattgaagacattgctttgttgccttctaacatctaattttcctaatttttgttttttactagatttctattttttccactcttgctttgaagcttcttgcctttctctttgtcctggcattctgcagatatctgtgcacaagtgtgtgtgtgtgtgtgtgtgtgtgtgtgtgtgttctagtttgtttttacactttaattagttatctttcttggtacttggcagacctttttcatctaaaggcttaatgcctgtcttagacgcttgaacaatttattttctgtgtatgtgaggctttcctttcctttccttctctattctgtccctccggaactcctaccacatgaatatgggaactctggaagctagcttcttttctccatgtctcctaactcttcgaccacatgttcatttccttaacgctgttttgtatagatctgtgggcttcttcttgcccatttgttacatctgttttgttttttagtcatattttaagggtactagttctttttttaatatgtcagcatattcttgttttattggtaagatagcctcttaaatcctttgagaatagtaattatgagacttttttatattaactgttttggcagagggattgttctttttgagtttaatgcctttctgttttggttctgtgatattgcttagatttttttcaatgtttattatctagtcatgttttttgttgtttgacttattttaatagtgtatacctcagtcaaagttggaatacctattttcctgttagtttaatagaattttcattacagacatctacttccagtgatttcagaaatgagtgaaatttgtggccagatagcttgttttttaggtgccaggactcactgcttctccagtttctttttctggtccattaacacacaaatacctcagatcattttaatggaggtgcttgtgaggctgtgggtggcatccttagttgcatattataataaattcacctgggagcttttaagtatctgtgctgcaccctagaccaagtaaatcaaaagctataagggtgggaccgtcgggatttttaaaaaacttcctaggtgatttcattatgcagacatagttaagaaccactgcatattaaaatttgagtgtctgaatagcttctgtgcagaaaacagcccttttgtaaataggcatagcaaatacagggcattttagactttacattgtagcatttatcagccccatgaccagcttttgcatgtgggcagtgatgcacacatactattttttgatctctgtatatataagtactttactataagtgatacagaaggaaatttggtgtcatataaatgtcttgaatggtgcccagcagaatttcttgaagtaatgaaaggacatgcttataagaagtactcaaaattgagatctcaaaggatattattagatttatttttctgatataatggccagttcttcggaaatgttaagcatttctgtgctttttttttttttttttgagacagagttttgctcttgttgcccaggctggagtgcaatgggacgatctcgactcaccgcagccaccgggttcaagcgattctccagcctcagcctcccaagtagctgggattacaggcatgcgccaccacgcctggctaattttgtatttttagtagagacggggtttctccgtgttggtcaggctggtcaaactcctgacctcagattatctgcccgcctcagcctacctaagtgctgggattacaggtgtgagccaccacgcccggcctcgtgtaaaaatggatgaattttttcaaaaagttctttcagttgaaataagagtgttatctgtcttgcttataagattgttatgaggaataaaagatataaagtgcttagagcagtggcaggcacatagcaagtgaccagtaaatgttaactgcaatattattgttaatgctgttatttaatccactatttaacttttcccatctttctagtttcttgatgataagaaaataacatggaacgttttcatttgaatctgttttcatttgaaccttctaataaactaagatcttagatctttaaaagttcagtttatgaaacagggtattaggcacatgtgaatgaagactgggttatattttacttagtgagtatgtgtgttaaaataggttgttttgaatagtaaacgattatgaattggtaaaagttgatttttgcagtgaaagacaagatgttaattactatgaaataaagactaaaatgtagctccatcttgttaaggcagaatataaacagattttttaaataagtaaaatatagctccataccttttaagaacatataagtcaaattaatgagtttgtagttatcccttttttctcttaagctaaataattgatacgagaagataatagtacttgacataaagcagaggagtcctgaccaccagagaattctgtgtctgccattttctgcctgcgtgtttaggaattaggtgttttgtggacataagtttattgagggaagatcaggtagtatgtttttaatagtaactctaatgtagcccaatttgttctgtaatacgcttgttcatgtgttgccttgagattagttaactccccaccagtatatatataggttttggttttcattgatgtatttataaagattagcctccttagtttatagtattatattaaatagttttcaaaatcttacatttttaattcttgagcattcctcagaagacttgattgtgctcagtacaggtaataggatattgaccctttaaactttaggttatcactgagcatttatgtagtttctatattctttcaggacctttaaattattttttataacttttgcagcatgcctgtgaaatatatttgttcataaatgatgggactaaaactcagaagaggccaggtgacttgttcagggctgtgaaatcattattattatgcatttatatagaaagttcaaggcatcctagtgattttaggcataaaatattaaagataattaaagcatgacccggccactcatttgccttttcccataaattgtacttgaaccatcttaactttgccaaaagttttcgaccttaatggtgcatgtcatggaaccctcagaggaaaacatgagtgaagagatgtgacattgactttaatctagaatagaatacactgacatattagtcttctagaccgtagttcattgaatctctggaaacagctttcgtcttgttaactgactatacgtttgatcatattaaagtttcatgatctccttgtaacatgaatgatgttagaatcatgaaaagccattgctgccaacaagttggaagttgaatttacggttttcaaaagtgtcattaggagatttttctaggttgtgcttgctattattgtatgacattttgatgaaagttcttaagcatgtagtactcttgtagatcatgtaatcaagggttagcttgtttcacagctaatctgcttgttagctgaatgttttttctaggagaatggatgacagtagagcttgaaggcagctttccctagttccttagtaagccaagctgaagggacatacatgtgctctaaaataagtgaatagacaaattatgctgactttatgaaagcagtgcttttgctgaaaaaaatgtgttgcgcatggagcaatcaaccctgatagccaaccagatggtttttttcctccatttattctgacaaagtctaccattgtatcagtattttttggcacattcatataaattacctgtaatttttggtgtgctattttttgatagttacagtaaattcttaatttttcatggtattgtaagggtgggataccttgaactagtgaagaacatagatattccaaactttgtgtgccatatatttaatcattttattttgctaaccttgttccttcagacctgttaattagcaaaattgcttgagttgtacttcctttctatctccagagtaggtaactaaaaatgttgacaggagagagatctaaatttaaacaagtagacaacaacaacaaaatcaagggtggactgtgatgtaatgtgtgtgttacatttcatatggattgatacttcaatgaatgaatttccatgttagtgggattacactggacacttatgtaagaacactcatttatggaaccctaaaaggatttcttatagtgcttatagcaaaacaaatagttgcagaaattaaacgtgtgtgtatttaatgtttttataaaagatgaagtttctcttttgctttaactattttatagtgtctatttttcagcttgaaaatgacagtgccaggcacacagtagatgcttaataagtacatggtggtgatcttcacctctgttcagatggaggtcagtgctgttgtggaaggaaattgcaatagtcattatttttattacagtcttcatcactgaaactcattgaaaacaataaatcactttaataaattctagcaaatttttatttttatttttatttttttttgagacggagtcttgctctgtcacccaggctggagttcattggtgtgatcttggctcactgcaacctctgcctcctggattcaagcagttcttctgcctcagctgggactggtgtgtgccaccacacctggctaatttttgtatttttagtagagacggggtttcgccatgtggccagcctggtctcaaactcctgacctcaagtgatccacccacctaggcctcccaaagtgctgggattgtaggcgtgagctactgcgccgggcctctagcaggatatttttagattattcctcaaatttgtctgtctcttttcaagtcattcattcatttcctaactctccatctttttatttcttctccctgtagttatgtttgacctttctctgcattttcttaaaacatatatgtaattaatgtccattcaaatattacagtttttgagagacttagaggaagatatgaaattacctctttattacaagaatagttcaatagttactctacaggtgcacatctgtatatgtgcaaaacactgtgccaaactcattaagggttagataaatgaggaaaaccatagtccttgccctcagggaacatacatagtagaagagaaatagaggaggttatgaaaatagtttacatgaaatacacaaatgtgtgtactataatataactctggaaaaaaatacattaagaacacagcaactagaaactgctgcttcctactgaaagctcacataggagaccgcatagtgctgtggaaaggaaattgcaataagaataaagagctctgagttctagtcttttcatcaccatcagctgagaaatactgagcacattctctggcttttttccgtccctagcttcagttttttctgtgtatatagtagattttaactaaatctattagtttcataaatattgtggcataataacatgtttgctgtaaccttcatagaagatgtgtcctttttcttttagttactactaatattctattttcagccactgttagggaatgtaataatttaatcaaataaataaaataagattaactgattagtcacatggactgattagtgcagtgtttagaacaaagaactttgttctaaactgtgttctatagcacatatgacatatgtgctatatgaagcattttaaaacttctaggctgtatattttaagtttctaaagtagacatgtagacttttgtcttatgggatggacaaaacccaaataacactgcccgagtacgcatctcttagagacagccatgaatctgattggcttttcttagaagctgttgaaagcatctagaggtgatcttttgatgcttgacttgggaagcaaagaattggtctttggtttttgcttctgaagattttttttctcttttctattaaaacagctttaagtctacagcaggtctccaatcggtgtttagactattagtaaattatcagttcaaatgcatctagcctgtttgtcttcctgtttctaaattggaagtgagaagctgctaattaactaaactttagcatatctgaacacttcaaaaatataatgtgtaatatatatgctggtgccctttgaaatctaagttttgaagatattttagctgtgctgaattaaaagaatactcaagtttattttataagttattttagtatatcatacaatattttggtttcatattaaacgcaaaggcacctgtgagacctgatacagaatgtgacaaaaatcagagattagcatagtcactttgtgaagacatttttctgttcaaaaggaaccaaaatatgcactatctgaagcctaaggatgttgacaaataacaaaatgaagcatttggaaagattcagaaggaagaagctgggagcagattgcttagaattttactcattgccttataaaattgataacatacttaggtactactaaacttgaagggttttattttggttttttaattggtctgtagaccactggccctttctatgcagactacgtacattattagaaaagttgggcaggagttacctggctgaagtgtggattaatgcagtagagtgctttacgtaatgcatactgcttaaagcacaggtgtttcttttgttggttgaatactgtctgattttccttcctatgtaatttacctgcatggagattaagaaagcccccttttattaaataagcttgaaaactagatgaatgcacttaggttcttgggtagaatgtattggatagctagctccctttatgatgagcatttaaaaatctgctctccaaaaactgggaaatgcattctctgctgtatggaaagcaatatagtactgaaatattcctccttaattttggtctgaacaaacaaaagtgtctgtgtttattcttgcctaatgcatcacaaatctgctgacatgctaaccttggagtcttggctggcgttaatcaggcctgtgcaccggcaggaaagatgtacctaatgcactccatcagtgcagtttgcatatggaagttctcacaggggagctgccctgtgccagctgagggttacctgcccactgcagttattgtatgtaattatcgaaccaatctgttcagcccagcagggtttagacggtaatcatgaagcaacactggaaaagaaagatgtaaggcattctccccttttctcatcagttatatgaagttatagccactcttacagctatttttgagaggcaatacccccatatacaaatctgctaaatgaatgcctttgaaagtttctcaaggttcagtcaagttgttatttttgtatgtgtgaagcattttctttaggaacatggtgggtatctctgagttctaattttccacagccaccttaagaatgttttgaaacagtgggattaattgtaatacatagataataacagttctgaccgtttggaggttttaaggtaatgtgccttgaatagagttcagctttcccatgtagttctctttggaacagaacccatggttgccattaggaaaaggaacaatgtgctgtcagcaggcattatcctcttttctagctgtacacaaaatggcctgcagcaaggaacattctcagatgaagtttaacttattgttaattgttagaaaatataaatgaggacattctgttgcattgtgaacctgtgagatttggggcatgtcggatggttttctaaatgatacagacttattttaggcaaccaagagaagctttggattaaaatttgtattttaacctgcttaaatttgaaactacagaagataaagttatataaaaaaattcaaagttttatatttattcctaatgcccgtctataattttacctatgtatagagatgttagagaatttagaaacttaacgcaggattggacctgttagaaaatgttgtagtggtagaaacacataaaatgaaattgaaggaacatttgggaagaatggatggtgacagaatataagcactgactcctaaataacacttcactagaaaaataggacaggcccaagagaatgtaggaaatccagacgatttttgagattttcggagagctttgtacttttaagactattcatgtacagtaaggtttatggccctcttaaacttttaataaaaagtatgctaaaagagaaacatttattacaagtttttcattattgattcataaatagaattctaccaccaatgttatgtggtacaaacactgatttaataaatggggcaagacatacattttttccatttatcaaatagattatcctctccaccccacccatgttgtacaatgtggagagtatcattggcctgagtggtgatcgtgagtttgtaaaacattttgttttaaaagagtttctgtatgattagtcctgatggttaaaccatagctttgaataatgaagtatataaagcatgaaaagttagaggtggatataacaaatatatctaccatctgggttaactgtctagttgaaagttcttgtactccccctttcttccatccctcatccattcctttaggtaactactatcctgaagttgagaatattcttcctgtgtgttttgacacacccacacctatatacatttatacacacacacagacaaatatgtgatgagtttgtagtttacttgactgtcagatatctctctctctctctttaattttatatgtaagaagcgaaagaaagaaattgaagaaagcaaggaacctggtgttgaagatacggaatggtcaaacacacagacagaggaggccatacagacccgtaagttgaacagttttgcctagctgctttcataggtaaacacaaatttcatttcctcccattagatgaggggtcaactatttgggtcatgaccttttgattttataataaaataccacaagatttttatatagtatgtattgtgtcttttgtacacaggttagattattttctctccacaataattataaagttgagactgggaagcttccttcattttgcagatttggaacccgagacactgaatgattaaatggcagagctgccaggcgtggtgactgatgtgtgcctgtagtctcagctactcaggaggctgaggcaggaggatcacttgagcccaggagtttgagtccagtctgggcaacatagaaaccccatctctaaaataaataaaataaatgactgagctgttgtgaaagggttagtgatagagaccagaactcttaactgtcaggccaatgtctttccacttcctcacactgatcccacataactctgggtatgatagtgagtgtcaggggtcagacatgggtctgttgcagctgagctgcctgattgttccttataaagtttgtcaacctcttcttttttttgaacaagttaagaggaaaggaattaaagctttatggatgatcacttttcaaagttcttgaagcaaaaaaaaaaaaaaacacaaaaaaacaaaaaaaacaaggtatgaagtcatttttctgagatggcttataaactggcactgaaggcacttccaatagttccagaaatgacattagcaaaggcagcatctgcaaagggcagagctaggttggactttggtctgatatgtttaataaactgccagccaatgtgttccaggattcatgtgatatgatgatgtacttgactcaataaagagagctattcagtgtggcccacaatacatttttttaaaaagatttttcctgtctgcctttttttttttttgaattattattttgtttgtcctgaaatatttcttggttgctaacagaaaaggcttatttttggttaaaaaaaaattttacagcataggtgccatattgagtaatgccaccaatttattttaccttccttttgctagtgacattagtgcatgtttgtggaaagcacagtattcaactttcaaagagaatcatttttgccctgattttattactatgttcttcattacatattatggttagaacatcctttggtttaatctgttttaacccaaagaatacttgagatacctgaagagggaatatataacttcacactgaaggcgagaggttttgaagtagtccctctctttttcccgctgctgtcttcctttcgctactgtcttttttcctcctttcccctgtcttgttcattttgttattaggaagtgaggagtcccaaggagcaatacatcgaagcatgtctcagccagaggctagcagcagcagctatgacagtgagtgggaacaaaattaaggagtatttataaatatacagcaatattcttaaaaaacaatcccttaaattttaaaactggcaattttagtttcagaaagatcctgcattgttctagtgagattgacactcattaagtctaaggcagagtctcagctgcgcatcaggaagactcatccctttcttgactgcctggacatcatttgttacctgaactttgcttaatgagcatcaagcgtttttgttttgatagataaatgcctttaaattctagtataattatgaatttttttttaacctaagtttttagtttaaggtcttctactgatgctttttcccatgagaaaatatatcagtatttttgttattttattaatgacaaaagagtatagtaaagtcataaataatttaaggagaacaattcagtttttttgacctaactttttcagaagataaagaatagtcagattcacccttattcatataaactcaaaattgccgttcttaaaatgctgtttatttcccccattacagttcacttttttcccctaaagtacaatgcgagttaaggtattttactatcaaaataatcataagtgagagaaatattatctgatggtaaaatattattgcttccagcaaaaagaaaaagccaagagttcatgtaaatgtatatttttaaatttatcagtttaaaagttacttgaaggaaaagacacattattacatttgtttttttaatttttaagatatatagtacaattcagtgaacactgtgttttagggctttaagattttgtgtcataaacgtgtttcaagaatggttacctctaacagcagctttagaaatgtcagtttcttcattaacaattttattttcaaacacaatttatgatttacagtatggtaagagatttttcgcactgtgtgatctttcagaatgctgtgcctagcaaaatgggagcaactttcctttaatatctatttagaccattttaaaaatgtgtataattttctagatacacctaaactcattttgaatagttgggggtctattgtgtaagaacacattctgaaagctttcaaaatgtgtattgtgtaggttttctcaaataaatagaggaggtgatgggatggttttcaagaagaacagaggcctctaatccttttatttttatgcaaggcataatttttaccagttgagaaaatttggttactggctgcaagtaatttttcccctcacaaaatgaggagcctttaaaaatcatgcatattttggcatttcaaaatcatgccagtatttcagaattgtgctaaaaattagctaatatagccatgatatttatggctggtgtactttcccccctcctgttcataaaatggaggctacttttgttggtattatttttaagaaccttggattttggaccattcctgaggaatctttggagaaagcatgactagtcaaaaagtagatatttttaagggaaccctacaaagaaatttcctactttttttttcctactgcattataaaatcatagaaaagcatcccaaacttgtatgttattttccaaatatcaaattatatacattagtcttctgattggaccctttgccagtagtgtatattatgaaaatggttatatatttaattaaagagataagaaggtagttttttttgtaacaatcagaattgattattagggaaaatattgaattgatttatgcagcaaagtcaacaaggtgcgtaggactgattatataataaattccaggcagtagtagcccttttagttgcagtgagaaactttggattgaaggagatgagcagcagtgatatttaatttcagagtaaaatggcaaattaagacattaatgagaataatgctatttgaatgtaactttatagttgttaatttagtgttctttgtagtgtggttaaagatttaaaatgtgttgaaagggagatatagtattgattattgaccttgattttgtaataccctttatgccagtctcactatcgcagcattttcagttttctgtgcagaattaatttcaaatttcttgaaataggccgggcgcagtggctcatgcttgtaatgccagcagtttgggaggctgaggcgggtggatcatttgaggtcaggagttcgacaccagcctgaccaacatggtgaaagtctaagtcctactaaaatacaaaaattacctgggcgtggtgacaggcacctgtaatctcagctactctggaggctgaggcaggagaatcacttgaacccaggaggcggaggttgcctgagccaagatcgtgtcactgcactctagcctggcaacaaagcgagactccctctcaaaaaaaaaaataataataataaaaataaaatttcttgaaataaaaacctaaaaatctactgtgggatatttttaatagatggccgtgttacagaaatttaagaaaaaaactcaaattttagaatcaatcatagtacagtatatagggtatgtattatgagtggcagaaaaaaggatattcatataagcttgaaatttgctttcattgaactgtatgattgaatagaaactataacttggaaaaattaaaaatgctagttttgaaactgaccttcatgttaagtaactaaaacccatgatcagaaaacctttagatacacatggtagaattttgttccacattcaaagaatgtttcgtacttttcagaaaagaagtattgatcttttgttttttttcgtgcagtcattgattaattatgagcaccatgctgtccctgactctggtgcccctgctctttcctggcagagcgtagcatgcggcagtgggaaagaaatggccctgcttctttcaccagcactaggcagccgtgatcaggctaactgctgtacccagaggtggagtaggagtagtaggtggggtgaaatgtcttggtgaggcagaattcccatgcccccagcagagagtcattgatttattccaaaccagaatagttagataggtactgtcataaaggacttagaccagtatcacatatgatccttttccaggaggctactcatttgggacctgtataattcctagcggaaaagactttccatttcagtatatcccagtgctctcctgcctcaagggtgtagctaatagtctttaaaaagcaacttattgctttgcttttcataacatgtgtgacctcatcgcttccacctaaggagtgaatgcttatctatattgctaaggtttatatttggagataatgttttaaattttacaacaaatttaaattttggagagaaatatttcagtattagtaaaaattagatacgttttatcagtcagtatttttatatggcttaagagaaggtaggttttgtcagcatattttttgacatattaaaaaatgacccaattttctaagattttcagagtattagcaatcatacctttgtatgtcagttttatctttgcaaatcacgagagtcgatttgattttaaaatgttaataactatatttagggatatttatatttctgttcttttgcttttgtaaattattgactagtgatttcagtttctttgatttttcttcaaggttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacacagtatgttgtggctgtaaggtttggtttgtattgattttgttctgttcccaaaatcttttattaaacacctgctgtatgagacaggaggtacaaagacaggaaaggaatatgaaataaaaagtggaggaagcgtatccatgagagagaaaatctacatatatgaaagattacataagaattatgtcagtatgcaagccgtatgacaagaaaacaagtgacagatgatcaaatggtggtgtgattaaagattgtgtaaagactggcttcatctacggaagtcctatgaactagatattaatagatagagcctattgttcattcacagaagtttatttttcttaaaagtttcactttcatagcatgtaatatttatacagtaaaccaagcacttcagagtttcagtgatcagaaagtttaagatctgaaatgtttttagttgccttgggaacagaagcttgtaattttaacacatttatgaacaatttcatgattcattcctcagagttttcttggtcagagaaattggtattggactatattttctgatggatggcatgccttaccacttaataacatgcacagtgtgtttagaaggtatatggacatagtttcacttaaatatttaagtatattaatgtgtattcagaatacagctagcacattaaactggtgatttgtctactacttaggacaagcctaaagtaggtatttcaatttttaaaagcaagtcgatttgagggaaaaaataagtaaatgtacaggtgggatatggacataccagaaattgtgaaggttggaccaaatttgagaaactatgaaccaatacaaagactataacttttggctctcttatgtggatatttagttgtcatgtgaagcatttatcactgaaatggttagatactgaaaaatgcaaaacatctacagactttcctttgaagattaaccttttaatgcctcctgaagttctagagcaatgtatctttacagattagaaaatttgactttgggcagaggctcctcctgctttctgtagaatgttacgttttagtactcatcagtgttaatcccccaagtttatttgtaacacctaaatcaactctcaagttccattttaaacacattaatgcttaaaatagagtaaactgtgtgtggtatgtttttctgtatatgctgtagcctccttatttttcaaaacataaaacatggaaaacttggttaaatattaagaaaacaaatatttcctcacattattgtcttaaataagtgctggcattttcttgaatgttcctatattggcagggctagagaaattaatgaaaaactactagccattgtagccagtttgattcatcagctacatcccttgttcggctattttattccctaccttgtattgttttattctactccccttttaagaaatggttaagctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtctcttttgctgtgcagaagctctttagtttaattagatcccatttgtcaattttgtcttttgttgccattgcttttggtgttttagacatgaagtccttgcccatgcctatgtcctg

SEQ ID NO: 13836 - DNA, 16506 bp, Human
atggataacagttcggaggttcctcaaaagactaaaaatagaactaccatatgatccagtaatcccactgccaggaatacatcaaaaagaaaggaaatcagtacatcaaagagatatctgcactcccatgtttattgcagcactattcacaatagccaagatttggaagcaacctaagtgtccatcagcagaagaatggatacagaaaatgtggtacatttacacaacggagtgctctttagccataaaaagaatgagatcctgtcatttgcaacaacatggatagaagtggaggtcattataagtgaattaagccaggcacagaaagacaaattttacatattctcacttgtttgtggaagctaaaaatattaagacaattgaacttatggagatagagattagaatgatgattactagaggctgggaagagtagtagcgggggaagtggggatggttaatgggtacaaaaatatacttagatagaattaataagatctagtgtttgttagaacaagaggatgactatagtcaacaatagtttattgcacatttcaaaataactaaaagagtataattggattgtttgtaatacaaagaataaatgcttgaagtcatttaccctgatgtgattattactcattgtatgctcgcatcaaatatctcatgtaccccataaatatatatatctactatgtgtccacaaaaaatttttaaaaataataagaattggcttaaaaaatgctgtttcctgggccccaccctagactgatggtcagatacctaatgttgacaaaaaaagtcaaactctgtaaaacatttgaagagatttattctaagccaaatatgaatgacctatggcctgtgacacagccctcaggagatcctgagaacatgtgccaggccacaacttggttttatacattttagggagacataaggcatcaatcaatacatgtaaggtgtacattggctaggtccagaaaggtgggacaattggaaacagggaagcggggcagcttccaagtcataggcagattcaaagattttctgattgacaatttgttgaaagagttattatcaatagaaaggaatgtttggagacatccaatagaaattcaatagacaatcattagaaaggaatgtctgggtcgtggagaccaaggttttattatgcagatgaagcctccaagtagcaggcttcagagagaataggttgtaaatgtttcttaatacacttaaaaagagcatgttctggctgggtgcagtggctcatgcctgtaatcccagcactttgggaggccaaggtggttggatcacctgctatcaggagttcaagaccagcctgaccaacatggcgaaacctcgtctctactaaaaatacaaatattagccgggcatggtggtgggtgcctgtaatcccagctactcgggaggctgaggcaagagaatcacttgaacccaggaggcagaggttgcagtgagacgcaatcatgccactgcattccagcctgggcaacagagtaagactctgtctcaaaaaaaaacaaaaacaaaaacaaaaaaagagtgtgttctattagtaattccaaaaggaaaaaggatgtaatgaggcatatccagcttccccttcacatcagttttcaggttaactttggaatgcccttggccaaaagcaggggtccagtcacatggttggtgagtatggccttagaatttaattttttggtttacattaggaatgcttccacattctctcaaacaaattttagtcacagttttgaataacgtactctggctcagccattgcaggtctcaagccgttaggtttcattttcctcctcccaacgattttaaattagtttcactttccagtttcctcttccttcccctaaaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagacacagagggcagtcatgaggtcagtgaaataagaatgcataatcatgcttgtttttgagtgcaaattgtaagttgagtttcttactgtgcaggcacattcctgaattgtcctgatgtttatagattcaatatgtctttatcagtctgagcatttgtaagatgtttgaggggtttttccctgtggctttttttggtgtacacacaggcttcttaagtttctggaatggttccctacggaactacatggggggaggcagggtggggaatgcatcagctcatgtttcctccctgtgtgcagctatttcctgcaatgagaggaaggcttggcaggagcggtgtatttcactcagccacaaacttggctgattcaagggtagacctaagggaattactcttttgggtttttctgttattgtcattttgtttgaaaagattaagtcacaggctttttttcttgtaattttaaaaggaggaatttattttcaacagatattgtgaaagatacaatcagtactgcaaacccactcatgaagaaggcaattttgccctgaaacgttgcattactttaaggtgggaagtggaagaaacaattcttacaaatgggcatttttgtcatttcttatataaaaacaaacccaaagcttagcatttatttttattgatgtagtgaatgctggtcagcagcaaaaaaagaatttctcctcaaaagtgtaatgacctaatctattatctaaaactagtctaatctctaatggtgggaagcagatcagtggttgcctggagatggtggggattgagtaggaaggctcccaaaagaatctttttagaatcataggaatagtctatagggaggtagtgatggtggctacatatgcataaacatttaccaaaactcatcagactatacactgaaaatgggtgcatcttattgtatataaagcataatctcagtaaacttgatttttaaatttatatattgtcctcctggagttcttcaggggatagcatgttagggagaactaagagaaaaggatgcctttcccaccaagcatctctaggaaaggagtgaggaggtgattgccagggagggaagaccccatcgaccattcaggggggcagaaaaggaaaactggattccctaccttactctgccccaaggacttgaagatgctctgcaatgtcatgtttggggatgagatgggtaagaggaattcactgccaaatacctcagtatatagaatacccttttatatagaataagttcctggtcaagagtgatgttaattgtgtctgtgtgagtgggattgaccagagagcaaggcgtcttagtagccagcttgcaggaaaggttttacagggtcctgtctttaggtgtgtctatagccactgacctgaggaggtctgaggggggctctctgaactatgctggactcaggttcacatcaaggtgctcctatttccagaggctataggaacaggaagagattgggctgctcctccccagttgtgctaaaaatttccaaatgggaaaatcacctggagaactcactggcacgtgccagctgatgggcatcctcctctgccccatccactgaggaactctgttgctccctttacacactcacaaattcacttaaaattataacacaaatatattagtaccagcaatcatggtggtaacatttctttgtgatctgtagttagtggtttcatgcaagtccgtgtgaagagaccaccaaacaggctttgtgtgagcaacaaggctgtttatttcacctgggtgcaggtgggctgagtccgaaaagaaagtcagggaagggagataggggtggggccattttataagatttgggtaggtaaaggaaaattactgtcaaaggggggttgttctctggtgggcaggtgtgggggtcacaaggtgctcagtaggggagcttttgagccaggatgagccaggagaaggaatttcacaagataatgtcatcggttaaggcaggaacaggccattttcacttcttttgtggtggaatgtcatcagttaaggcaggaactggccatctggatgtgtacatgcaggtcacaggatatgatggcttagcttgggctcagaggcctgacaagtgggcactgtgttaaacacgttttacgcatgacctcatatcacccttccaacagccctaggaagtaagagctattatttctattattagcctcattttctagatgaccaaaatggggcttagaagggcaaattacttgcccaagacatcagatagagagcaggtgtcagagcagagtcattaatggaggcaccaaactctactgctgatcatctgactctatgcccaatggccaaaaggtgaaagatcttaatgctttcaactatgctcactttagagagggggccagggatgggcttcctatctggagagtaagggccagcctttgatggttacccatgccttagagtggccaaagccacaagaactgaacccagatcttggagaagggtgaaagtggttctccccagggcataattttctatcatttggatgaagggaaaaggaaattcatcctagggcattttaaggataagggaatgaggctcagtgatatgactcaagaaatatcccagaactaagcaaagaggtcactgaaatccaggtgtcctgtggttttcttcccttcactcaagatgcctgataatgctgcttaattcaccacattagctccataaataaaggggaaaactgctttttaaaatacctctatgacagcacttctcaaaatgtggtacaggaactcctgcactgaatttccaaggcacttgtgaaaacacaggtttctaagctcacatcagattcactgcaccagaatctctgggagtaggactgcatagtcagtactgtcaatatacaataatcagaaggctcaggatccagttaaaagagtttattcaacaaaaagttgagggcagcagtcccaggagtagagctgcacccaagaatggtgaacagtacttccagtgtagagaaaaatgaggactgtttacataggcaaagacagaggtgttcaacagaatgacaacttctcttgttgttgttgtttttgttgttgctgttgttgtttttgagacagagtctcactctgtcacccaggctggagtgcagtggcccgatcatggctcactgcagcctcagactcctgggctcaagggattctcccacccagcctcccaagtagctgggactataggagcacgccactatgcctggttaatttttttgtattttagtagcaatggggttttgccatgttggtcaggttggtcttgaactcctgaccttaagtgatgcacccaccttggcctcccaaagtgctgagattacaggcgtgagcctccgtgcctggccaacattttccatacagaggctaacatacagatatacaatttgattggctactattgattacagtccaagggaattgcttaatattcttttgtaaagaggtaacatggctggccgcagtggctcacacccataagcccaacactttgggaggccgaggagggcagatgcttgagctcaggagttggagaccagcctgggcaacatagtgagaccccgtctgtactaaaaatacaaaaatcagccaggcgtggtggcacgtgcctatagtctcattgactggagaggctgagatgggaggatcgcttgagcctgggaggcagaggttgcagtaagctgagatcgtgctactgcactccagcctggatgacagagtgagatcctgtctcaaaaaaaaaaaaaaaaaaaaaaagtaacaatcaaaagggtctctatttccataacatgaggtctacgttttaataaagactaggttgtctgaggccgggcacggtggtgcaaggctataatcccagcactttgggaggccaaggcgggcagatcatgaggtcaggagttcgagaacagcctgaccaacatggtgaaaccccgcctctactaaaaatacaaaaattatccaggcatggtggtgcacgcctgtaatcccagctactcaggaggctgaggcaggagaatcacttgaacccgagaggcagaaattgcagtgagactagggagtctggttaacatgtaacccctcaccacacaggtcaaagagcaacagtcatgcacctgagaaaaaaaacagtcacgttacgtgagtcagttttcagggcttaactttgcctcttgacataacacatttggaagcttctaaaattttattttctttttacagtgcctttttacaactttcaaaccacagttttccaaatctgtctggaacatgttcctggcgtgagtgagctcagttctcacagattctgtttcagtttcccctcaagagggatcttgatagggttccatcagtttcactttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgaggtaaatagtccctgcttctctgataggaaacagaatttcttatgtacaacttcctgacttatgctatttcagtgtttgcttagagatgaaatatgcatttatctaattcaagcataaatctgccttaccaattcatgcatttttatttctgtagctctttgtgatgtatagagttaggcagccaaaggacacagggaaatgggagctgggagctgggaagggacggggcatattgagagatcctagagagcccatgctcagatgctttcaggtaaaatcgggccagtgaaagctggggcctggagggaagttactggaggttctggttcgtcttttgtttcttatatttagaaagcctaagtcagaggtttgtggttttgttgtgactgtggttatttttaaaccatgcttgcttctcagcaaatgtgtcaataattaattcagcactgcaaaattccaatttatgttgaggtcacttttaccttgaaatgcactttttcataattgggggatatgtctacttgagttgtcctctagcaggtctagtgacctgctaagcctcccacgtgatcaatgaacagggagaaggtgttgcttgcagtctctcaaactgtgttctgcgagtggcctgaatcatatcaacctgagtcttctaatagaatgcaaatttctaggtcctgcattctgaaatcctgattgagtaaaacagaaataaggtccagaaacaaacatatatttaaagaggaccacaagtacttcataggcatactgaatggcttacagaagaaatgtccatctccaaatcctctcttccttaaatgcatacaaggcttcctgcattgtatgtgtgtaaatgtgaaggaggaaaccccaagaggcaggaggggggaggggtgggaagaatgttgaaataaagcaaagcttgtttctgggcacagtggctaagcctgtaatcccagcactttgggaggctgaggcaagaggattgcttgagcccaggggctccagaccagaattggcaacaaagtgagacctacaaaaaaacaaaaataaaataaaaataaagcaaagtttgactgtttaaagggtaatttaagtatgagaaactggtgattggaaatcactgccaaaaagggaagtcttcccagagccttgctgctcacagtgtggtctgaagctgagatcccccgggaggttgtaagaaaggtaacatcccagcttatctgaatccagatctgcattttaaaaagatctccagatgtttgtgtccatatgtacattaaaggttgagaagtccggctctggagagttccttcacttgctttctgaagtgatggactccttggattgggcctgttctgaccaaccaactgagcacaggtctgccagttccttcacgtagtcagttggagcataaccagcacatgctggggacaagctgcacatgtgcagacaagagtggggaaatccccactcttaccacttcaagaaagccactttctgaaaatttcaagattctactctagtaatagctttgactgggaaggagatgtggtatctaccctggagtctgtgggcaagacaggtggtcatgatctgggttaggtgagagactgtaactatgttgattctggggatttcctaaggactagcagcactagctttaactgctttagtaagcgaaatcttatgtctgcaatccgaggtcatgggaaatctctttctggacctgagggaatcctatctccctaaggtcttctactagatgcagatccaggtaggactggcattctactccccaagtttcacctgaacctagctattctgttttttcttctttttcttttattctttttttttttttttttttttttttttttttttttgagacggagttttgctctttcgcccaggctggagtgtagtggcccgatcttggctcactgcaacctccgccttccggtttcaagcaattctgcctcggcttcccgagtagctgggattacaggcgcctgccaccacgcccggctaatttttgtgtttttagtacaggcggggtttcatcatgttggccaggctagtctcgaactcttgacctcatgatccacccgcctcagcctcccaaaatgctgggattacaggtgtgagccaccacgcccggccacctagctgttctttatcaagtgactgtagtcatcatcccacctgcctgcttgtatttatttaaatatctgcattaattactgttaactaacttatttatacatataagaagtattcagagtaactttcaaaaacacatatgagataaattattaagtgaggaaaccttggcaattggagtatttgttttaagagggcaatagtattataatgaaaacctcctgacctgtggctctggggttcatgtttcttcttatcgaggtctcaggccttccagtccaatatattttgctccaaattttacttcaaggagagatcaagtatcaaatacctcatcaaattggagactttagggagtaaggcttaggaaaaatcaagagaatcaagggacccaattttcagtgggttttataatcataaagccacatgagtagttgactatcttcctgaataaattgttccatgttatcattaaatgtctcagcctggccagctctcgcattggtaaagcattggtggggatggaatatccctgagagatccatattcagagctctttcacaagtccagaaatgttcagtgtgcttttctgcttgtccaacactttcttgagcaattgatatcttctgaagctgacacatgacagggtggaagtatgtttcatctcagagggagaatcttgagctataagtgcttaaaatttagtttggtaagatccctggtgcattgatatgtcaaagccttctgccctccaaaaaaaaaaaaaaaagagagagagatagtgtcatcagacttgcaaggtggtttccggtttcgttgaggcaaatacatccaacaatacatccaacatcacctgtcatcctgcaggtccactggatactctctattaattactagagtgttcagctatttttttcaggcacccatatgtacctacaaatctgcagatacattctattgatctgagactcacactttctccttttaaccttcctaattcacacatcagcaaagttaactcatgtttccatgactttattatgatttagtggcataacagatataagcagagttgttcaattatcatcgttataacttacttttggtattcattttttaaataattgctaacttgacttttgacttgtagtccttcatacagggtagttagaatacccaggtaaagccaaattgaaaacccctagggccaggtgtggtggttcacacctgtaatcccaacactttggtatgtcgaggcagaaggattgcttgagaccaggagtttgagaccactctgggcaatatagtgagaccctgtctctgcaaaaaaaggaaggaagggaggaaagaaggaaaatagggagggaggaagggagggagggagggaaggaaggaaggaagggaggaaagaaggaaaatagggagggaggaagagagggagggagggaaagaaggaaggaagaaaggaaggaccctataatagacagggaagatattgacactggaaccctagacagggaccaagaaaaggaaaaggactgtccccaaatcaaagcacacacataaagaggctagccggatgtagatggcaacttccctcctcactcccattgcccttgagttgattctgcatctctcactataaagcatttcatgtgcaatcatattgggccaaaaatggtttagatcagcattactggagagacagacaggaagtataatagatcagtacacttgcagtagcggtgtgagggccagtgctcgtccatggtaaattgcaaataaagtcaatggctccttgtagaacaaaatgcattcaatttaaagaattttgtttattctgagattactttttcagtggcaaggaaaattctttcttttctatcttttaaaataaaatattggtcagaatagatggttggtatcttttcagatacattagcagccctatttggttcataactttttttctgaaattgtgcttgtctgtgaaatccaaaaataaggacacttggtttaatgatttctggaggttctttccaatcttatggtgccgtgactccactggtaagaaggaagaagcacaaactcaagagtgagggacatacagcccaagccccaggcaaatgtagataatgggaacacacttagagaactcttgcaatttatccagctaaataaggcaagtgatctcctttagtatcttccaactacaaaacaaaaatgagtccattttgtttgtttgttgcaacaaattcattctgtctgggaatctggcctgtgtggtggggagactacttcagtcagactcaagctgagcctccgtgggtctgtttgtaagtggtggaaaagatgaagggaaaaatacctaaatcacataacatgttggcagacatatctgggcttttatttctttacatgtctcctaacaaaactgaaagcacctggcgggcagagaaggttgggataatctctatttttcttagtatccataatatctaataaagtgacaaaaagaggtaccccaataaagagtcatgggatagctaaacaaaccttacccagaatgtacaaggaatgagaactgacttggtattttttaatttttattcttacttttattttttttgaggcagggtcccactctatcaccctggctggagtgtaatggtgtgatctcagctcactacaacttttgcctcctgggctcaagtgatcctcctgtctcagcctcccgaatggcgaggactacaggcatgtactaccatccctggctaatttttgtatttttagtagaggcaggctttcgccatgttgcccaggctggtcttgaatcctgggctcaggtgatccacccgccttggcctcccaaagtgctaggactacaggcatgagtcaccattcctggctgacttggtaattgagcagcgtgagagagatctcatttcctgtcactgaagctgcctcctcttacccatcttacctcacctcctgcatatctgcttacacggtgtaagggatgtgctttgtgggtgtctgcacagactgtagctaaagaaaagtgaatgtaggaagcaacttacaatttttccaaccttgtgatggtacaaaagtgataattccattcttgtttttcacttaaaatacagtattcaataagttacatgagatactcaacactttagtataaaataggctttgtgttaggtgactttgccccactgtaggctaatgtaagggttctgagcacatttaagctaggctaagctatggtaggttagatgtattaaatgcatctttttatttacaatgttttcaatttatgatgggtttatcaggatataaccccatcataagtcaaggaacatctatatataaagagatttattatgaggaattggctcacctgattatggagactggcaagtcccataatctgttgtctgcaagctggagaccaaggaaagttgatggtgtagtcccagtccaagtctaaaagtctgagaaccaggtaagccaatggtgaaagttctagtccaagtctagtctaagggcagaaaaagaccaatgtcctagctcaagcagtcggtcagagggagaattctcccttcctctgcctttttgttctattaaggccctcaacagaatggataacgcccacccatactggggagagcaatctgctctactcagtccaccaattcacatgttcatgtcttccagaaacaacctcacatacatacccagaaataatgttggaccaaatatctgggcatcctgtggcccagttcaattgacatataaaattaatgatcacagggtgcagtgcttggcagtgtacatcacagtgaccatgtttattttctccacagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttagaatagaggtaattgtgtggtttgtgtatgggactataacagtaatattaattcccaaaatttctcctactaggaacagtgggtaattgctaagccgtaccatactattctcgacatgttcatttgagcccctcccttagaatgaacaccctccccctgaaggcagcctatccttacattataggaactatgactgtctttccagcctaggagccccaactaagccccatgcccagttagcagctgctgctgtagacagggttgctgtaagcccaggaatatctgggcaaatgcctccctgacagagtgtgagggacatcagtgtgaggctggtcaaaagggcagagatccatccaggtctacagcagtccctttcaaactgccagcatctgacacggtgagctccattttgttcaggttaaagtcagacctggacagcaaaggtctcttaaacacatgggggaatagcctccatggactcttgagattaacttctgcagttcatttttaattcactcatgaatgtaatatctagtcacaaaggtgtaaacagaaaggtaaaagtatataaatgtataagatgatcatttgaacactttccttttaaattccttatcccctaggaattaatgtaatatttgaaataaattctgaaatgattccctagctgatttaacacctggaaacttgcttgtaggttcataagtggcagaaagactgtggccctaaaggagttcatctctcagaatttagaatatagaccctacaccaggaacccataaagagttgccctctggtattcacagacatagtatatgcaccttggaccatttccaaactcaaagatccagacctgctagggattttgggttttgccaaggcattataccgtattaagaggctaacatagtacatcatggtgactatagttaataatgatatgttgcatacgtgaaaattgctgagagagtagattttgtgttctcactacaaaaagaaaggtaagtagctgaggtaatgcatatgttaaataatttgatttagccgttccacaatgtatacatatattaaaacatgctatacaccataaatatatacaatttttacatgtcaactaaatttttactttgtattaaaaaaggctaatggggggtaactgcagctaatgaataaacatccaataggtccagcattcccatgtcaagtgtcctctgcctgtcatcctttatacaataattctaatgaaatgctagatggaatgggacataccactcaagaataccacagatgatcacccttaagatattataagatgggcagagagcacagacttccactcttaactcttgcctggctgatcacaaatcatatcccagcccaggtccagggacctacttgcttccttacaaacgaggagaccctggttctaagacttttgctgagagcagaaataacctcccccatcctcctgctccttaaacaaaagaacctttagggcaattgtctaaaaggaaacaacataccagaaatacaattcctgggttaaag

SEQ ID NO: 13837 - DNA, 15181 bp, Human
aatgctgttctatcctgtgtccctcatgggtttgtttagcccaaagagacactaagcaagattctgaatacctaatcagcctgggccatagccccgtagaaccaagactgctgccaaattcacagcaatggcaagataaactttttgttcatatctctgcatgctatctagtgcattggcaaattgaaaacccattttttcccataagaattccaaagacatcttgctccccaaaagatgttttctaattcatctgtttcagcatttgcttatggcctgatcatgtatctgagtgcaagacaaaacctgtcctattaattcagaaattcttatttgtgtagaactttctaactagttgttgaactctctgtggaagcttacagaattggtgagagctgacatgggagatgagtctggcagggagttgagcagaaactgtttagatctggcagtgtgcccagttaagtgtttccaaaaggaaaatactcttgcacctgctcctcttctgcttcttattttaaaagacaaagtaggtaggtttttttaaaggaaacattgtttttatatattgttatgattatttgagacaggggctcactctgttgcccaggctggagtgcagtggtgtgaccatggctcactgcagcctctacctcctgggctcaagtgagcctcccacctcagcctcctgagtagctgagaccacagacacacaccaccacacccagctttttttttcagtttttttgtagagttggggtctccctatgttgtccaggctggtctacaattcctgggctcaagtgatcctcccgccttgccttccaaaatactgggacttacaggcctgagccaatgcacccggacaacaattttttattttttatttatttatttttttagacggagtctcgctctgtcaccagactggagtacagtggtgtgatctcggctcactgcaacctctgcctcccaggttcaagcaattcccctgcctcagcctctcgagtaggtgggactacaggtgcacaccaccacacccagctaattttttgtattttagtagagagggggtttcaccatgttggccacgatggtctccatctcctgaccttgtcatccgcccaccttggcctcccaaagtgctgggactacaggcatgagccaccgcacccagccaagaatcattatttttaacttgatgactgaaaataataataataatagttaccacttatttgcatgcttctatgtgccaggtagttgctaactatttaaactcaaattccatgaactgtagtggaggttgtactggaatttgattcagaatgacagtgtccatgatggagcaatagagggctctctatttcaaaccatacctccttgcttttacctcctgcctaagtcatcaggggttagaaggctttctaggtattggtctctttccttcattcctaaaccagattggttgcttatttccgtcaagctgaaaccaaaagtaagcaaccaaaaagcaaccagcaaccaaaagccttgttactcaattaattaagagtagatttttatatttgatagtaggttccttctaaatatagaaactgaaaatagagctatctccttcaattctcctttttctgtgtattcatccagaatccagccaccaactgccacaataggcagcaatggactgatgttctttagggaggacgtgaatctcgttccaaatgctggccagtcattgggtttctgcagcactagaaacatctatggttgcaggtctgcagtttatctgttttaaaatagaaacaaagtttcattccccacccccccccgtcagcaggaattccgctagctttagtttcactttcccctttcggtttccctaggtttccaacttgcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgaggtaaggatttctttgctcctctgccataatgtctaaagtttttgaaaaaatggtaattaaatactatttcaacaggttagatctcagtgaggtcaggttttctaattcctcgatttgagtatctgcttatggactgaatgtgtgcatgcatgtgtgtgcacgttcacacatacataaattgtttaatgcatttttatgtttgttagcatgaacttgaggaagcttacctcatgctatagcccaaagaaggggagggaaatgggaaaagagttttgcaggaagggagaaaatgatcccaatctgagagattctttcccatcagattcacttctgtctgatatggggaaggaatggacagcttgtctgagtagaggcattgctttctgcaggttctttaccacagagaaaaagcaggacccacaagaatgtgaaagcctcagtcttgcagcctctctgatgtcttgtgggtaatacagtggagatgtggtaggaaaagctcacagccttcctccataggcttctggtctcactttctgcactgctggcctcttacaacaggttttcgcaatcaggctgagcttaagataaacagattgcctcctccctggaaaatctaggctcttggtacgtccttgactgaagatgatccacatctgcttgggaagatccgtatcttccttacctaaagggcctaatgtgggaatttctcagctgatttaaaaaccattacttaggccgggcaagggggctcatgcttgtaatcccagcactttgggaggccaaggtgagcagatcgcctgaggtcaggagttggagcccatcctggccaacatggtgaaaccccatctctactaaaaatacaaaaatttgggcatggtggcacatgcctgtagtcccagctacttgggaggctgaggcaggagaatcacttgaacctgggaggcgtaagttgcagtgagctgagattgtaccactgcactccagcctgggcaacagagcgagactccgtctcaaaaacaaacaaacaaacaaaaaatccattacttaatactgatttgtaaattttcccctcagtgctccagttggcaaaattttgaagaggtaaaaattccagaaaatgcacattacaggcctatgatgaaccctcctctgtaaacagatggagttggtactgataattaaaataataataatattaaatgttataaaggtagttatcacttcctgaattcgtattaagtgacagcctggcttctaaaagtgttatgtaaattattccatttaattctcaaaagatacttataaggcaggtacttacacagtcatgcatcgtgtaacaatggggatacactctgagaaatgcagctgttaggcaatttcatcattatgcaaacatcaaacctagacggtatagcctactacacacctaggctataaacctgtgcagcatgttactgtactgaatactgtaggcaactgcaatacaatggcaagtatttgtttatctaaacatatttaaacatagagtacagcaaaattgtggcattaaaatcttataggaccaccaccaaatatgtggtcctttgtggactaaaatatcattatgcagtgcatggctgtatgatcctgattttacaataaggaatcttagatttagaaatgttaagatcacacagacaataagtggtagctttgagatatggatcaggatctctacattcaatgatatttcattaaacctttaaatcaatgtttcccaaagggtgtcagtgggggctcatgtgattatttcagatggcaaactcatttgcttttatgttttcctgcttttatgtttatgtcaatatgtactacaggaaaatatatatatatatatatatatataacttgtagaattttattcaggttagcaatgtgattttttattgtgataaaatacatgtaaaataaaatttatcattttaattactttaaagtatacaatttagtagtatttagtatattcatgatactactgtgcaatcatcatcactatctagttcaagaacatttttctcgctatgtggagaaactgcatagccattaagcagtcactccctacttgcctctttccccaggccccagcaactgttaatctgctttctgtctctatggatttgcctattgtgggtatttcatataaatggaaacacatactatgtggttatattgaatttttataattttatatttcctaagcatccctttttgaatattaagttggactttctcattccagaagcagggctcagtcacccttgagacaatttctagttctccacctttttccagttcctcaatgtgattgatccagatatctgctttatataactacctcctggtgaccacttccctatagcatagcagggtatgacctatttgacttgcccccactgaccccacccccaccccacatggaccaggcagatgtgctgcagtgaccacctctcagtcacagcatgaccccttggcaaaattgcacctgcttgctctaaacccaccaaatagaactctccacaggaaacccacctaggtaacgccctggcctcccataaaggcttgggcccacattccccactcgctggttgagcaggcatgtcctcaatggctccccctttcccattggccctgcaaggcatattaccctcttctctctggatctgtaagtaataagctgcttctgttatttcacatactatttttttcaattgcctcctttgtatttcacctgaccaacacactcaaactcttctttactggtcatggctttccgagagagtggctgtctcagtagaaataaactaaacacaggtcaggcaagaaccacaagggcatctgcctgatataaacaagtttcctataaaaggggacacctagacatagatcagacgcttaggcattaggctgttcatcaaaataaagaagtatcccaagaaaggcacattgtaaatatccatgaccaaataccctgaagctctttcaaggcagggctgtagattgtagccactctcacaggagagacctcaagacaaaattaggaaaaaaaaaaatacaacagtgaccttttggatcagtttttttcatttagtgtagtgttgtcaaggtttatccatgttgtgtcatgtatcagtacttcattcctttttatggctacataatattccactttatggatatattacatttttttatctatcagttggtgaacatttgggttgtttccattttttggccattatgaatagtgctgctatcaacatctgtgtgcaagtttttatttgaacacctgtttttaagtatcttaagtatatatccagatgtggaacatccaggaatgtatacccaggaatgtgtcatatggtaatattatgtttaacttattgaggaaccaccacattgttttccacagcagctgcatcattttacattcccaccagcaatgtatgagggtttcaatttctccacatccttattgccttagtcctttttgtgttgctatagaagaataagcaacaatttctaaggctgggcaatttctaaagaaaaaaggtttatttagctcacagttccgcagcccatacaagaagtatggtgctggcatcttctcagcttctggtgagggctttggtgctgtgtcaaaacacactggagaaggtcaaaggggaagcacatacaaagagggtctaaacccagggggcatcctcacattataacaacccattctcaaaggattaatccattcccccaagaaccaatccagtctcacaagaatgagaattcactcactactactagaatggcaccaggtcattcacgagagacctacctctatgatccaaacacatcccactagaccctacctccaaaattgtgacactagagatcaaatttccgtagatttggtggggacaatcaaactgtatccaaaccatagcacttgtcaatacttgttcacctattctccttttctaaaattattattgtagccaacttactgggtgagaagtgatagctcatggttttggttagcatttttctagtagctaatgatgttgagcatcttttcatgtgtttgctagtcctttgtgattcttctttggagaattgtctactcaagtcctttgcccatttttaaattgggttgcttatctttttgttgatgagctgtaaatatacttacatatatttctccatacatgagtaatcacatacatacaaatatataaggatttggttctttataaaatagggtcgtgttttggacacttctttacaattcacttttcttgatatatatgaaagtccatcaaactcaagtagttttgatctaattcatgtagtctagtggctacataatattctatggtatagatatacctttatttaaccgttccctattaatatttccagtttgttgctaatatatacagtgttggtaatgaatattcttgagtatacatccttatgtactggttatttttttctgggagatagattctgaggagtggaattactttgttgaaggaaatgtaattttaatgaccaccattaattttaattttgattttaaaattaaaattttaattttaattactatcaattttcatggctgtcatcagattgatcttgaaggccataataatacatggcttcagaaattgtgtcctcatccatttaaactcttgccaatctgagtggaataaagttataaattattgcttctttaatttgcatttctctaatggctagaggcttagggcatcttttttctttttatagagacagggtcttactatgttgcccagactgatcttaaacttctggcctcaagcaaatctcctgccttggcctcccaaagtgctaagattataggcatgagtcattgtcttgatccagagcattttttttcatatttattggccatttatattggcttttctacaaattatctattcacatagatttccagtggtctgttgaactataccaatttacaaaaacactttgtatattacagatgagagtcttctctgtattacaaacattttccacgtttttgttatttttctatttactttgtttggagtacctttgccataaataaatcacaaattgttttattatggtaaaacatatataacataaaatccaccattttaaccatttttaagtgtacagttctatgacattaaatacattcactttattgtgcaaccatgaccaccatccatctccagaaatttttcatcttcctaaactgaaattctgtactcattaaacaatcatttcctattccctcctcccccagtgtggaggatcagtcagagtgacgggaaaaactatagggaaagaatgcaagccttctgaaaggtcagaaggttctgcagagccctgggggagaacagctgaaggcagctgttctataactctgaggcagagggcaaggagtaggtacaagggagtgtgggggaatgtatcttaaacaggcttgtttatttatgttgaccaggaactgacctttgatcatccacatgcgtgatgttccctgaaaggggaacaataaatgttaattccctacaggttgtgttggctccaggttttcggcattgtgcctgcactgaataaaagtaagcagctccagcttctcggggatgttctctggccactagagccaggcagtcacctagctgctcttacattgcatacctgtgtctgagtactcatttcatccatcagccagggtctgtgggacagacccggcaccctagtccctgttaatcactattttactttctgtctttatgaatgtgcctactctaggtagcttatataaattgaatcatacaatattgtccttttgtgactggcttatttcacttaacataataccttcaaagtttatccatgttgtaacatgtatcagaatgtcttttcttttttaaggctgaatattccattgtatgtatataccacattttgtttatccattcatccatcaatggacacttaagttgctcctaccttttgctatgtgaataatgctgctatgaatatggacaaataaataatctgcttgagtctctgctttcacttctttttgggtataaaaccaaaagtggaattgctggatcaaatggtaattctatggttaatttttctgaggaattaccataccatttttcacagcacttgcccccttttacattcctactagcagtgcacatttctctagattctcaccaataattgttatatcctgctttttttttaaaataatagccaacctaacagacatgaagtggtatctcattgtggtttttatttgcatttcactaatgattagtgatattgagcatctttgcatatgtttattggccatttgtatattttcttttgggaaatgtctatttaagtcctttgcccatttcttaatcagttgtttgttttttgttgctgagttgtagaggttctttatctattctgtatattaatcccctatcaggtacaagatttgcaaatattttccttcattctgtgatttgtcttatcactctgttgatagtatccttccatgcataaaagtttttaattttggtggagtccagcttaattatttttactgttattgcctgtgattttggtatcatatctaatgaatcactgccaattgccaaatccaatgttacaaagctttttcctttcttctgagttttataattttagggcttacatttaggtctttcatccattttgagttaatttttgtatatggcataaagtaagggtccaactttaccctttttcatcatatatccagctttcccacaccatttgttgaaaagaccatcctttccccattagatggtcttgtcattcttattgaaaatcattccaccattgttatggaatgaattgtgcacttcccacccacccctgcccaaaattcttaagttgaagccttaaccctcttatgttgaactgttgtttggagatagagtctaaaaagaggtaataaaggttaaataaaatcgtaagagtgaggccttaatccaacagagctggtgtccttagacaccaaagctcactctctctctctctgtgccactgaggaaaggccacttaaggatgcagcaagaaggagccatctgcaatccaggaagaaattccttgccaggaaccaaattggttgtcaccttcatctaggacttctagcctcgagaactgtaagaaaataaatttctgttgtttaagacacccactctgttatattgagttatgacattctgagctaactaatacagtcagataagtaagggtttttttcagggctttctattctatttcactggtctatacatctgtctttataccattgttgtaatattgtgattactgtagctgtgtagtaagttttgaaatcagaatgtgtgagacatccaactttgttcttctttttcaagattgctttgactatttgagatcccttgacatttcatatgaattttaggttgaatttttctatttctgcaaaaaatgtcattgggatttttattaggattgcattgaatttgtagatcactttgggtagtattgacatcttaatattatgtcttctaatccacgaacaaaggatgtccttccatttatttattgcttctttaatttctttcagcagtcttatagtttccagtgtacaagtcttttgcctcctaggttaagtttattgctaaatattatattctttttgatgctatttttgtaaatgggattgttttcttaatttccttttgggatttttaaattgttactatatagaaatatgactgatttttcatgtagattttgtatcctgcaattttgctgaatgtatttgttaatgtgtagaatccttagaattttctacatataaaattatgccatttgtgaacagagataatcttacttcttcctttccaacttggatgtcttgtatttctttttcattcctaattgctctgactagaatttccagtaccatgttgaatagaagtggtgaaaggagcatcttacctcattcctgatcgtggaggaaaagctttccctttttcaccattgaatatgatactagctataggtttttcatatatggctttaattgtgctgagatagttcccctgtattagtagtctatagtctgttttttttttcataaagggtgttgaattttgtcaaatgcttttcctgcatcaattgagatggtcatgtatttattcccttcattctgttaatgtggtatattacattgattaatttttgtatattgaactatccttttatatgaaagtctccatttagatgactttttttttttttttgagactgagtttctctctgttacctaggccagagtgcagtggcgcgatctcagctcactgcaacctctgcctctcagactcaagcgattctcctgcctcagcctcccaagtagctgggactacaggcatgcaccaccatgcccacctaattttttttttgtatttttagtagagacaggatttcaccatgttggtcagctggtctcaaactcctgacctcaaatgatccacctgcctcggcctcccaaagttctgggattacaggtgtgagccaccgcacccagcctatatgacattcttgaaatgacaaaattacagagatgaagaacaaattagtggttaccaagggttaggggagtacaggtgaggaggtgacagatgtgaccataaaggggtaatatgagggagatgtggtagtgaagaggagtttcgtttctttatcaaagtggtggtctcataggcttacgtgaaaaaaatgacatagcactatacaaaagcattgttgtaccaatgtcaattttctagttttgagctactgtattatagttgtgtaagatataatcattggagaaagtgggtgaaggatacactggatctctgtactgtctttgcaactttccgtgaatctgtaattatttccaagtaaaaaaaaaatgaaaaaaaaaaacccgggtcaaatattatctgtttcatgtggtcttaatttgttgcattacatgcagagtaaggtcctgaagtcaatgtttcctaaggttctgcatttctaactgacctctgtcctaattatcttaatattaaaataagaaactcttatatagcatataatatgctctaagtgcttgacacatataagtttattaatcctcaccaaacccagtgtgataaatactatcattatctccattctacaaataggactcataagtacagaatagttacttggctggaaattgctctagccagcatatgaagccaagcaaacaatatcaacagtccatgaataacttaaaaatacattaactttaatgaaacctaagtaagttgatcctttcaaggataagcactaaaatacaaggtattttatctgacttttttcttttagctgttcctcacctaacaaagaaaatctgtttttgtttttacagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaaaaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacattggacttacactaaatgtttaattcattcattttattgtgaaataaaaataaaatccttagctcctccaccaactgaacagaccctcttggccaaggagaccccagaaaccttaaaaactaagtttcccaaccatgacaagatgagagatcattcacacctcattatattccctcccttgctaactgccattggactttttccactgagttaaacagaaacccatggaaaacaaagaacagaagactcactccttggctgacttcacctagctcactccacgtagcgccacagccagactcccctcccctcttgcggtttccacatgacaactgatcagccttccctcctgataagtgaccactgcccacagactggttctggccagtccatggaggctgcacacagggtgcctctatgtcctttgtttcaccttttgatatagaaaggctaattttgctgtattttaatgttaagtctccaccacagagtgaacacagaatgcatgtgacatacatgtttacataccactattgtgtgactgcccctcatgaatattcatagccccccataacctgttaactatgtgtgtctagccaatccaccaaccataaaacttctgtaataccctcccttcctccaagagcctgcttttggttgctgtggtaggctctgcttcccaggctgcaggttgcaggagaggaggctgcagtggctcacgcctgtaatctcagcacttcgatgggacgaggcaggcagatcacctgaacccaggagttcgagagcagccttggcaatggcaaaaccaaccgtctctacaaaaaatgcaaaaacttagctgggtgtggtggcatgcacctgtagcttcagttccagctactcaggaggctgaggtgagtggactgctggagccagggagttcgaggctgcagtgtcgagatcttgccactgcactccattctggatgatagaacgagaccccatctcaaaaaaaaaaaaagttctctccaattgtatatagcttgtgattttatgtcaacactatcaataaatagctttcagtgcaagaaaccaaaaatactgtaataaacaggcacatattcttcccaaacctcatgcagtttacaatctagtgagagacacagatagcagtacagagtcaattaaaggttagttttcttcatgaagatgttttaattttaattcaatgtgaaagggttccaaggagtttatcttgttttatgccattttatttgaagcactacttactaagtcatttgctgatattaatctagttaaatcaagaaatattacatgaaaatgttgctaaatcagagatcatgggtaacaatcacctttgattatgaataatcatattttattgaaaggcaaggcacaacaaataataagaaggaaaaaataaataagcaatgttattgatctttcattctgtatatgttttggggggaatatactagtttcttttagtggctgtaacaaattaccacaaacttggtgacttaaaatttcacagatttactctttcttacagttctggaggtcagaagtctgaaatgggtttcaatgagccaaagtcaaggtattgatgacgctacactcctccggaggctctaggcagatagccttttccagcttccagaggctgcctgaattctttcatccatcttaaaaaccaacagtgtagtagcctcaaatctctctctctgcttccttcttcacatctccttctctcctctgactcttttgcctctttcttctaaggacgcaccaggtccacctgcataatccagaataattgccccatccgcaaatccttaatttaataacatctgcaaagtcccttttgctatgtaaagtagca

SEQ ID NO: 13838 - DNA, 5670 bp, Human
aatgtcagtattccatcagtggcagttagtggacacacaccagttaggagattctgaattacaaattggcctattatatgtatctatatcttatatattacatattatgaattggcatattatatatatcatatgtatgcatatataccatatatgatcttagttttaggcccatatattggtccatatttttgtagtacttgttctttcctcataatagatggcgttatatcttttatttctctttacataatcttacttgattttaatttcaaatttctcagttattctttaggtaacgtgtggagtacaaatttaaaataccatgcatattacttggtgtgtttgctgtgtgctaggacctatgattttactgctgtaaacccacagcaataataataatcctacttcttggcagggtgaggaagccagcttttttgaggattggataaaatcaattcagataaaacatttagccaatgcgtggcacctagtaggtgggctttacacggtagacttattatttttccatttaatactccaatttccctttgtggggaatcggggggataagaaaatgcaagcttcaaggagtaaagggctggacacaaccacatagatacaagacactaagcaagaattaggagtgctccctggcttcaaagctggtgtctaaaacgtctatcccctaaggggcccttgtatcgtgtcatgtgtcagaccccgggttgaacgcgaggatttttgtgctgttcccagggtctctcaagagctctcctagtaccgacctccttgtgctcggtggcccctggcccgaggaccccagatgggtggcggagaaacgcaggggatagagactagccccctagccgggctccgtgggcccggagtggattcaaggaccggtggcagagggcgactgcaagttggccccgcaaagccaacaaggggaagggtagggtagtgacgacatcacctggtccttcaatagcctcccgggaggcttcaggaactcacatctctttcccttgacgaacaacgcaggtggtttgctgaattaagtgttcccgccccaaattgagatacaacgggctttttagccagattggcgcagactgggagttaaatccagcattttcccggcaaagctgagcctggccgccgcggagccctctttccgctgtgcggtgcctccggctccgatcgcgggcccggcgccccgggacgcgccgccgagggtagctacgcggccgggctgcggcctctcccggagagcctgcgtgcgtggtctctctagcttgctgcccgccggccaggaaaactctggggacaagctggagctggcggaggttcccatccggccacccttcccgtctgatttcctgagctgacggtcaccgccggcgttcggggaccagcggttccctgtgcaaagggctcgtttctcgatcgccgctggatagaccgcaaccgggttctcagaaaacacccgagctacagaccgcatgtagctttaaacagtttttaaaatgcgattatgcttgcgtctttatgaaagcacatggatgcagttatacgtatgcattaaaaaacacaaacaattctgcattgattgcaaaggagcgctttctggtggcaatgtaaacggtctagtttgagacccgtgatgacacacgtgaactgagttgccaaactcatagaaactccacacggtagatctgtacattgtgtcccgtgttaattgtacgtcaactgaaaaatcagaacttacatgaaaagtacgaagtgccactgcatacacgcatatctaaaagccggtaagatgcggctatagatgagcacatttacagcaatgaagggccactctgccgggttgctagcttattcaagcttcgcatcgccgggaaagggatggaaaggcagctgacatcactcggggcggggccgtgagtcctgtgaaaagtcgatgggactcgagcagcagcctcagctgccttgcacagcctcgcaatgagctgccacaactgctccgacccccaggtcctttgcagctccgggcagctgttcctgcagcccctctgggaccacctgaggagctgggaggccctcctacagtcgcccttcttcccggtcatcttctccatcaccacatacgtgggcttttgcctgcccttcgtggtcctggatatcctgtgctcctgggtgcccgccctgcggcgctacaagatccaccctgacttctcgccatccgcgcagcagctgctaccttgcctggggcagaccctctaccagcatgtgatgtttgtgttccccgtgacgctgctgcattgggcccgcagcccggccctcctgccccacgaagctcccgagctgctcctgctgctgcaccacatcctgttctgcctgctactcttcgacatggagttcttcgtgtggcacctgctgcaccacaaggtgccctggctgtaccgcaccttccacaaggtgcaccaccagaactcgtcctcgttcgcgctggcaacgcagtatatgagcgtctgggaactgttttctttgggcttcttcgacatgatgaacgtcacactgctcgggtgccacccgctcaccaccctgaccttccacgtggtcaacatctggctttccgtggaggaccactccggctacaacttcccttggtccactcacagactggtgcccttcgggtggtacgggggtgtggtgcaccacgacctgcatcactctcactttaactgcaacttcgctccgtactttacacactgggacaaaatactgggaacgctgcggactgcatctgtcccagcgcggtgatgtggctgcggtgggtgcccctaagactcgggactgctgtgcctttcacacttgaatgaagagaaacacctgagctatatatttttttaaagcaactaacttattgctttatgtttatctatgaaaaccatagataaaatctgatgcatttttgtaatctgacaaagtaatttacatactgtttgtgtatcaatacaattttgtgttcttggtattcttagtctagctcacctcaatagccttgaatcctgcatatgaattagacattcatcactggcatatttagaatatctctaaaaggacttgtttgtagaataaggaattttctatgtttcaaagtgttctaaaacctggctaaaagaatgtatttttgtggatggtgttgacttctgactctaaaagcaatcaaacatgtttctgctggacagtgaccaagaattatagtaccttcttatatttttttatagaactgtatatttattttgaaagaaatgttattcgtgctttaaaaaggaaaaaaaaccatgaatcaaataagtattgacttccgtttcactggtattttgactgataaaaaagggaagagggagcgggcataccaagtgtccttctaagcctccatcagcctcaccatggaaagagaggaatctgggtgtagggtgttctgttgggggttgttagagaaaaggaggcaggagaaggggctctgtttgttgtgctctagcaatttcatggaggaaaaacacgctaatattcttaatgcttttcagctgatttctgtataacaggcaaatgataggattactctgtaaagtttcatagaaagattaacgctgagcagtcaatcattttattatttgtgggaatggattaggggaagaacagaattggaggcgtgccttgctttgcaaaactggtgagtcaatagtatacactagagtggctgatagatgtgcaaggggattctgaggaagcccctgttttcatgaatccatccatagctactgcaaatgaacatcaaagcattgcttctgaaatctggaatttctgtatattcagttttcttaattaaaacatacatgcagcaggtacagccctttctaaaagaaagataaagtgaaatttggccctggatcccctgattcctcatgtggaaaaggaggaggtgtcccagatgttcttgcagatgacagtaaatattcctattattaaccacacacccatcacccatcactcaccccatctaactcctgcctattcattttagttttgtttttggaatatatatagtgtagagttaaaaatcaagacaatttagacacaatataaagaatggcagctttgtgtgtaattcttggctcattatatttgaaccaaactgtcatgtttaaaggtaaagcatccatttagagacctggtctccacggtctgccaaatgagactcccaagaaatatggttaggccctccaaatgtttggcagaatgccccagaatgtggaagctcacagccagttttcccatgttcccttcaacgtgtgtgttcctttagcttcttgactgaagttacctcctcctctgtctgtatcaggaccaggctgggatttaaagatgatattgatttataaaagtgaaatccatgaaaagaggaagtgagatgtgaggagaaaatgctacattgacggtagtatattattatcatgatgcacgtggcacctggagtaagaagagacggataaacaggcaggtgtggaatctatggtgcaactatgagttgtaagcagctgtaggcactccaaagctgccctgtaaatcatggataataacaatttatcacagcgtatcctcagagaattgtaaaaatgtatcatgttgcatcactgcataaggtaattttagattttgggcaaattatacacatggaaagtgcacaatttggatttagaaatactttcttacaatcgaatgtcttaacagtttttaatgccttgggaggtagaaccgcggaagtggaaaggatgagcaatttttcagatagcttgagaacctgttaataaaaatagtaaagaaaaagttcatatgcgcatgcgctgtcacacaatttctcacttgctccttacaacaacaccatagggatgtagaatagttactattatcatcatcacctctgttatggatagaggattggtacccacacaggttaagtacttttttccagattacaaaataggaggagtgggagccagttctactaaacttaggtctggtggtgtatactgtgcttctcttctgataactgccagagagctgcaaaccctgcaacaccaacaaatggcctccctctgttgttcctcctttgttactacccctaaaacagtgttaccctggcccactacttcacttccacatggctgccaaagcctctgcctgggtaggggagaaagccaggggaggtagagcaaggccagtctaagcaagccctgggagagcaggaggcaggtcaaggactgttttctgcatccttcattgcacctgtgctacaaacgcaactattgcagccagattacctgggtgggaatctgggttctgggacttactagctgagtggctttggataaggtacttaacctctctgccttagcttccttatctgttgatcatagactgttccttgctgagttgttgtgagggatttttgagttactagacgcaaagtgctagatgaatccgaaatcctggctgtagtcgtgtttgctgtgactgatgcttcccagtgtgagtgctaggactgcagttcagaatggtcaaagctttttgttcacaaacatgcttgtgctcgctcat

SEQ ID NO: 13839 - DNA, 7325 bp, Human
  misc_feature (1)...(7325): n = A,T,C or G
gcacctgtggtttcaatgccacagagcaagtttacaaaggcggggtgaaagtagggagcgtgccaagcgggcagcagaccagccccccgccgctccttgtggcgcgctcccggcgaggccccgggcctgaaatgtccccgcgcgcagagcctcctgccaggcgacccagctgttagccacctctcgagcggcctggagtgctcgggccaggcgtccccggggttttcggtgtccgctgggagctgctcagatcccggggaagtcggtggcctacgcagaaagactggagcgctgggttgcctcccattcctgacccggctgagggcgccctgaccccgcggcccgggcccgcgtccgagccacgctggacgcccggctcccgggagcgccgcggtcggccaggactagaagccgcggcgccgaggtctcgggagaagcgcggcaggatggcaggccgggcccacgggcacgttcggcggctgcctgagccggcagcagctcagggagcgcgaggactgaggggcgggcccggcagcggggcgggggcgcgggactgactaggccgcggcggccaatcgcggcgccgggagggcgggcggggcgggagccgccgttaaaggggcggtttgaccgggggggcccggcctcgagctggagggagggagggaggccggggcgggagactagggggtgcggggggaggggagaggaaaaggaggagacaaaaaataaaaaataaaaggctgccgctgcagcgttggcggcgcccatcgaaatcaacggaggcggtggcgaacgcagcccaccgcagccgagacctgggagcccgcctgggcctcacactccctcgggtcgcggactgcgctgggtccacgcggcgcggtcactagttccgggcccagcgcccaggcccgaccggcgggagggaggaggcgagcgagagatcacttttttattgttgttattgtttttcagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctcctcctcctcctccggggccgccgcctcctcctcctcttcctctccgggccttcgctacgcgcccggccgcccgaggcagatccaggcggcggcggaggcggcgggcgcaggagagcggctcccagggctgaagtggccgccaccaccgccgcctgcgcctggagcccggtggccgccggacgcaccgcgcggatcgggagcgggagtcgaggcggcgcggaggcgcagggctcgcaggggcgggcgggcgcgctggccatgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggtaaccgcgggctgggacagggaccaggcgcggaggggagacacgcacaggctgagactcaggctgtgggtgccgacgctgggcgcagaccgccagccggggacctgggatgggaggtgtttttgcgtgtacgaaagagccagcagcttgtttctgttggacgatgacaatattattgggctaggtttttccatgtgcggaaatcgagttttgaatgattagcctcacatcaaatgtatgcttgggtcatgcaattgcttcgtttgctcagccccggttaataatttccgttttaagtagaaagcacaaaataaaactgctcgctaattcggtgcccgggaagcgagcctagagaggattttgccagcttgtctgaatgtgcttttctgctcggagtgtatgtctgtctgagtggtttgtgtgttttcccacttcttttactcggggtccaaacgcccttcccgggactgtttcccatgaaatgagtctggtgtgagccgaagctgtaatgcgtttctcatttttaaagtgtttttaaagcccgtctcggggtgggtcgcgggggctttactgtggtttcgcagcagtttgtgaaattctctaatgggcaccacagagtttgcgattcccaacttggacccaggtcagctagagccccaggtcagctagagccccaggcagcgcggccccgcggggggatcgcgtgagaagagagagccgcaaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaagtggaacgacgtttgagttctcgcacctctaaatgactccaagcatttggaattctggcaacaggatgcagagacagccagaaaattaaacggggaggttttgaaaggctttgctgactcccccaaccctcgcccaccagcttgtgcctctccgcagtcactagatgctgccttatctctaatatttaccttttcttcaacttatttttttaaagacgggaggtgagactagaattgtggttaattcaatttgcagaattttggatgaaaaatactggctcagtcactctccacagcccggcccccaaacaacacgtagcaactccaaatgtaattgcttactggccctggcgagaaaccgacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtaccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacatactattttttctagcaaagttattaaagaaaatgggggaagaggcagctgaggattgacctgggtacgcctcagcgagcctgagtgggcgggaggcacacgcgttctggggaggaaggtgtgtgtctgcatagaaaccaagccaaagtgcccgtttggcagaaggtctcaaaattattttcttcggcctttgtttaatagctgagagtgaattaaatttttggaaagcccctgtgaggaatggcggcaggaaccttcagagcttctaatggctccattatctgagggaatgcctttctttctttcagctatttgggctggatttaagagcactaaacatttccttattctttgttttccccctttcctgccccctttcctctccctccctctgaaaagctgaggtacagttatttttaattacacatttaaaactgtgcagagtactttctttttgaacttggcctaatgattatagttttaagggcccgtttgtaccaaaagttgcttgaaattttaagcagagaaaccttgctgaagcaaagcagctgtgtcccaacaagcaggatggtcaagggaaggtgataaataggctata

SEQ ID NO: 13840 - DNA, 276687 bp, Human
  misc_feature (1)...(276687): n = A,T,C or G
gcattgataaaatatttttttgagaggatgggggtaaggatctattaagttgttgtaaacagggttttgcaggtataccagtttcaaatttttagattgcgctttttcactcccgtaaaacaggctaattcttctctactgatttcattctgattattttatgcttgttattgtgaatgagacaaataccattcttgccattctcatgcaggattaaaactcgtgcataatctcttgcagaatcaagaatcaaagcatgcacaatcttctatgctttgtccccatctatgttttctattgtgttttcccctaccatcctgcagataactctgtacttcaactgaattgtttcagtcattccttaaacttgtcctataatctccacctctgttttccccactattcctgcctgaaatgttcaagtcctgctcattcttcatagcatcatttaaatagccctttcttttttttcttctttggaaacggagtcttgcgctggagtgcagtggcgtaatcttggctcactgcaatctccgcctcccaggttcaagcgattctcttgcctcagcctctgagtagctgggactacagacgcacaccaccacacccagctaagttttgtatttttagtagagacggagtttcaccatgttggccaggatggtcttaatctcctgacctcgtaattcgcccacctcagcctcccaaagtgctgggattacagacatgagccactgtgcccagcctaaatggcccttctgataatacacttttcttaattatttttctctctacctccctgtgatcctttctgttttgaattgccagtgatagaactatttgggtcctttgcttttctcttcttggatttgaaggctcccagtgtaagagcatgttctttatctgtcttctcagtgcactgagcattgtttcaaaaataccagcccatataaacatcatgaacagaaaaaaattttaattgaattaattataaaacgcttaggaagcaggtgccattttaactaagttgaagttaaagagtgatgttttgtggtttggggttcaaaaggtctatgacatttggccttctcttcccttttcctctaaggatcctatagcttgagttgagtgccagtagagcattacaggccaggaaggatcctgtaagggctcactgagctcttttttcttcagaaaagatcataaacaaatggtcccaaacataggagtatctctaccttgtttttagaaaacatctaaagaaggagacttgtacacttttcttgataaatcgttgtaaatgactcttgctgtcagaagttttactgtataataactaaatacttaatcatgtaactgatgacaattttatgagtttaaaactttagctggaagtgtgctttgttttgaccttactttgtattttcataacaccctgttaatgtacggaacagtggaatagcttctccattgataccagtgagccctggagcttctgctccagcccatagcatcgtagccaggtttggattttccccaataccatcatgtcacttcttgctaataaaagctgtaggggttgtctgtgactcttcagatgaaaataccttaagtacctgaaaatcaccatttttgaaaaaagggaatttgttatgcatgcaaacctcagttttggagatgtttcctggtgctattataagttgtttcttatatctttgattacttaatactgtacttctgtttttggaatccactgttaatttatgtgtgttttcttagcttttattactggggaaagtgttatgtttattggtacaagtaccctttttttcttttaaaatggtcacactctcattttttaaatacatcattacactggtgttactttcctggtgttattttcctgactctaaagaaaggaacttttaaataaattaattattgttttctgcgttattgaacatgtggtcaattgtcatgttcatacatcccaatgatcaaagtctgaacttctgtctaattcttccctgctgttaggctaccctgtcatgatcaaggcctcagcaggtggtggtgggaaaggcatgcgcattgcttgggatgatgaagagaccaggtgagaggctgtccaaaatatacttttgatgaaaattgcagttaccagagttttattaaactgacaggtaaacagataccaaaagcataatggagtaattacagtaaccatctaatttttacacttttgaatgggaaaaagattgaaattatgtggaaaccttccttatttatattttgatgatgattatcttattatagaaagggttttactgttttaaacattaacaaaggattttctttttgtttttaccgtatatttttaaaaattacagtcaggattctattttctgggcataaattactaacatttggctatataattctaaatgtcatctaaagatttaaatcaactatatttaaaagcagttataatttcattgagacttaatgtattacctcaatatgtagttgctttcctttgctagtgcataaaagtagtgaattactttgataattttagagtgtgaaatatattctttttccttgagtttgaaattactgtgtcctttatatggaatgcgctcttattataatttagaatactttttatggcccaatctcagaagttacacaggtttccctccagtgaacacagcttctgctcaaattcaaggggaggggactgagtcttcacttcttcatgagagcgtgggcaagattcttagaagagcacgtggaatgggagatattgttgtggccatctttggaaaagacaatctgccacagcccgttttgtgggaaagaatggtatcataaagaagtcgaatacaacttaatggttttgcaagagatgtgtattttgtggacttcaatttttttctcattgtttttctgttttgcacagtacttacatagcaatttcactgaacgcttagcgcttatttttcattattcatcttaggatctcaggtttcttatcagtcatttctccagggctactgttagtaacttactcttttatggtgcggattactctttatagtttcttggaagtgaggtttgctgtgctgctgttgatttataaattttaatttacagcttaatattttgagaaatcactatatccattcatatattaggcatcattttgtaaataatttagccctttcttgccaagtaaatagcacattgattcaaaatatgtttataaaattaataaaaatacatgaataattttctacttaaaatattactctcttcagcttgataaataaaccatctcagaaaacttgttgagatcaacacaggcgtgcctattagatttaataatacaagctcctcattttaagaagttgctctatgtcccttatttatttgggaaagtcaaaactacctaaaaagggaaagaacagtactgcaaacatgcctatgcttgtcttttggagccactaaccgtgaacaccataccacaacttatccaccccttcttttcctctctccctctcgaggaagtaattggtttttacataatccacaaagatttcatttttcaggtacaaaggaaaatttggtagcttaattactttattcctttatcctaaggggtgtctttttcttgtaacatctttcctatgttttttggggggaagtagcatctatgacttgtcttggaatctgtaggacatctgaaagattttttttaaaaatgtaatggttttttttttttttttttttttgagacagagtctctctctgtcgcccaggctggagtgaagtagcacgatcttggctcactgcaatatccgcctcctgggttcaagtgattctcctgcctcagcctcccgagtagctgggactacagctgcacgccaccacacccagctaatttttgtatttttagtagagacggggtttcaccatgttggccaggatggtctcgatctcttgacatcatgatctgcctgcctcggcctcccaaagtgctgggattacaggcgtgcaccactgcgcccaacctttattatatagtaaatttgggtgagaattatgaagattgttgaaggttcacttagatattttcatagtaatctctggctctcttttccctattcaagtttaaatgaagcgtatggcatgattgggaaactgattgtgtctatatttttgaatatccccactaagacttttggcattgtgagtgcaatttctgttttatttttgtattcctagcatctaaaatatatccaggcacaaagttcagtaaatacttattgaatgaatgtataattgaatgtcaccaatgatattcataatagagtttcccatgagttctaaaataggttgttggcgatgctttcaaacttgctgcttattttattttggtgactttgactttttacttgtggtgttctgggtttaaatgcaaaatgaaagatctcaatcattatagtggaggcaaactgtaaagtgctatattttttctttctgttattatatccaatctaataaaaagttgattatatggtatcgaaaactaattcattttgcttccagtttctttgaagtttgcagcctcctaagattcccctaaatcaacaatgtaatggaggactttattcccctaaatcaacaatgtgatggaggactgagaaaacctaataccttttctctgagacctctgagaaatgagttttttgcaatgttttgaaatttgtcttctagtcagttttacctgcagtgttgtacaaaaacaagcaaattagttgtgtgtgtgtgtgtgtgtttttttttttttttttgagatggagtctcgctctgttgtccaggctggagtgcagtggtgcgatctcggctcactgcaacctctgccttttgggttcaagcgattctcctgcctcagcctcccaagtagctgggactacaggcgcacactgccacgcctggctaattttttgtattttagtagagacagggtttcaccgtgttgcccaggctggtctctaactcctgagctcaggcaatccacccgcctcagcctcccaaagtgcttggattacaggtgtgagccactgcacttggccacaaattagttgtttccaatattactaggtggactgtaggattaaatgatattattttaaagttgtaataattaaaacgcatcttaagtgtaccaacctggattactatatgacaaggattatcattaaatttttctattagtagtctgtcatcgccaaaactagaagcagcttttgagatgaaaaaccatcctttaaaaaaaaaaaaaaggaagaacggtcagactaacaaaacaaatagagcaatagggctgacatcattaaagaaaacacaaaacaagcaaatcagatagttgttttttatattactagatggaccatttgcaacttaaaggactggaagaatttggtttcagtattgtacattaaatacagacatttagtcttcagattaagaaactttattaaatataaaaggaattaaagcacaaaaataagcaaattggatagttatttctaatattagtagatggaccatttgcctctgaaaggatcggaagaattggctttaatgttgtacattaaatacaggtatttaatcttcagattaagaaactttattaaatgtaaaggaattaaattttatatgctgattatatcaatggatagaaggcaatatatgctcaattacttttaggcaagcaagtttgggttttttttttaattgttttttcttttcttttttttttgagatggagtctcactctcacccaggctgtagtgcagtgacataatttctgcccaccgtagcctctgcttcccaggttcaagcggttctcctgcttcagtctcctgagtagctgggactacaggcatgggccaccacaaccagctaatttttgtatttttagtactgatgggatttcatcatgttggccaggctggtctcgaacttctgacctcaggtaagccactgtgcccacccaagtttgcgttttgaaaagattggtcaaatgagccctaaatatttgaataataggcatattttaatagtaatgatttaaattagtttgtaaacaaaatatataaagcaataattaggtccatatttttattttaaaaaactatacttttataattactatttttgatcaattttatagaagataaaattgtaatgatctgtgtgggtgtatgtgggaggcaactgcatttcaagatgtggatttaaaatattaagcagtgttcttaagaatcttcctgttggatgttcaatctcaatgagtgtatttgctgtagttccactccagtcatgcaggtgactagaccctttacatttttctttgcatcttctgacttctgaatcaaacagatgtttttttatatttttgctagtggaattaaggtatattatggttgaagaaatggaattaattttacttgctctgtatggtttattaaaatatcatatttaggctgggcactgtggctcacacctgtaatcccagcactttgggatgctgaggtgggtggatcacctgaggtcaggagttcgagaccagcctggccaacatagtgaaaccccgtctctactaaaaatacaaaaattagccaagtgtggtagcacgcgcctgtaatcccagctacttgagaggctgaggcaggagaatcacttgaacacaggagatggaggttgcagtgagctgagatcacgccactgcactctagcctgggtgacagagtgagactctctctcaaaaataaataaataaataaataaaataaaaaaggaggtatgaaaattctgggaaatgaatgcatggtaaaaatgaaagttaagtgaagtgttaatcgtaggagaagtgaagtattttatgtattttaggtctttattctgatttctgaatacagctgtctgaatgaatgtccgaattaattaatagtataaaacctgctagacacaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaattgaagacaatttctatacacacacatctaattgtgtaacaaccatccaggtctagatagagaatgtcccatcacaccacttcctagtcagtccctacctgtggccgccaaaagtaactgctgttcctatctgatgtcagagattagttcttaaattgcataaatgaaatccagtgatatagtctgtcacgtcttctttttcacacatcatcatatctttgagattcttccctgaggctctgttgtcctttgcttctaagaattgctctgtgatctcccattatttgactcacctgcagtttatccatattgttgttgatggatctttgggtttttagtttctttatattagaaataaattgctgtgtctttttatgaacatatatacatctctaggatagactgaggagaggtattgttggattacatagtaaggttatttttagttttagtgggtactctggttgtgctaatgtatactcccaccagaaatacatgagagtttccattgatgccacccctgccaacgtgtgatattttcaatttttgaaaacatttaaccatattagtggacttacgatggtatgtctgtttaatttgcatttcctggatgagtaatgatgttaagcatctgtttataagtttattgaccatttgaatggcttattttgtgaagtgacttctcaaactttcatccttgccttcctttttcaaattagatttttaaaaattactggagtgtccgagttctgtatcaattttgtttatgagtcctttgtcagatgtatgtatagtgtatccttctcccttcatgcggcttgcctgttcactttgataataatgtctttcaaagaacagaagttctgaattatagtgaagtcaagtttaagtctactttgtgtaccctagttaggagtttttttgttttaggtatgatatttaagtctgttactctcctttacttattattattttgtttgtttgatgtgaggcagggtcagagtaatttttaaaattctgatatccactttttccagcatcatttattgcagtgaccttttgttgcatattaagtgagacttcgtcattgtcttaactattttgcttttataataaatctagaaacctgattctgtaagtgatctaaatgtattgtttttctgcagatagttttcattctctttaggttctttgaatttccgtgaaaagtttagacttcacctgtcaacctgttccccctacggacacctacgcctacacccacccactcccacctctacctccactcccacacaccccatctgatgggagatttgtatttgggtcgtattgaatctagagattattctggggagaattgacatcttaacaatgttgaattttctttcttccctctctccctccctccttcgctccctccctccttctttctgacagaattttactctctctcccaggctagaattctggatattttgtgaaggtagaccagattttctaatagatggatgttatgtacaagaaaaaaaaaataaggtgattttagggttttggcctaagaaatgagaagaatggagtgggcttttactgagataggaaagactgtgagatgtgcttgtttttgagggaggaaatcaggttataaagttggataaatcaaggttgaaatgcccattagatatctaagtgtagatgttgagtagacagttggctatttaaatctgtaatttaagggagatatttagattgtccttcttgtaagatcgtaggggcagaattaattttgtccttcactgtattccccatctagcacttgttcacactactggaagaccacttaggtaggctgttttatctttaactagttgaatttcgtaacaggccatgaggtccttaagggtagagagtaggtcttactcatttgctgtccccagcaaccagaccattgtctttgacattactaatactcaataaatgtttgttattttgtgttaaataattacatacctagatcagctttttagtttattttatttagccatggcatacagcctgggtgatatttttaaacataagtgaaaatgcctcccagttaataggccacacagatgttctcatatctcatctatacttagaagggtttttaatttacttttctttagttttcacttatttatattaagtaatttatgcacatgataaagggtaattaataaaaagtaagcatcccttttactctattctaagtcctctagtttctgtccctaaatgcaggcaccgttactgtttcttggctattcctccatacatagtctaagaagtatatgtgtgtatgtcacctattatttttcacatgagccattatatactatgtcctttccacaatgaaactgcactggtagtgtgaatggcacctctctttgtggcataaaccagtatttctcaaccagggcactactggcatttcctgggttgggtctagggataccaacaggcttgcattatgtgacattgtctattataataaagctttttcaggaagcagtatagcttagagatttttctacattcagtacgtgtaaacctataaaatttttaaaaaactcatgatgcatttaaggattaacttcccttaaaagcagtatttatttataatgttttctgattacatggcttcctcatttatttaatggaataaataatcagcaaatcatttttgttgaatgcctagtaagtgcacagaatttttaaaaaatgaactgggagactatacagaatttagagaagaacaaactcttgattctgtatatgaatctgatattttatagttggaaatatttctgagaattcttggttattttggctttatttcttggagactgtctacttttactttcttgtcaactagaatttaaaaagaggttgagagttattttaatgatttcaaatatttttagatttacttcatgcagccacctttgagtcttagaaaattccagcttattggcattttattgctgttatgttttccttcattgcttggaatcattcttgagtttcagaaagggtttgttcctaaaaattaactttacagtcatatnnnnnnnnnnnnnnnnnnnnnnnnnnnnnnnnnnnnnnnnnnnnnnntcaaatattaagattgatattatctgctatttataatgcacaaagtaaacagaatgacttgttcagagaagttgcatagctgtttggaactaaaattagtgcctggtctttgggcttctaaaacagatcttacctctgtaaacctaatatatgtattcagaaatataaatcaacaccttaaatctgaaaatagattggtccgtttctgaaaatcagatgttctaggcaaaaactttaatgaagagctgcttttgagtttccagatttagctgaaaaagatacatgttaaatttgaatttcagattaacaatgattttttaaaatcactgttccatgtagtacttgggacatagctagaaaaaaattattcattgtttatctgaaatttaaatgtagctggatatcttgtattttatctggcaatctcagcttattttccattacaggttgaatgtatctcttaactgaaatgcttgggaccagaagtgtttcagatttcagatttttttgggttttggaatatttgcatttatacctgctggttgggtatccctaatctgaaaattcgaaatgctccagtgactgtttcctttgagcgtgatgtcaaaaaatttcagcttttggagcattttggatttcagattttctggttagagatgttcaatgggaaaaactattatgtttgtatattaactccagacctttagcagtttcctagaacaaaaataaaccacagtacagacatccatagatagataacagattacatattgggtggaaatgcatacaatgtcatttcccaatcaacagacatttaataatgttaacatcaagcagatgtttgtaataaagctgcggtggcactcctcagcaacattgacatccagtgtttatccccttcactaacactcagtgtccttcacaaaatttgtacaactgattctgatgttttactcgttgtatttgaaaggtgatatgaacactttttcctcaaatctttttgataaaaatgttttattgagctttggagtaataaatatagttttcctttgttaacatgaatcaaaataatgttttgagaggtatgtatatactatgaagtttgaatattaaaaaccaagagatgttgcatgcggaaaatattaaccatcatctactttgtgggtgtggttatatggtttttcaaatggtattgctctttcaggttctaggtgataaacatgggaatgctttatggcttaatgaaagagagtgctcaattcagagaagaaatcagaaggtggtggaggaagcaccaaggtaagtctcctaagaaacgtttataaagcggctgcttttatgcatttcattcattcattcattcattcatcattcactgacgcatgcattcagagacagggtctcactctgttgcccaggcagtggtgcaatcacggctcactgcagcctccacctcccaggctcaagtgatcctcccaactcagcctcccacgtagccgggactacaggtgtgtgccaccatgcccagctaatttttgtgttttgtagagatggggttttgtcatgttgctcaggctggccttgaactcctggcatcaaaagattagcccacctcagcctcccgaagtgctgggattataggtgtgggccactgctcccagccacatttctttttttatttgtttgctttatcagctacaattgcactaatgttcatgtagactctgttactgcatatttttataattaagaatttgttacttgatttcctcagtgctttaatgtgtaaaagggagagaatacttgaaaaagaagtgggtttttattagaggagaaagttgggtagacagccaactgtgacttctgcaggcttctaggaagtatggaacctgatggtacttcacgggatttctgagatatatgccttctagactttcatgttggtgaagggttcataaagttggtcctgaatttatcctaccatgaaaggcttctggagtgtggttcttggaaattccttgaattatcagagccactttgggtacttctccagggcatctttcatgagtttggtgtatggggccttatttctcatttgatgctaggttgctatttgtatatactctggtattctctttgttcttaaaaatcctcaggtgagtgttcctagtaatttttaattaccagacggtaagaagtatagcttattgtagctttaatcagcagagctagcatatcttgatataatgcctatatagtttctgaaaatagtaagtgagaatgtgagtatatttttaatcccggagtaatggtaaaaattcaactctattttagttacattggtttttaaaaatatggcatggtgttattagttttaaaacatggaccccaaatcctttgccatttttctctttgagcagtgaggggaaggatcattgttcccttttcttgattctgtgctctgtgaaggcttgacccgtagactacttagaagtgatgctgtgccagtttccagcccaggccttgggaaactgccagcttccgcttcctgttctcatgggatgcttgtgcttacacaccagccagtatgctgtgaagaactgtgtagcttacataagatgtggccatctagttctcaaggcccaggaacaggatgtaagaagggaggaagaagaaaagccaaagggaatcctcttcctgtgtctttaggaagatcctggaaggtgctgaagctaattacttggtgttgatctgaagttagacacttagctagggagacttgttagtatctttttcttaagaaaccatgtgctgagctagaactagtactgtagtactgtagtatggaggaaggggaaaaaggatacctgtggaacagtaagagtcttcaacacacatgtcttgcaattttctgtttccttgactgattatcaattccaattcaattaacactctgtttttagtaaaaacctactcaagtgttacctgggatagaaatctttcccagactgggaaccttgaatcataaaatgtgtttgttttttctctttgtctagaaatacaaacttttcataatgaataccttatctacttatttagagaaaaaaaggaaaatatacagcagtaggaatcaaaatgaaaaagctagaactcatcattaatactgacctgatatgtatttgtacactgtgaaatgttaaaataaatggaatgtgtagttttcagttcctggagtaagaatcggctgggcatggtggctcacacctgtaatcttagcactttgggaggctgaggtgggaggattgcttgagcctaagagtttgagaccagcctggacaacgtagtgggacctcatcttcacaaaaaagtaaaaaatcagctgactgtggtggcatatgcctatagttccagctacttgggaggctgaagtgggaggattgcttaaccccagaggtcgaggttgcagtgagccgacatcatgccaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatgcttttaaggaagttcttgttttttgtgtagttgtgttacaaaagggtactttatctcatagaaaacagacatgtatgtttttaaaagtgaaatgatacctaatttgggatttactttaaaaacaataaagggtgggcctggtagagaagtgggcaagtagcatagataaagccagagtggctatgtattaataattgctatatattggaggcagcttcatgcaagttttttatactattccataataaagcttttatagcatgtcatctcaatcctgctcatttgagaataattttaatccacaagtagaaaagtagctaatgtttagtttctcagagcctttctttcatagaagcaaaatctgtgaaaatgcaaagtggtttgatgatattttttcagggtttgttgaagtcattttagcttaacttgcctgcttgaaggtgggtctggtatcttgaagccaaacgtgcaggatttagtggatgtactgctgattcttgttatttgaggcagttatgttctctaaagtcaccttgattactgaattagcgaacactgaataatttcccctaggggaaatacagggttagggttcctgcaagcctttgcttataacattttcctcagtggattaatacataattttgttttgtgtgtatttctcatttaatatctgtggttgattcattaacagtgaactcacaatcctggccaacaagactataacacgtgcctgagtaaagcttatcccacacacattttctccagacagtacttcatggccttcttgcacatgggaaccccagacagcacctaaggacaatgcttgatgggccatttcacaccatgaaatgacacacacacacacacaaatgcaaaaaaagtgacactaaacagaccttgaaaaggatgcttgttatagtatgagcattgaaacgagaagggagagcatcaccttgttcagccttagcatactggagtctcaaatttttcacctctctgcacttgttcacaaaggaccatgaaagcgccttaagtattgattttggggttacaaataaatttcagcaagtaggcagctttgtaaatatggactacatgagcaatgaggattgattgtgtatgttagatactagtaagttatttttctcccagtttttggctcgaagcaattctgaatatatatgttaaatattagaagttgaagagtagttatatattttgtgaatggattgaagttgcagagtaatgtgaaaagttcaaatgttttatacaaatctaaagttgacttatttgagcatgttatgcttaataatatagtcaacatatattataaaacatatataaagcacaatattttgaattcttaaattggtatagatgatctatatctgagtaaactttaagaaaatgtttatgtaatgcacacaaaagataacttgatttttgtccgaaatgtagacaaacatttttttgtatatgtagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggtaacaacaactgttatttattcctctccatgcctctgtactttacccttccttctccacccttttttgttttataaatgttaaaaaattaactccataaagtgttaaataaagatttagtttttatgcttgtgctaagacatctgttaggaatgacggatagtatccctctaaagttcaatgtctagacctctgctttgtcactgttaatactttatgttggaaataccactttgtttttttcttgaacctttctagatgaactgtatttgtcagtgtgtatgtgctgttaagaaaaattactctagatattacaaataggaagtgatacagtgattgcaaaatctttggaaggatggaggaaggaagggtacccagagtgaacttcggtggtgactcccactgctgtaccactcagccaggctcccagaggaaccggcacctctgccacagtgaggacgttgagaatcaagtggctgcccttggaactgttggctttgggggacataacttccttagttctaaccaaatctcaggaagcgactggcgttgtaaccggtggctttatttccttccttcttcccttttttctttcatttaaattgtgaactatacagaaacatacatagaacacaggtgaataattgaatgtattattataaagcaaaaatcaatgtaaacatcaactgggcctagaagtatttacaaaacagccagctctttttacactagcctcattttcttctccttctcaatgattctgattccccctccatcttccctagagctgtctcctatctgactgacttctcagaaccttcagttttcatatcattcttcctttgaattacgcatacctaagcagcattattacttttgtttgttttttaaaactatattaatgggatcgtatagtattcgttcttttgtgcctggcttcttttttcagcatggcatttgtgagatttgtgctatttcatggaactcctgtatgatacattttctaagaaaatgccactatttctttatctgttagatttctgtagatagtttatttccagttttatggaatttgtgttagtttgctaggactaccataacaaatgatcattaactatagcttaacacaacagaaatttgttctcgtacacttcaggaggccagagtctatcatgcaggttccagccgagtgggttccttcctggggggttggagggagaatccactccatgcctctctcctggttctggtgttgccgacagtccttggtgttccttggctttggcagcataactctaatccctgcctcagttgtcatattgccttctctctgtgcatctctgtgcccagggttcccgttttctgtagggacactagtcacattggattcaggacccttcccatttagtacggcctcatcatacgtgatttcctctgccaagatcctgttttcaagtaaggtcacagtcacaggttgtgagtggatgtgaattttgacacgacactcttcagtccaattcaccattcaaaaaacacatatggcctacagagataaatagattagtacttgcctaggactggggtgggtgagtggggggattatgggctgatggctaaggggtggaataggacaggagagactgaggaaggcatacttatgcctgaaaacagtgtcaactcttcttccgttaggcccttgggggagggggtggggggggagggggtgttgagtcactgcaggcatgagctgggtcgagcttaagccttcctgcagtggttttctcacgtgcaccaagggaccgcttgtgggatttctgcatgcctgcttcatcctgagcttgagggcttgcctctgaccctgtgcttcatgggagccgtgtcttcatgcctgtgcctctttcccagagggagactcctgtgggccctggttagccctaccatgggtgcaggagggctgttttctgttcgctgtgccgtggcggtagaccgtccttgtgtccttgaactttgaggtgagttcagtagtggccctgctgctccccagccgtggggaagctgatgttctgggctccaggtggatttctgcctctttcctgatggttatcttttgcgtgctatggctttcttcatgcttttactctcgacctacctgtttgaagacagttcacgtgtgcctctgtaagcagtgtataatttttcagcccagtttgatatgtttgtcttgtatcttgaccatttgctccttagaaagttgacagaaatgctggtatttttgagtttaaatttctaatttttaaaaatgttttcttcttgtccaatctctggcctttttcctttttttttctttcttttgcagtatttatcatttaattttttcctgtacaagtttgggggttataaatactgctgatcttttggtagaacctctacattacaacacacatccttaatttatcaaaaactgataacagtgtcttttcacctgagctgccagactgacaagggagcttagaacatttaaagtccgtttactgtctcctgacttgggtacaattatcccccgaggccatttctcttattattttagtcatcattcattccattcctcccacatatttacctttctttgtctttgtttctggtagtttcttttagaggtttacttgggacaatctctttttgttgacagccaatgactttatgttgccttgttcatgaaatgcgtttttactcttcttagacgtcttggctgtgggccgtggctcacccctgtaatcccagtgctttgggaggctgaggtgggaggatcccttgagcccaggagttcaagatcagtctgggtaacatagtgagaacttgtctgtaccaaaaaaaaaaaaaaaaaaaaaaaaaaaaaaattagaaatcttagtttggccagtatttttttcaatttattgaaaatattatttcactgtttctggtgagacttccccactcattctgcattctgcttatttggacataattgatttttccttttggtagcatttattaatttctgtttttgttagatttcctttaactttttgctgattcgtgtacatgtatacatggaattcattgaatattttgtctgtagattaatgtcttttaatttttttggaaattctccaccattattacttctggaacaatctcacatacacagatgaataaacctataactttcattttagacctccttaatatatctcttatgtttcttatgctctctttgatatttttcatcttttttggataatttcttctgtctttcttaccttcccttatgctgtatttaattaattaatcacccattgagttcctgatttcaattgtttatatttcagttctgaaatttctatttggttcttttaaaagtatgattcattggtttttatcttttcttgtctcctatttgaattttcaattttgacttttattttttgaacataattaacttatttgttttgtagtacatgtctgataatgttgacatgtgaagtcttatgactacttgtattaactgctttttatgctgtttcttggttctgctgttgagttcctgttgggccttgttattatactgtcatatacagttattttaaaaattgttattaatcaaaacctaagatgatggattctttcttatagagatttttcaaatttttttctgccacatgcctatggacagtagtatttgtgactacggcaatctaagctcaaagtgtaaggctccttgaactcctgaggggatacacagcccggttgcagttctagagaatggttggttttattccagttcagtcttatcttgaggttgcattcctttatggtgcccactaaaagtgggggtagtttatcaaggttctttgataaactgatactttggtggcctcttatcttcgtggttatgcttttgatttgttgatgccaccaaaagtatagcttatattcatagtccttttttcctggaatggcaaatgacgttagggcaaaaatggtgttgagtgttgggtttgcaaatctgtgttttcatcttggttttggctgatcccttcctatattcttaccctgtgatgtttttaagaagacctcccccatctcccattccccaccagttgttttctagtccccaataagcccaagttccaagctgagtggctttagaggtacattatgcctatagattaaataagtttgtgtcctgactctcaacaccccccaaaagcagtgagcgggcagtggaatgacagtctgtgcctcactgctatctcacttttcctttccaaatctcatgcatttgcacatccagaacctcatgcagtcacatggaaacctcagctgtaagggagtctgggaataggctttttaaccatctgtattctgcagtgtaagagtataccctagaaggagtttggagggaaagttcagtgccagcccaccattttcacatgaatataatcaccaaaattttaatctgtaagttatatgtaaaaagttaaaaacattgctgtattttcattgtaaagtataactgtcaaataatgtggctgattttccttaagtatggcaaaagtgatctatctagatgcattttgagactagtattgtaaatacttgtagcattttataggtagtagctcagtagttgttgcttaaaactcatacttcctttgaaatcacctttgtagcctatattttattttgtgactatctttagaagtgacagaattttgccttttgaaggttaatttgattttgattaaaatgtatctttataactaagtatgtctaattagataattagctgggaaatcatgtttttggttaaagtgaagactttattttgtcataatgagaaaaatagcttgtaatttgattctgaagacaatttgagacgactgcaaaatatttgtattctattctagaccaaagagatctgagattttttaattgaggtacttatcagtatttatggaattgacaaatgggcagtttgttattctgttcttgtgttatctttttttccatttgtttctggctcatttatctcaggttataagtttgttcaagtttgtaccatggttgtttctggtataaaacccgatagttgatttttttttttttttttaaacagagtctcactctgtcaccaggctggggtgcagtggcgtgatctcggcctgcaaacctccgcctcccgggttcaggcaattctcctgccttagcctccagagtagttgggactataggtgcgtgccactacgcccagctaatttttgtatttttagtagagacagggtttcaccacgttgaccaggatggtctcagtttcttgaccttgtgatccacctgcctgggcctaccaaagtgctggtattacaggcgtgagcctccgtgcccatcctgtagttgatatttttatcgaataattctatgcagttggtcaagactatctaagtacctatgttttgtgtattggatagcttgctaggaaattatgttctataccctcaaaaaattataaaaatatttcaagaaaaaaaatcaaattcacaaagattttgtcatattaccagatctaatatgacaaaaattgtgaatcattaactcataatgatatgaatcaatgctatagaatgtcatgtccatgttcggcctgaaattgccccacttctcaccggtggtctgggccccacactgtgagaaaatatttcactaatacctgcgcttagcaaacgtcccaaggtctctgactgattagagctcttgttcacgaacagagctctgatagtacctaatgctgttaagcgtgctattttaatagcattctatgatatttaacatcatactttgagacatttgtctcccatgtagtgtttaatcatatttttctctcttgtggtttacttccagtgactgtgatcctgtcagttaccagaataagttaattttaattttttagaatgtatctgtgtgatagggggtatttgatgtggaggatataattaaatgggagcatgaacaaagaattttggacttcatatgtgttcagaaaactattcttacatattccaaagatttctttctgatattgtttaaacaatccaatttgtttttttttgagacggagtcttgctctgtcaccaggctggagtgtagtggcacgatcttggctcactgcagcctccacctcccagattcaaacaattctcctgcctcagcctccggagtagctgggactacaggcgcataccaccacgcctagctaatttttgtttttttagtagagatggggttttaccatgttggccaggatggtctcgatctcttgacctcatgatccacctgcatcgacctcccaaagtgctgggattacaggcatgagccaccgcgcctggcccaagtgttcttttaatagtagacattctctttcaaatttctttactaaccttaaattataatacttaaggcacattcaccaaattctttatctcccaagatatatgttatctctaattagtgtttcagtttgaactagagggctataattttctttgttctttttttattttctttgaaatttcctgattgaactttcactttttccagcttcagaactgtgttttgtttttgtttttgtttttttttttttggtaacagaaatgcatcttcactttctacattttcttaagagtgaaatttgaaataacaatacagtttctccataaagagatgcaacactaagaaagtcaccgcgtttggtgcattaatagttggttccgttgactggttttgttctcaatctggtcacagtttatgtaactgaattacctttgctatcttcacatatttttgctttattttttttaagtcactggttttctgttgcttaaagataaaatttaaatgcttttgcatcacaacacaagctttttttttttgtagccctgatttttcccccagagtcctgtttcttgccagtgccgatctctgtgtatgaattgcaagagactcctttctttttcctgaaggtgcctttcagtttgacttctttgtgccttgtatcatgccactcccattgcttggaatgttctctgttcacctctcacagtgaacactgagctatgtatctacctgcacacccacaccacacacacctgtctcccctctctgaccatacttctccctcatctcacctctctccacatttgaaagatggacagctagatggagaactactctacggacactaggattttgttaaaatgctattttattgaagtgtattctagtagtcccccttatccatagttttcctttccaaagtttcagctacacacagggtctacttcatttcaaatatattaaatggaaaactttagaaataaacaattcataagtgttagattgtgcactatcctgagtagtgtgatgaaatctcacaccatcctgctccatcctgcctggtacgtggatcctctctttgtctggcatctccatgctgtagacactccctctccatgagtcacttagaagctacctcactgcaatgagacatgatggtgccactgcactccagcctggacagagcgagaccctgtctctgaaaaacaaacaaacaaacaacaacaacaagaaaaaacagaaggaaaaaaaaatccgcctcggtgatcacatcgactgtatgatacctcagtgcttatgttcaagtcacctctactttatttcataatggccccagcatacaagagtagtgttgctggcaattcacatatgccagagagaagccataaagtgcttcctttaagtgaaaaggtgaaagttctagacttaataaggaaagaaaagagtcatgtgctgaggttgctaagctctgcggtaaggatgaatcttccgtcggtggcattgtgaagaaggaaaagaaatttgtgctacttttgctgtcaaaagtcaaacttcaaaagttatggccacagtgcatgataagtgcttaagatggaaaagacattaaatgtgtgtgtataagacatgaatagaaaagtgttctaattgacagcaatcatgttctatactatccacagtttcaggcatttgctggggacctaggaacatgtcccccaaggataaggggggactactatatatgcaatttgctgggataattttagtttcttattttgttgaatggtaatactcagaatttataatactttgtttaaaaaaatctagtggttcataagagtctacaatgggaaaagttactctccataccacacttttatcacagccatttatttttcctctgttgaagcaacctttgttttttttaacatactaatttgggagtattccatgcctaatttaaagcattatctttttcattttaatgacttctaataacctgtcatagggatgtaacagtcatataatttcaccagatctctatcgataatttttccagtattttgctatcccaaataatgcaattatgagtgaccctttatatccactttgcacgtgcagaagtagaattgctgggaatatatgtgcttttataaattagttaagtattatcagtttacctcttaaatgagagcttgtttcttctctccctggccaaaagtgttttttgccttttgatctttgtgtgatagtgaaaaatggtatattgttttcattgtttatcatgaatttttctttatagattcatttatatttctgtgaattgactattagatcctttgccctttgggttttcttattgatgtgtaggtatttgcttattgttgggggaaattagccctttgtgatattgtcagaaaggaggggctttgtgaatattttcatagggctacagggcaggtgctttctgagcaaagaccctggcagttgtgagaggtgacagcgtgctggcagtcctcagagccctcgctcgctttcggcgcctcctctgcctgggctccaactttggcggcacttgaggagccttcagcccaccgctgcactgtgggagcccctttctgggctggccaaggccagagccggctctctcagcttgcagggaggtgtggagggagaggcgcaagctggaactggggctgcgctcggcacttgcgggccagctggagttccaggtgggcgtgggcttggcgggccccacactcagagcagccgggcaatgaggggcttagcacccgggccagcggctgtggaggttgtactgggtcccccagcagtgccagcccaccgtgctgcactatggcttggccccaatattttctctctgatggggaaaaatggccacctgagggaagtacaaattacaatactatcctgcagcttgaccttttctgtaagagggaaggcaaatggagtggaataccttatgtccaagctttcttttcattgagggagaatacacagctatgcaaagcttgcaatttacatcccacaggaggacctctcagctcacccccatatcctagcctccctatagctccccttcctatgaatgataatcctcctctaatctccccccgcccagaaggaaataagcaaagaaatctccaaaggaccacaaaaccctcctggctattggttatgtccccttcaagctgtagggggaggggaatttggcccaacccgggtacatgtccccttctccctctctgatttaaagcagatcaaggcagacctggggaagttttcagatgatcctgataggtacatagatgtcctacaaggtctagggcaaaccttcgacctcgcttggagagatgtcatgctactgtgagatcaaaccttggcctttaatgtaaagaatgcggctttagctgcagcccaagagtttggagatacctggtatcttagtcaagtaaatgatagaatgacagccgaagaaagggacaaattccctaccggtcagcaacccatccccagtatggatccccactgggaccttgactcagatcatggggactggagtcataaacatctgttgacctgtattctagaaggactaaggagaattagaaaaaagcccatgaattattcaatgatgtccgccataactcagggaaaggaagaaaatccttctgccttcctcgagcggctacgggaggccttaagaaaatatactcccctgtcacccgaatcacttgagggtcaattgattctaaaagataagtttattacccagtcagccacagatatcaggagaaagctcgaaaagcaatccagggccctgaacaaaatctagaggcattattaaacctggcaacctcggtgttctataatagggaccaagaggaacaggcccaaaaggaaaagcgagatcagagaaaggccgcagccttagtcatggccctcagacaaacaaaccttggtggttcagagaggacagaaaatggagcaggccaatcacctggtagggcttgttatcagtgtggtttactaggacacttttaaaaagattgtccaatgagaaacaggctgccccctcgtccatgtccactatgccgaggcaatcactggaaggtgcactgccccagaggacgaagattccctgggtcagaagcccccaaccagatgatccaacaacaggactgagggtgcccggggcaagcgccagctcatgtcatcaccctcactgagccccgggtatgtttaactattgagggccaggaaattgacttcctcctggacactggcacggccttctcagtgttaatctcctgtcctggatgactgtcctcaggtcccttaccatccgaggaatcctgggacagcctgtaaccaggtatttctcccacctcctcagttgtaattggaagactttgctcttttcacatgcctttcttgttgtgcctgaaagtcccacacctttattagggagggatatattagccaaggctggagctattatctacatgaatatgagaaacaagttacccatttgttgtcccctacttgaggagggaatcaaccctgaagtctgggcattggaaggacaatttggaagggcaaaaaatgcctgcccagtccaaatcaggttaaaagatcccaccacttttccttatcaaaggcaatatcccttaaggcctgaagctcataaaggattacagaatattgttaaacatttgaaagctcaaggcttagtgaggaaatgcagcagtccctgcaacaccccaattctaggagtacaaaaactgaacggtcagtggagactagtggaagatcttagactcatcaatgaggcagtaattccactatatccagttgtacccaacccctataccctgctctctcaaataccagaggaagcagaatggttcacggttctggacctcaaggatgccttcttctgtattcccctgcactctgattcccagttcctctttgcctttgaggatcccacagaccacacatcccaacttacgtggacggtcttgccccaagggtttagggatagccctcatcggtttggtcaggccctagcccaagatctaggccacttctcaagtccaggcactctggtccttcaatatgtggatgatttacttttggctaccagttcagaagcctcgtgccagcaggctactctagatctcttgaactttctagctgatcaagggtacaaggtgtctaggtcgaaggccccagctttgcctacagcaggttaaatatctaggcctaatcttagccaaagggaccagggccctcatcaaggaacgaatacagcctatactggcttatccttgccctcagacattaaaacagttgtgggggttccttggaattactggctttggccgactatggatccccggatacagcgagatagccaggccactctgtacgctaatcaaggacacccagagggcaaatactctggtgggaatcagaggcagaaacagccttcaaaaccttaaagcaggccctagtacaagctccagctttaagccttcccacagtacaaagcttctctttatacgtcacagagagagccgggatagctcttggagtccttactcagactcgtgggacaaccccaccaccagtggcatacctaagtaaggaaattgatgtagtagcaaaaggctggcctcactgtttaagtgtagttgcagcagtggccgtcttagtgtcagagactatcaaaataatacaaggaaaggatctcactgtctggactactcatgatgtaaatggcatactaggtgccaaaggaagtttatggctatcagacagccacctacttagataccaggtgctcctccttgaaggacccatgtttcaaatacgcacgtgtgtggccctcaaccctgccacttttctcccagaggatggggaaccaattgaccatgactgccaacaaattatagtccagacttatgctgcccgagatgatctcgtagaagtccccttaactaatcctgaccttaacctatatactgatggaagttcatttgtggagaatgggatacgaagggcaggttacgccatagttagtgatgtaaccatacttgaaagcaagcctcttaccccagagaccagtgcccagttagtggaactagtgcatcaccctctcaccctccctctccccaccaccaaaagttgagaaggggcagatatgccagcaactcttctacaagctctaattttaatagtctgagctttcctttccagatgtgcatacccctctgcatgtgtgtgggggggaagcaggccattaactacgctgcctcatggggaagtggggtatgaggaacgggactaagatgttctgtgagtaaacaattgcactgatctatgattcagaaacctttttatttttaataaaattttctttttaattgtcagcaaggcaagttatttctatagaagggtgtgcccttacagatggagcaatggtgagcacacactcggacaagggaggggaaggggttcttatccctcacgcacatggcccctgctgctgtgttgttcccctgttggctagggttagaccgcagaggctaaactaaatccaattggctaatttaaagagaatgacggggtgagtgctttggcgggagtcagggcagagcaggtagcaggtgatcagagtgagttagggtggagtaggtaattgaaaaaggttgctttacgaggaacttaagtttaaaagtagaaggcaacgaattgaacatattgacatattaattctttgaaacgaaatttagaactcatatctaacaacccctccccttgtatttccttacagctttcttttcaaacttttttttaatgtgtcttggcttagttgttttgcttgattttccaaaagaagaagcttctctggataaggtggaggatagttaagggaggagaaaccttttttttttttttaatgtcttggcaggattaacaaatactcgtatgaaaacataacagatatgatttgtaggtatttttccttatctattgcctttttaactttgtatgtgttttttcttcttgtatagaaagtttttatttgtatgcagtttaatttttaaatcttctctttgtgatttcaggagtgacatacttaggctttctgtgctctatgagcaatcaaactgttttctttcatgttttcatcaaatatttcatctttaatggtgaaatcttcacttcatttggaattcattttattttattttccaatggctacctgattgttccaacaattattgaataatcagtcttttctgtaataattcgaagtgctatctacattacatactgaaattgcagatgtatgcagacctattacttcactcttctttttttaatttttctgcttattcatctcctagcaccacactggtttaggtattatagctatatattatagtacagtatctagtagaactattcctttctcattacttttatttttcatatgaaaaattagcctatagattagcttattgtatttatatttaacagaagaaaaagaaattaaaatgacagaatctctggactattagataaatgtttataactttccacagatatattaattcctaaaatatgttctttttttcccttccagtgacatggaactaaaatatgttcttaataagaaaaatggttatgaaaaacatttatatttttgtcatcattttccttcatatttcaatctgaaagagtatattgtttctcttttacaaaagtaatggaaattggcatacttatatttaatcccgctgtctttacttcctaactcttcatgtttgctagttttattattagttctatgtgattgtagcatttcctttcttttctgtaggcatggctctcctggaggtttcatcttacttgtgtattttatcactttatggtcactgtcagcatcttaccatagcttcatgattagtgagttctttattttgatttgttttatataaagttagggggttttttttaatcaagaatttattttttagagatacctgtgggtagtgtatttgaattcttagatggattaaataaggttacccttatatttgaaattttaactcagatgcaaaccgtttgataccttcacaattgtaggactttaaacatctttctgtggtagaccttcagaattttatgagggagtatcaaaatttaagattatcgattgttttattcaattcctctatatatcttttctttttccctttaaaaattgaatctgtttgattaagaaagagatagacggagtttttatcataattttaaaaacgaactttatttgttagagcagttttgggtttatagaaaatctaagtacacagaattcccatatgcccctccctcatgccacaccatttctctacttaacatctcatattagtttggtgcatttgttacaactgatgagccgttatcgatgcattgtgggttttttgtttgtttgtttatttttagagagaggggtcttactccaccacccaggctggagtgcagtggtgagatcctagctcattgcagccttgaactcctgggctcaggcaatcctgccaccccagccgcccaggtagctgggactacaggcatgcatcaccacgcctggctaatttttgtattttttgtagagacgaggtttcaccatgttgcccaggctagtctctaactcttggggcctctgtctcctaaagtgctgggattatagccccgtgccagggcacccggcgatacattgtttttaactaaagtctgtagtttacactagggttgctctttgtgttacacattctatgagtttggacaagtgtatctaccattatggtatcataagaataggttcattgcctcagaaatctttgtatccaagacacctttgcatttctttccttctttccttgtttggttctttctgtctctcttctttcctttcctttttcccttcttttctttcccttcctccttccttcttttcctttttccctctgtgtgtctgtctcactttcttttcctcattgtaattttcacacatacagaagtacttcagaatagcaacagtagtagagtagagccctaggaatctgcaaccagcttcttatttacttcccagtgttgtttcacgtatgccttcttttcctcagttgttcctctcttggctggagtatcagacattatataaattcacatcatactgaagtatatgtctttaagttttccctacattcctaataatgcatatttttaaatatttatatacagtataatttgatgtatgtgggtttatgactcttgtacatgagttatgtggctattttcttgcctgaatgtttatcttgtttaaatgtttaatctgaaatcctactttgactcatgtcatactgtatctcctcctgttttgtctggtcctttattttaaagccttctttattagttgttttgtttttttagtttagaaaaaattatgtgtgtatgtgtatttgtatagatggggtctcaacatattgcccaggcttgtctagaactcttgggctcaagggatcctcctctcttggcctctgaaagtgctgggattataggagtaagctgctggcgcctagcctgaaaaaattttctaagaacctaatccaacattttcttttagtgtgaaaatttaattcttcccattttaaatacttgattttatttattttatcttatatttaaaaattttttttcttgttttccattttgtttttccttttctgtttgttgcttgaaataatggttaattatcccttttgtttcccattgataatttggaaatcctattgtcctttaaaattttatttatgtttatttttctattcagacagacgttttctctgtcatttgtaaagatgatgtaactagtttccttgactttccaacactgaagatttgctaagataatttaatacttctaagctatttttagtttatctcttcttttttagcttttttttagctcccatgtatacagcccagacacatctttcattatttgctatatcttcagctttcttttttgagatttctgccctagttcacttatttgtgtagcacattttttcatgaaatttcttcagtagaatgtgtggaatatatgctctgaaatgtcacatcctcaactatgtttctttagccctgaacgggggatactgttttgattgaatacaggattcttgattaggattgggtttcggttcttgtctttcaggagcatatgaatttcagctgtgttctagcttctagtattatgtctggtgtcattctgatttctttcccattgtagataatgtagtcttgctgtctgaaagtttgcccaattttttttatttctctctctctctttttttttcttgagacagggcctcatcctgtcacccaggctggagtgcagtggcatgaacctggttcactgcagccttgacctcctgtgctcaagcagtcctcctgcctcggcctcctgagtagctgggaccataggtgcatgctgccacgcctggctaatttttaaatttttttgtagagacgagatctcactttgttgcccagcctggtctcaaactccaggtcttaagtgatcctccagcttggcctcccaaagtgctgggattacaggcatgagccgttgtgtctggctctaattttcttttgatcattggaattcagggacttttttttccaaccaggatatgccttggtttgtgtttgtatacattaaccctgccttttagtccatgccctttttcagtgttcaggtttaagtattgcttcatttcagaggaagtttcttctgttatttaactatttccttccatcagcaattttctcctccttgtggaacttctagtttttgcaatttaggtctactggatatgtttctcttatgataactgtcattttatatttatgctgtgtctcttgacattatttctttattgatcttccaggttactaattcaggttgcaacagtggttatcctctcctataagtaactgactaaattgtgcaattgggaaatcacattattttagctcagaaattctaattgtgcgttacagttagccctccttacctactagttctgcatctgtggattcaattaactgtggcttaaaaatttaaaaataaaatgaaaatatcaattcaacaattaaaaaataccaataaaagcacaatatagtataacaacagtttacatagcatttacattgtattactataagtaatctagagatgatttaaagtatacggaaagggctgggtgttgtggctcatgcctgtaatcccagcacttttggaggctgaggcaggaggactgtttgagcccaggagatcagtgctgtgatgaaccatgatcatgccactgcactgaagctgggatgacagagcaagacccatttcttaaaaaaaagaaaagtgtacgggatgatatgcataggttacatgcaaataccatgttactttatatcggggacctgagcatctgtagagtttagtattcacaggggtcctgggaccaatcccctggggagatggaaggaggactcaggggatgtgtgtgcacatgcacgtatgtgcattgctacttcttaagtttttaagtgcctttactgctttttgggcaaagttgtatttttctcctgtccttcagcagctctgtttcacttggtctgtgtaatcattattctgaatgttttttctttcttgtgctagtaatccccctgctgtggttttttgggggttatcagtactaagttctgcttcttgaaatattctaagtgacagcagcccttcagatggttgaagacatgaccatatctactccagaggcctggaagagcatatgtctcctagcattctcatctcaaggacagaattgagctaatttttattgactacttggattcctgggcaaagagaccacggacccatctggagcctttattgacttttcccctgaggtccatggctctttgcaagccagtctgtctccatgatgtgttcctttcacattcttccctagagttctctgaagctagtctccagttttcgttcagccacagagggagaagagcctgttcccagtttttggctctcatcttctccctagatcttggtgcttcccatgtcctcagctgcttagtaactctgggggagatagacagcatggagtttggagtggagaggtgggagccaggctggttccaggctgtttttgacagcttctcagagcaggaatagctaacctgggttatctggatctctcatgagctttagggaagtctgtgaaccctctgaagtcagatatatagttttttagtgagaaattcagtgagattcaaaattgtaaaatgtttcagaacaactgcagctgactaatggaggactcatttaatcattgtttttgttaattgcaaacatctactgttttcactcagagcaagtaaattctagttctcttccttcttagctgtgtgaccataagcaagttccttaacttctgtatgttttgatttcctcattagtaaaatgacattaattatagcatttgctgtataggattgtcagcattaaatgagtttatatagtttacaaattcaaaatagtacctggtttatactgagcacacattctttctgctaactgtgagtatcttatccataacatttgcatgctgtttattatatattggttgacatttttactcttactgttgtcattattattaacattattgctattactattgtcattaatataaagcctgtctgacatctgaaaagatggcaagccacatattaaataataactttctctcattcttttgtcagttaactgcaaaattattgttacatgtgaacaaacatatttgaaatattaaccacttttaaagagatctcctttctgttataagggtgtttgtgtaagaagagtctgggaggaaaaatggaaactgaaatcttccaaaaatgaagctgatagagaaaagtatttactacatggcttaggcctttgtgttaagattaatattaggaccctgaatacacctttccaaattcgtgtgtgtgtgtgtgtgtgtgtgtgtgtgtgtctgtttgtgtgtgtgtaattaataatttccagatgctaggtttttttttagatttaagtgttttggaaaagcatcctctgtatagtctacaaagtctataggagttagaaaattcccaaatagagaggaataaaatcttaataagtaagtaattaaaaccccaaacatggtcagtcagctgtccatatctttgagaacagacaggtaaactgtcccacttttgttagacttagtcagttgcttatgttgattggtacagtgcaggaggaatctacttttaccatggaaggaaaggtacagtacaattgttgaaattctatgaaggctatacactctaatctcatcagggggaattctgcatcacagggaacctttatattccagaaaggttttagaaatttttttgtaacttgattttgccctttgccatttgtttaaaaattaagaattattgcaacctaaattctggtttataacaattaactataattgaacaaataccatattctaatttcagactagttttggattaaaaaaaaatttctagacctgccagatgaaaatattttggtcttttatggaattggagtgtttgatagaaagaatgaggagaaattattgggaaaaggatttctaactaattgtaaaatttcattcttgtcagaaggggcattttggatgtgagcaaatgttgacctttttgattgtatttaaaatgatagaggccagggctctcaggctgtttagagtgagccagaattgggatgttttggcatgttttgttctgggaaactgaggatagaaggtaggatgtgttataccctcccttattatttactgaaccttagtagaaaatgaaggaaagaagtttttggtatacagatatgtatagataagcttttcaggcacttagatttggggttttgttttaaagcatattgtaaatgatattgctgtctgagttctggactctttttatctatgtttaactttttaaaactggtctttgtattagtttgctagggctgccataacaaagtatcatacactggggtggctgaaacaacaaaaatgtgttttctcaaagttctggaggctggaagtccaaaatccaggggccaacagggtcagtttcttttggaggcctttctcgttgcttgtgggtggccatccactccctgtgtcttcctgtggcctctcctctgtgccttgtgttgtctgggtcctgatcttctcttatgaggataccagtcatgctggattagggcccactctgatgatctcattttaacctgagcacttctttaaagaccatgtctccaaatacagtcacattctgaggtggtggggctaggacttcaacatacgaattttggggggtacacaattcagcccataacggtttccttatcatttcttcatgtgattattattcttggggtcaccaggggaaccctataatagaatctgttccgttttcgtggtcactcttttttttttccatgtatacatagcatataaaaattttaaacaacttactagaatatgactggttctaaaaatcctatctcccatccccccaaaatgaagacttgacaccggttagtctattctaaacattctgatttcagctccaaagtgaatttttaaggacaagttccagaaatgaattggcagtggtgatattaaatgcatatttagttttccaagatgagctggaaaactaaatttttagtttttagtgctgttggactatttaggaatagccagtactcactttgatgtatagttctgatgttattggcaaaaataaacaaatcaaaagcacaaaacaggcaactgacaatgtcatgtctctgaagagcacatctgtatataatcctacacaggtatacgcaccttcatccatctattctaagcacgaagaatgtatcagagaaaaggggagaaaaattggtttctaagccctgcagtccaactcttttttttgtttttttctgaggtagagtctcactctgtcacccaggctgtcactcttgaatataaccattgtttccaaggtgagtttataggagtgatgtgttggggcttatttcccaacatgcttttcatccttgagtgctgtggatcaaaatctaataaccttagatctttattttgaaatcctgtattctcaggaggtagagcttcagaattttagtaggtacatgctagattctgttccgtgaacagaaagagcagaatctttctgaacagacagagcagaaccaaaaataatggcattgaccatcctttcaggctggaatagcaacaaactacaaagacagaggcctattatgccaaacacttatgaaactgaattttatgtaatgggacagtttccttatatttcagtgggtaatcatactaaactactttgctaagttgaatccaacaagttctgcttacaaaagatagctttcgaaaaaacaagtctttgtaatacctgtcagtttagacaggatatattgaataaaaatgtcacttaaaattttgttaatttaaaagaacattattttgataacaaaaaatttcagcattctctcaccacaccatatcttgagagcaatctcctatgccttctctattaaatgacagtgatgtattgaagaagtttgtgcatgtgtggaaggattttgtaaatttcaaagtgccacactgatgttggttatacttaggtatggtgggccttacacttttaggggcagtttctgctttgactaagcaactgggccactacttaccagctgccaaataattagagctgcagatatagcactgttgaaggaattttaatacttctcatcagcctcctcctcataatggccaagttaacacacactgcgtctttctgacttctttttacatgttgtgacttttccccttttcccttaaaactgattttcctcagttttaattttcatttcaagtcaactcaggtatataattaaaatttccttgaatcttgctcaccttcaggatgacttgcctgttattcagttactgatcctgaaagttttagaaattattaggtaaatatcacagtaaaatatttaaaagtttaggtcagaggaaacatatcgcacaaactatctgctattgtataactatttttatttaacatagtgggaggattctgacaagaatgttggtcaagtcagatgtctttatttttaataatgttttataatatgaaaaacaagtctttctagggacactatttttatttttattaacttttttattttttatttttttgaggcagggtctcactcccatttcccagactggagtgcagtggctccatcttgcctcactgcagcctcgacttcctgggttcaggtgattctcccacctcagcctcccaattagcgggactacaggcatgcgtcaccatgcctggctgatttttttgtattttttttttttttaaatagagacaaagttttgccatgttgcccagtctgctctcaaactcctgggctcaagatatccacctgggtttttctcccagagttctgggattataggggtgagccaccgtaccctgacgtatttttcttaactttaaattttgaaatgatttcagactcacagaaaagttgtaaaaatattacaggtaatttctgaatacacttcactcatatttaccacatttactttatctttctatctatatctgtatttactggaagcatttcagagtaagttgcaggcctagtggccctttactcctaaatatgtctgtacttcctaaaaacaagtaaattttcttatgtaactatagcaccataatcaaaatcaggatttggacattaacatattactgtcttccaatttagggactatattcaaatttccccagttgcctcattaatgccttttgtggtaaaagaaaaaaaaatctggttcagcatcctgcattgcatttagttgttgtatctctttattctctctcaatctggaataatccttagttttttggtcagttgtgatcttaacattttttaagagcataaaccatttattttataaaatgtcactcattttaggtttgcctcttttctcatgtactagattcagtctttgcattctgggcaggaatagaaatgacactgtccatctatgagcaccatgttggtagcacgaagtgcctctttatcccattattggtggtgttggctttgttaaggaggtatctctggcgtttctacactgtagactttctattttccttttgtccttaataaagtatcttatagggagatactttgagactctataaatagccagcatactttcactcactagctttagcatacttcctagtttgtatttagtgaggaataggctgaagatgacaatggcagtgtcagagtttattattataatttttagaatcatgaggtaggtaacaacacagtgccaaggagatttagttttccctaagcttattctgctaccgaaatgagatacattaagcactcagagatgaagcacaacctaatttacctcacagttgcatttgacaagcttggttatattttgggaaataaatttgaagcaacagatgagtaagagggagtggtaagaggtattagacacgatgctaatagtgacagcttggtggtgattaagaatacaaaactaaaaatagcaagtagatctataaaaagctagccgattgttaccatctagcgtaggtgtatggagctaaacatatttattctagtccatgagggtgattatggcatgagatgttataaggcacgattatgtcctataatatggcatttgataattttttgtacctgtttgaacaaaagattcatggtgagctagggatataaccaatacaaataaatttatcaacaactgttagactctgcagtgtggcactcccttgagaaatttgtctttgaggattcaggtattataacttggtagggcttactccttttttgtgagtgtgaatttttttttttttttttgggttcgggcttactcttgctcactaaatcccaagatttatatattcacatgctaatacgttaacaatgcaaaacagtgctgtctggtggatccctgatttgtgtgctttttagaaagagcacattgctgttgggtaggaaaaacatatgaagccaggttctcaaatatttgtgtggtaaggatggagtaacaataagggaattccattttgtattttgaatgtttttgaggcattgtttccaaaagtgtgttccatggacttggcaactcataaaggtactttgcaaaaggaggaggaagtgctgcgcaaggcccttctctaggagagtcacaggacatatgggcatcctaatgacaagagtctttcctaaacaatctgttgaactgagattaacccggtgtttcccaaatagaagtgacacagaaaccttttccccccacataatagccctcaaaacagatgcatattagcatcagacttctgtagttacatttttcttctaagtgggacaagatgaacttgttggtttaccagacaccaatttttgacttttttgtttttttatttttataaccttttgatcaagttaaccatcttttacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccgtccttttgttcctttatataaccctgttctatcacttaagtattgagcttaacttgcagagagaaaccattgctaagcacttgggaatagggggatatttgtgattatttaagcaatgttgtgcttataagatttctggtaataacacagtctaaaggaaatgcttcatatcctgtggagtagctttggaatcctatgtatttagaaggatttctttcaaaaatgtttaaaattataagttttactttaaagaagttaatttcttttacctggaaaattgaagcaagttagactattttgtggacttatgcagtacttgtcaaaaggtaaatgttttttaaaatttctgttagtaaggattttacctttagcagcttgttattttagttatctgcttagttgcttctaatttgaattacttgtagctccctaatttagattgtaaaatgttatggctctgttatatgacttaagtttagaacacagtgggtccacttttggatcccattcaaagtggatctgatgtacttattttcctacacagttaaagatccctcttcaaaggtgaagcagagacacaataaatttggatcttgaaaccttcatagtaatatgctttttaaaagacatgtatacataattgtatagccattgcatatacttttatacatacatttctttcatatacattactgtcaggaagatcaggaagataatgtcatctctttagtgagataaattccaactccatcgtgaccacttaccatagatgtgactctgtatttgctgttcattcattcaatatgtatttatttgccttgtatatagtatgtacttatatgggcactggtcatagaaagaggaaactgaatggttcacttaacttttgaaattgtcttttcacctatcagggatgtgtgaatagtattgatgtaaagcacttggcacgtggtaggttcacctcttttttttttcctgagatggaatatcgctctgtcgcccagactggagtacagtggtgcaatctcggctcactacagccttctcctgggttccagcaattctcatgcctcagcctcctgagtagctgggactacaggcatgtgccaccacacccggctaattgtttttatttttagtagagacagggtttcatcatgttgaccaggctggtctcaaactcctgacctgaagtgatttgcccgtcttggcctcccagagtgctgggattacaggcgtgaagcgccacacccatccaggttcacctcttgagtagagtgctgagatgctttctcacatgagattggtttctagtaataatagagggtttttttgctagttactttcttattgtatttatcttatagagtcttggttcttacaaaatcataatttgctttcaaaaatacatattttaaactacctaataagatctttatttagtgtcacatttacgaagggttgatgcttattttagtgatgatttgtcattaaaattatgtcaaaatgtcttaaaatgttgttgaaactgtaagcaaactcaacacgcacaaagctaattatgggtgccatctgtttatttttacaaagctttttttttaagactatggcattgtctgcttatgataagcttcaagattattataatgactaagtcctgtccttcaattagtgtagttgaagatgggaagataattcgtttgttcactgaccttttcctgtgtcagagtgtatgaaatatgacatgtcatgataaagaaactattgtgaagtgcatttagaagatacttaatttttatgagaaaaaaatgacatcaaagcagcagatgtggccaaagttttgtttaaattcttagaacttattcaaggttttagatgaacggtagacttttccagtgacttaagtggcttcattttaactcaaggttaagaatttctaagtgatcgaccaagtttatgttgacatgtatccctgtttgtgtacctatatgtcagcacatgtttttgtacatacatatctcatgtgttagtgcagaaggccaggtacatgcatgacagcatcagcccaagtagttatcagcaatctgctgagagagcagagcgatcgcactggctctgttttgcaattgtgcatgctaagcattacccaagtcagtgtggagggaaagcaacctgaaggatccatctgctcccttctgctacactgcctcgatgcaagattacactaatctggctgcttgtcaggacaggttagtgaaagcatgcaagtgggtgagacttagggtggactagtgctttggaaaatcataagctgcccctgtagatgccacgttaagtgcagcagaataggttgattatcggccacattgaagattgccgtgaaataaatatatagctttttggttaagaattagtttcaaaattaaaattcttaaatattgttggaccacagataaatcaaaattgagaaaaataatacagatagtttacaaatacttttaggccttagtttttcttatgatttgtgtattgtgtttattctttcattttattcccctagctcaagagttttttagtcaaatatgttcaaatgttacattcgattaacttcattttacccaaaaacttttgtgatttttcttgtttgtttctatttatttacccttttctacacctactgactggcagaccttggccttgcaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggtaaaatgaatggtgttgggaggaaggatggtggttatgtccagagtcatgagacctggtatagccaaacaatgaggtaaagttagggttttataatgttgccaactattggattacgtaatccataattaaatcagaaaaaaattagataattttgacctaattccagatagttttaaagaattgggcttagttaattgtcatgtatttgtagatggggaaatagctaccaatcctttaagaggcaacagagcattggttaaatactcttgagcttgaatggaccatggtttttgttttgtttgcattttctttgtttattttcaaacaacactaacaagaagtagcatttatttccatgggttttttaaaaaaatgcccaccttgggtacacattagttgttgatcagatatttacttaaaatttttcccaaccttttttttgtataattttctcctttattattacataaaaataacaatcaaaatttaaattgtaaagcttttagtaaaacatgtactcttaatttataattttaattttgggttttactcataaactctcagttcagtacttctaaatgctttttttcaaatgactaaaacaagaatgcaaggtaacatttgtactatttttacttttcgacatcaaaaatgtctgtcaagattaaaaataaatcagtgtctgtgtttaagaatactgagagctggtttgaaatatttttcaaggagttcaaaaatatgttttggcgtgactgtattgctcttgcttttttcatattttaagtagtattactttcattcttatgacactgaacctgtttattctgatgatctaagatatttacaaatgaagtgcatatctagtagcgtgcaaagttttttttttcaggtctttatttgaagaacccaaattctcaagttttaccatatgtgaactgttttgagaagtaagaaaaacaaatatctttagtataccacatttgttgttctaaacttgagtatgttttgatgtagggcctaggttattttattttttgcccaaggcattctaagaagttttataaaatgttggaattttaccaatttcaataaagtatgaacaaggtcaggctaaattctgcttacagttctgtttgatttttaagtacattctaagttgtctagcgtaaaagacaataatattctgaaatctgtgatttggtaaataccatatgttgaaaatagacctataaatggttcttcattgtgtaaatatttaaccttacttgtgctgatttatatttcaaagactgtgcttcctttcctttgaactttcaggacccctacaagtcttttggtttaccatctattgggagattgtctcagtaccaagaaccgttacatctacctggtgtaagtcattaagctgtaataccagctgaagggttaaaatcgtgatttatgtcatacttttatgttaaagcatgtcaacaccaaagggtgtaaattgaaggacaagtgaaattcatgggaatcatggtttttgtgttgaaaacaaatttttttcagtattttgtggtgttcaagaaagtcaggattcactggacaggggaagcctggggacatctgatgatataaatgatagcttacagtgttcccaattctttcgaaaattataataaaaaaggctgtgaatcctaagaatgagaaatgatgttttgtgttacaatttaatcttttcaataaatcgagtccaaccctgctatatagtcacttgtcaagaaattcaagcacaaaatcagctccttaattgaaatttaaggagattgaattaaggcaaacaaagtgtgcctcagtctattaaacctcatggactttaaagagtaataatatttatatcagttaaataaaagtgaccactgtccattttattccatagctcttctgtatttaatagctattttgaaaatagtttttgttgcagaaaaagagcaaggacataccctttttcttaatcaaggtaataagtgcatatatatatatatatatgacattatgttagctagtagatgacaaggctgtaccatctgtgaatattcaaattattcattttgattactggcatgaagatggtgaaagattacaggaagaattctaaatctgaagatattattggatatatgatttatttcactttttaaattgtttttgcccatgtgctttctaaagggacttgaccctttctgtgcttggagactccatgctgtgttcaaagccagaaggcagaaaaaaaattgtgaagatttaacaggcattatgtgacgttaaatagcacatgagaaaacaagtatcatagggacatatctaaacacttttttaatcaaacaaaagaagtattaaataagaattcataatgattactctagttgttagaagttttcaccatgttgtaatagctaacaggatgtcaaacattttgccctcgcaagtttttgcaatttgcaattttcaaacgtgagacctgttgaaagtacaagtgataatggacaaactataccccctacagtcttcatcccaccaaatctttcttcaattaatgctgcagcaggagttttatgtaataacatttgcagttgtgagccatccatagaaagaaaaaacaattaaaatgccttaaatgttctgcttactgctgttatttgcttgtgtgaatgttgcatgtcagctaaatggaccaaggagtagataaagtgattgggtgcaggagagtgcacactaagctttgtctatcattattgctgggagcaatcaaattgatgtcagcaggacagtagatgcgttgacagctgtaattatgtatctccatggtgatcacttttggcctgtcatggaggcccatgagtcccctcccttggaagcatttaatcagattgggctgtcacttgtcaggtagacatggcgggctgggagttgtgcttagggggagaggtgaattgagaatgaagggtgggagatgtctgatagtttcacagagtccactgtggtactgaagacagaaattttaattgtgctagaggtttctgagcagtggtttgagaatctcgtacagaggtgcttgggtgttttgttgtggttgttattgtttgtttttcttccttgtcttattaaaactagagcagtcagtttaccttagaaaacaatttttggctcttaccttttttggtcacaagaatgcatacttaagagttaacttatggtttgtacttttcacatgcttcattaagcctgagatttattaatatggcagaggtgaagatttccttttttatttttgatcatcatgttttgtaaatttgttattttcagaccacagttttgttctgctcagaaatttggttctgatttcatttgaattttttcttaaagtttttagtgcaaatttgtatagcctttcattgaaggaatggagacttgatctgacttcagattggttgttaagaaataaaaatatagctgattattacttggaaaaagcagcataaatagtaaattataaagcagagttttcatactgtggtacagtttttaattgggaatactgatttgcttatacaaagatacgtgtttatatatatcttgattttatcgtatgtattttaaagttaagatgacataacttctgtgatcataatattagtaaataacaaagacagttatatttaattaagatctgtaggtaacaccttataggatgatattattcaaggcaactgaagttttaagtaaggaactgtagaagaacataataaatattctttattgtctatgttattttatttgtgggttgaacatctaagttcttcctagctttgtagcagtttatgtagcaaatgataggatgtagttaaagtcagaagttttagaacttgtatcagtctcgtttgtaaacacagcattagcaagcatgctgtggttttaaagatgacatagtggtcaaattagctctttcactttttagtactaaaattaagaaaatgaaaactcacagatatattttctgttatgtaacccgtttactagttgccattttggggctctttaatgtggggaaaaggtagattgtgattttattgcttttaaagctgctccattaatttttttctagtttttgtcaacactgtgaatttcatagaacatcagtttatgtcctgaaatatgttttcagaaaatagaaagccaagtatatttcgtaagtgtgctgaatgatttttgtttataattaagatttttgtatatgaatgtgaatacgaatacagatatctatatttttgtttgtgcttgcaaatacagaaataaaagcccttcaggtatgttatagtgttccttttacaaccttacaaagagaataatagtagtgtgaattttaagaaaatgaaactatcgcttgtcttctgatgtcaccgtataataaagccatcattataccctcatgtggatatcctagacaagaggttctacatgtggtcccttgataattgcctaaattaaaatattaaaggcctaacagccgctgtgttgacctttttctgccttgctgcagacagatgagctgctgtttattaggaaggcttcttcccacaggtggaaggctacgtgagcttccgctcttctcttcccacccctttacaatgttgggcatcaaagtcctgctgttccagcagctttgattcagttcctccatcctcaagacccctaggatgtgcctgacagtctgaagtattttgattagcttttaaatacttcagattccaaaacttctttctaataatttaataaatgttctgtcctcagtaactgctcatttttaaagttttgcatggctaacctccgtgccttgctgctggtatcaaactgggaaatgaaaacaagaatcagtgatgtactaactcactcgttggctggttaacagcaatcagcctcttcaaaagaatattttgaacttgtgctatccccctaccccccaccccaagaaaatcacaaaatcagaactctaattggggctttacaaagcaaagccataggaaaagctgtgtaaacatgaaagcctcaggggagcaacagtaacagaaaaatagtgttttacagttgagagggtgaggcagaaaaggaaagtgttacagacatgaaaggcccaggcccacattcctatggagctgaggaccaggcttgacgaggggcctcactggtgggctcagaagggtctggcagggagtgcagttagcaagggcatcgtccatgccatgcttcagctggaagacaccatcagagagccacagcatcctggcatagtgatgtaggaagtcttcattttttattttttatttttgctgttttttagtttcgtcattcagtggcagaacaaaaaatgtgttgcattacatattaacggatcaagattttagattgttttcctattttccagaagttgaaatgttatttgagattgaaattctctatccattttctccatggaaatgaaattggtggttacaaaaaaatatctacacaatatgaattacttttctttttttctttttttctcccaggtccgagtggacagtggcatccaaccaggaagtgatattagcatttattatgatcctatgatttcaaaagttagtttaatttctcaatggattatttgatttcttcgaaaaatcaatgatatttaaagagtctgaaactgggcctttatctgaatcataagctataattaaacaactaattatgcactgatgtaaatgtgaaagcagagcaggttttttctcttgagagaaaattcagcgttatgttagtttgtagtactcctcctccccaactaaatcatgccacaccatcacacacatgcatgaacaataataataataaacatctaaccagtggtgccagcctaactcattgccatgagaaggaattaaggttttttttggccattggcagaaattacctgagatggaagtatgaatgaatggcaagagttgggctgataggcagtgtttgttagagtactttttgatcttttctcttcagtttttacaaattaccaattatttaagtagatgtgatgtaagagtataagatttgttttgcccacctgtctttttgaagtttgactttccagaataaatgaattgaatttttggatctttaaacccttaaaaccgtataaagtgtaaaatgctgtaataattaagattgtggattttatttttattttattattatttttttgagatggagtctcgctctgtccgccagcctggagtgcagtggcacgatcttggctcactgcaacctccgcctcccaggttcaagcgattctcctgcctcagcctcctgagtagctgggtggctcgtgccaccaagcccagctaattttttttgtttttagtagagatggggtttcaccttgttagccaggatggtctccatctcctgacctcgtgatccgcccgcctcggcctcccaaagttctgggattacaggcgtgagccacaatggccggccagattgtggattttattttgaaaattctgtgttctctgaaatgatacatctggattgaggaatgatttgtttttcaagccttgtttctcaagatggcttttccccaagtgtcctttttaatgttatagttgcagtaaacaaacacttttttatctgtctttcttcagttagggttttagtgcttttttttgggatagggtctccctttttcacccaggctggagtgcagtatcatgatcttggctcagtgcagccttgacctcccaggctcaagcgatccacctgccttagccacccaagtagctgggactacaggtgtgtactaccatgcagggctatttttttatatcttttgtagaaatggggcttcctcatgttacccaggctgatctcgaatacctgagctcaagcaatccacccgcctcggcctctcaaagtgctgggattacaaacgtgagccaccgtggttggcctaagttattagtagtattaaaataaaatttaggtcttttgtttattagagaaccaccatttaatttaaaaataaaactatgtaaaaatattatacgttgatttttaaatattccatttttagatgaatgtttttctcttcagaaaaatggcctacaaattaattttcaaatttgcttgatattgaagagctagtaaaacctactaaaataatcacaatctatagattggctaatataactgccagaaaaatctttaatgaatagttaaggtcttatttcattgccaaattatagagatacatataagtaggcactaaatcatgtagaatagtaagacttttctgtttttttgatttctgaaaaagtaccatttgcttctgtgtatattatatgtaaaactgcaaatgatttctaagatagtcgtcttctttctttatacttttatttttgaaactttactttttttgttagttatgaaagtgttaagggctggacgcagtggctcatatctgtaatcccagcactttgggaggctgaggtaggtggatcacctaaggtcaggagtgtgagaccagccaggccaacatggcaaaaccctgtctctactaaaaatacaaaaaaattagctgggcgtggtgacacacgcctgaaatcccagcttctcgagaggctgaggcgagaggatcgcttgaacctgtgaggcggaggttgcagtgagctgagattgcgccactgccctccagcctgggcaatagagcgagactccatctcaaaaataaaaaataaaaagaaaggaaagtgttagctattcagggtatcaaacttggaaaccacagaaaaatagggaaaaaatgtcttatctaatcctcaccactacccttggtgttcaaatcctatctcatatattcacgtttagctgtatctccttttaaattttttctgtacttacttttgttacgtttttgtttttgtaaaatcactctttactatgataatgaaatgtaggagaagagtctgaaatagcttgattctaatatttatatacttaaaaaatcataattgacatgtattgaaaactgaactatcataaaatttcgagatatatttagaaatctgttatgaaatattttaatttttactaaaatgaatcatttaacatagttctaaatatatatatatattgggttttttgtttgcttgtttttagctaatcacatatggctctgatagaactgaggcactgaagagaatggcagatgcactggataactatgttattcgaggtaaaaacaaagatttgcactcgttggttattgtatatggtgtccagttccagagaacagcctgggggtttaccaatgagaatatggcacagcacatttgctcactatgtgcttaaagagaaataagaaaaactcaaatccatcaaaccaccataccaagtatagccgtttccactgttttaagcaaatgcatattttctctatatgcctaacatatatattactctatataaccagtacacattggttacacaggccttcaggagggcgtcttttttcttacagaagtaatattgctgtggagaggtctttagtgcgtatttgggacacacgttcagtttatgtgagtttatctatgtttatctatatatgcgagtttagatagacataaataagttacttgggaagattattcctggaagacattaaagtatttgtaagcacattctatggggattttctccctttttatctctgcatttttattgtggtaattgaaatactagattttggttaatttaatttttactctaatgtgcttgagcagtaaatccatgaatttgagagtctgaataagaatattttgtcaaaactcatttctgttaaactgtgatataatacgacataggggcatggcatctgggcagtttgtcaaaatattagattagttttggtcccaactagaagttatttatctactccatctggcttctgaaaggagtactcttttgtatttacatgaataccatttcatgttttatacttaaatgaacattttcccactaatttgcttactctatatatgtatatataggttcaccagttactacagtttttaagtgactaaaatacaaagtaggcttgccattattctcctaactttatatgtgtcacatataaaaaataaattttgttgtataggtagatttttccaggcttagtctgaaattttgcctttgaattactgtgatgtagtagacagaaaccagacaaagctaggttcatagcccctgtcctgacgccatttaataattatgtgatttttggccaagcacggtggctcacacccgtaatcctagcactttgggaggctgaggcgggtggattgtgaggtcaggagttcaagaccagctgggcaaagatggtgaaacccagtctctactaaaaatacaaaaattagtcaggcgtggtggtgggcgtctgtaatccccgctacttgggaggctgaggcagaaaattgcttgaacccgggaggcttagtttgcagtgagccgagatcacgccactgcatgccagcctaggtgacagagtgagagtccgtctcaatgaaaaaaaaaatttttttttaaataaataattacgtgatttttgtcaaatgactttgtctctctgaatctcatactccacatttgaaaaatggagtgatagtctctgccttataaattactggtgaggattaactgaggttaagtatataaagggcttggcaccacactggcttatgttgttcaataactttagttgtcatcctttcttcctctttcctcacacttaataaaaccatatatttaagaatcaaggccaggcgtggtggctcacgcctgtaatcccagcactttgggaggctgaggagggcagatcacttgaggtcaggagctcaagaccagcctggccaacttggcagaaccccgtctctagtaaaaatacaaaaattagccaggcgtggtggtgggtgcccatagtcccagctactcaggaggctgaggcaggagaatcgcttgaacccaggaggtggaggttgcagtgagatgagatcgcgccatcacactccagcctgggtgacagtgtaagactctgtctccaaaaaaataaaaataaaagccatgtgttataaatcacattatcaatccattagtcatatgaaatttactaaatcatagataaacaatattgaaagaccgttttatgtaatttctaatactgtgtgcggaggttatatgctttcattgcaccctgttcaaatacttctccagagaatttaccgtcactgtaaaattaaagtattaattgtgtaattaactgtgaaatgttgggttatcctataagattattaggcacatgaggacactgatgatctttatcttgtttgtatgcatattgctggtgcttagcagtgtctgacacatgctagatgattaataaatgtttgttggatgaatgaatgagtgagcaagtgatactatccctgatttcaaggagttactaatatacttggtgtgaaaacatatgaaaagataagtataatattaatatagctttgtaggtgccccaataggggattgaaaaagggtagtgggagtttaaggaagaggctagcatatctttcttttctcgcctctcttggtcctttgaaagtaactagtactgctttaggactcatagtgtctctgtgtctctgtcgagagtacctcactttgttctgctttcaaatgatcctcagagtggcaggatttttaaaaagactggtaatgtcctgtgtaggtgaaataaaggggatgggcacgctcaagcgtctttgcagtatcacttgttatagtattttgggaaaataatctggtgttagatgttaaaataaaagtgcataccctctgacccagctattcatcttttgtgaatctttcctatagagttaaaaaactgaattatgagcatgttcaccatgacatttacaacaacattgtttgtagtagccaaaatgctgaccaaccacagtgtccgctaaatggatgaatgactgaataaattacaatgcattattactataaaatactatgcagctgtgacttaaagacctgtttgtatgaatcgttaaagtagaaaagcaatttgtagtcatgtgtagtacattctcatatcacttgaaccatcttctcatcctaaaatattttaaattgtgttggatgagcacagagaaaggtgtggacatctacatatcacaataatttttttaagctcaaaggatttatgagagaggggtttttcttgacacatttctcttagactttttaattttaggtattttcaaatctatagaaaagatgaatgaatagtactgtgcatgcctgtgtactcttcacctagattattatttaataaacttttttttgatatttgctttctctatttctccctttctttgccttttcctcttcctttctcacccttcctctttcctttcctccctccattctcttctctgtttttctcctgatccatttgaaagaaggttgcaaacatcatggcgcatcactcctgaatactttaccaggcttcttaaggggaagaccatgttcctgtaactggatttttcttgcctgctgcacagatagagtctatttattgagacagcgttattgcaatagagaaagagtttaataaacacagggctggctaaatgggagactgaagttttattactcaaataaatttctcccaaaatttggaggctagggtttttaaagaataatttggtgggcagggggccagggagtgaggaatgctgactggttggtttggggatgaaattataggtgcttgaggcagggtcttcttgctaccttcagttactgggtaagatcacagaactagttgagccagtttgctggtctggctgcatgactcctgagccttaatttctaatgttagttttacaaatgcagtctgttccccagacaaggagggggtttgttttgggaaggggctgttttcattgttttacagttaaagtataaattaaattcctcttatagttagcatggcctacacccaggaatgaacaggggcagcttggaggttaaaagcaagataaagttggttaggtcggatttttctcagtgtcataatttttgcagtggccatttcattcctgcaaaaaagcacaataccatcattacacccaaggaaaattgacagcaacctaacagtttcatctcatgtattgtccatatttaagcttgtccctcggagtctttttttattgttttttaatcccatctgtggcccaaagttacacagtgtctttgattatgtctctttattatcttgccgtctttcatatttcatttcattaattttcaggagagtccacggtagttgatttgtagaatgtggcacattctagatagaaagtgttaacgttggttcactaaaggcacttgtgaagtgattccaagaatgagggttgtaggtgataatttgcactatcactcacagaactcgcagaaactctttgcttactattatcggtttattataaagggtacagcttgagagtaacccagtggaggagatgcacagggcaaggtgttaggaaggggtgcagagcatccatgccctctccaggtgcaccaccctccatcacttccgtgtgttcagcaacccacaagtcctctgatccttgtccttgggtttttatgaaggcctgactaggtaggcatgattgatcctatcaatctgccattagtgattaagtcattcttcagtccctctcccctttggagggtgggggtggggctgaaagttccaaccccttaatcacatggttggatcctctggccacctgctcccatcctctaagagtcatctcattagcataaactcaggtatgattgaaaggagcttgttatgaataacagaagacattcctctctcaacagtcatttctatgatattcttgccaaaaatgtacaacctgagtataatcatgaggaaacatcagacaaaccaaattgaaagacagtctacaaaataaatggcttcttctcttcaaacatgtcaaggtcaggaaacacaaagaagagttgagcaacttatgtagatcaaaggaaactaaagacacatgacaactaaatgcaatgtgtgatcctggtttagatcctggaccagaagaaaaatgtttttcttttgtagtaagggtcataagtgggacaattggtgagatttgaataaggtctggagatgaggtgatagcaatgttagcagtgttaggcttgtctgattttgatccttgtactgtgattatagaagagatataccttgcttttaggagatgtacactgacatatttagaagtaaaatgacatcttgtctgcaacttaccttcatatgtttaagaaggaaaattatgtatctgtgtataaatagaaaaaattagtgacaaagcaaataaatgtgataagatgttatcatttgtagaacctccatatatagtaattctgcttactatttttttgaaatttttttaaattttgaattttgaaattatttcaaaataattttgaatttttttattttgaaataatttcaaaatttaaaaaatttaaaatttaatttcaaaataaaaagttaaaaaaatagggaagagcaagaacccccactctccactaatatttaaagaataaaagcagagatgcatttgggattttgaacttacatattactcatctggctaattctgaaggataggcaggtttaaaaacttgctttatgaaaggcagaaaagggaagacaatctactgtcttgtttggtaactgcttaattattcaaatatgaatatttttttcctgtgctgattgtgaacttttgttaagatagagaaactttgaagcaaaaatgtaattcggttaaaatgaatttcaaaatcctcaggaaataagagtgcttttggcctctgtttgatcctggcagcatgtctagctgatgtctgggcagtgttttggaaccagcaggcagtcaggggaaggccactcctaggggcctcttctctgtggcctggtggtgatttcccatacagatgggacctggtgaactctgccagaggtcatccttgactcccagtccacacctcccagtcataatttttatgagtatgtgattaataatatccttgaagttgtaaactaactctcaaagaatacctctactgtccccataccatttaaacaaggatctgttcaaatagtgttgtctttcctgggatgtgaaaagaaagaaactaaatgcaaaatggtaactttcaaatctgtatgatactgtttagtgcttcagtgattcttcccatctagctgatcttttgagctcttaggtataaaatacttttctgattattaccctcttttggctttaggattaattaatggacagtagtttcgggaacagttagtcgaggcatagatgtttgttgtctgccatgagccattatctcaccatattggccttaggaaagaaaaagagataacgatttagttttgcatagtcatatataatattttatttagaaaacattaaagagaaaatggttttgtgttttaattttgtttttaaaatatcatttagtgagataaaagtctgtgtttttatgctgtatttactattcaagtagaaagatttttaaaattccatgcttcatttacgtgcttgatggctctgttctttgatatccaaaatgtaaattaatatttgctttcaattcctttgagttagatttttctaaaattaacacctatttttcagctttggatatagaggacaaatacaacatatgatttatcctgtgaaactgcaagcatgttaactttctgaatattatcagtcacaaattttgggcatcagaaaataatctctttttttgttcaaattgtcattaactatttctgaaaactatattgtattttactgatgacagagtttggttccacctattttaacattggccacacagggagctaaaaaatttataccagcagtaggctataaacatgaaagccagtaaagttaaatatgaaatattaaatatatatgttaatagtattctttttttttttggagatggagtctcactctgtcacccaggctggagtgtagtggcatgatctcggctcattgcagcctctgcctcccaggttcaagcaattctcctgcctcagcctcctgagtagctgggactacaggggtgcgccaccacacctagctaatttttgtatttttagtagagacggggtttcaccatgttggtcaggctggtctcaactcctgacctcaggtgacccgcctgcctcggcctcccaaaatgaacaatactatttctgtttaaccagggcagggaagttcaaaaatcctgagactgcctgctaacttacttactgttttgcaaaaacacttgtaaattgaaatattctgaattatttatttgtacataagatcaatatttttggtaaaataaattgttgatgtaccttggtctaatacctttcatcccttccagtccctcccttagagtcttattttttccagaactttatttatttattgtaatatatgagcgatttgcatattgctggttttatttcacgtttctctgtctcaccctgttttggattccttcacatatgggagatgttcccccataagtaggaacgtctgttttctgatgtataccatcgaatctgcctgcttttctgaaccttaatcattcagacatcatctcacaggcatctcaaatttaacttgtccatgaatctgctattttcctctcaacctgtttcttctctgcaaatggcaacttctctcatgttgcagagccagaactttgggtgttgtgctcatctccccattctttgtaattgtggttgttgttttgagacagggtctcactctgtcacttaggctggagtgcagtgatgggcccagggctcattgcagtcttaacctccagggttcagctgatcctcccacctcaacctccctggtagctgggactacaggcacaagccagcacacccagctaattttttgtatttattgtagagatgggattttgccatgttgcctagactggtcttgaactcctgacctcaagtgacccacccacctcggtttcccaaaatgttgcaataacaggcatgagccactgcacctggccctcatctccccattcttgccatcagtccctgcctgcctcctgaatatccgtcaagtccagctgcttctcccatctgtattgtcagtgtcctagctgtggaccccagccttgccatttttcagcatatctccgcaattgtcccctaaggaatttttccatcttccctcttgcccttcctcagtcccttttccgtatagcagcctaagtgattctggattgcataaatctagtcatacctgccctgcttcccattctagttgctctcatgggaatgtggaatctgtgcatggcctatcacacgctgaatgcctattggccttttcactgcacccagcaccgttctctcctttgctcatactcagaccatggtgttttcctttcattcctctccataggaatacctggtggtaatcatttgctttttgcaacagtgaaatctctctctgtctctgtctctctctctcttttaattatactttaagttctaacaacgtgcaggtttgttacgtaggtattcatgtgccatgttggtgtgctgcacccattaactcgtcatttacattaggtatatctcctaatgctatccctcccccctccccccaccccatgacaggccctggtgtgtgatgttccccttcctgtgtccaagtgttctcattgttcagttcccacctatgagtgagaacatgcggtgtttggttttttgtccttgggatagtttactgagaatgatggtttccagcttcatccatgtccctacaaaggacatgaactcatcattttttacggctgcatagtattccatggtgtatatgtgccacattttcttaatccagtctatcattgatggacatttgggttggttccaagtctttgctattgtgaatagtgctgcaataaacataacgtgtgcatgtgtctttatagcagcatgatttataatcctttgggtatatatacccagtaatgagatggctgagtcaaatggtatttctagttctagatccttgaagaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttggtttgcatttctctgatggccagtgatgatgagcattttttcatttgtctgttggctgcataaatgtcttcttttgagaagtgtctgttcatgtccttcgcccactttttgatggggttgtttgtttttttcttgtaaatttgtttgagttctttgtagattctggatattagccctttgtcaggtgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgtctatgtcctgaatggtattgcctaggttttcttctagggtttttatggttttaggcctaacatataagtctttaatccatcttgaatgaatttttgtataaggtgtaaggaagggatccagtttcagctttctgcatatggctagccagttttcccagcaccatttattaaatagggaatcctttccccatttcttgtttttgtcaggtttgtcaaagatcagatagttgtagatgtgtggtgttatttctgagggctctgttctgttccattggtccatatgtctgttttggtaccagtaccatgctgctttggttactgtagccttgtagtatagtttgaagtcaggtagcatgatgcctccaggtttgttcttttggcttaggattgtcttggcaatgtgggctcttttttggttccatatgaactttaaagatccaattctgtgaagaaagtcattggtagcttgatggggatggcattgaatctataaattaccttgggcagtatggccattttcacgatattagttcttcctatccatgagcatggaatgttcttccatttgtttgtgtcttttattttgttgagcagtgttttgtagttctgtttgaagagatccttcacatcccttgtaagttggattcctaggtattttattctctttgaagcaattgtgaatgggagttgactcatgatttggctctctgtttgtctgttattggtgtataagaatgcttgtgatttttgcacattgattttgtatcctgagactgctgaaattgcttatcagcttaaggagattttgggctgagatgatagggttttctagatatacaatcatgtcatctgcaaacagggacaatttgacttcctcttttcctaattgaataccctttatttctttctcctgcctgattgccctggccagaacttccaacactatgttgaataggagtggtgagagaggccatccctgtcttgtgccagttttcaaagggaatgcttccagtttttgcccattcagtatgatattggctgtgggtttgtcataaatagctcttattattttgagatacgtcccatcaataccaaatttattgagagtttttagcctgaagggctgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgctgctggatttggtttgccagtattttattgaggatttttgcatcgatgttcatgaggaatattttagggcctctctgtattgcctaggctggagtgcagtggcacaattatagctcactgcagccttgaattcctggattcaagtgatctccctgcctctgactcctgagtagctgggactacagatgtgccaccctacgcggctaatttttaaattttttgtagagatagggtctttgttgtccaggctggtcacaaactcctggcctcaagcagtcctcctccctcagcctcccaaagggctgggattacaggtgtgagctaaattcctccctaatgttaccatagccttagctacttatctttgggtccttctcatctttctgttttccttcccagccaggaaaatctgtgtaagtctcaaatactttcctcttcccggaacaccaaagctgtcatttcctatgcaggtgaacctttctggcaagtgatacctcttttctttttcaaaagcactctagtttgtctctttgtgaaacatgatcaagggattaatttcccatgttttatttagcctgatctctttcaaggagctttttacatttttgcctacctaattgatctttctaagcatcctagcatattgccttcagttgcttttcactttcatctaaacaaaagcaacgccacattttttcaatgatttcttaggtatattgatgtcattagaaatttcatctgccttctactatgtttctcattaaaaaaacttattaaagccctctgaaacatagttattatgtatgggccaagtaaatcattacccacagaacaagcatgaaatagctgtgtagatctcatgggcatgcgctatagaagatctgtgtgtgtgtgtgtgtgtgtgtgtgtgtgtgtgtgtgtgtgtgtacataaagcaatctataatatatatatatgtatatagtgaagaatatgatcgattctgatatatataactttttcccatggaatttttgtgtagctaaaggaatagcattaatttgaatttgtgaatgttttctaaacgtcttgaggcagttttgataaattgagaattggcctttataaaatttagatacatagcatctcttgagtccggaacagaaatgctcaggattttccatatggttgtggatatggtctagtataaaaggatgcataggaaaatgcctgggagggtatacatgttaagctgttatcattggctagcttagagatggaaagtcatattgaaaaggtgtgccctgctcgctcaaacacatgcactagggtacagggtaacctgctgtaacaaagatttctaaatacagtgggataaataagagagacgtttatttacctctcatgtaactgtctggtccatgctgctaggaggcaagtcagcctcatgaggtcattcaaagatacacacacccatcctgatgtgccactccgtttgaattgccaaagctgagtttctgccatgtcaggaaacccacagtaagacgagaagaaaggaagctcaagcaagcaatgagagagtcggaagttgcgtacatcactttagcttaccttcctttgtctaggaattagtttgtcatgcctacctacaagctagatgggaaagtggagtctgtgtctgggtgtcttttgctcagctaaaattctattactgtggaaaaatgaaaagcaggttttaggagaaactagcagtctgtcacaataaactgtgtcttaaaaattgtttatatataattatatatatgtaactattgtgatatataatgtgctaatcattaggtaaactattcagtctctctggattgcaattttcttttttttaattttttttttttcttttagagatagggtctctctctgtcacccagatttgggtacagtgatgcagccgtagctcactacaacttcgaactcctgggctcaagtgatcttcctgcctcagcctcccaagtacctgggactataggcacatgccaccattcccagctaattttctgtttttattttttgtagagacagggtcttgctacattgcccaggctgatcttgaactcctggtctcaagtcatctcccaccttgacttcccaaagtgctggaattaaaggtgtgagccactgcacccagcacaattttctcatttgtaaggtcccatttttctctgtagtttacttattctataactagttgcgcagtttcccaagagcaggtaccatattgtgtgctctcattttccttcccatgatatctaatggctgcatgagtaatagtgtagaatacatgttgatgcatatagataggtttgctcagattaaagggctagatagtaaatgttttagactttgtgggacacaaggtttctgttacaactgcttgactctgctgttacaacatgaaaacagtcatatgtaagcaaaccaggctggctgtgttctaataaaactttttttacaaaaataggtaggaggctagatttggccttcaggccatattttgccaaccattgtcttgtaggaaagttacactttccaaatagatacaggtgtaaactcagatttcaggagctccattctttttttttttgttgtttttttgagacagagtctcactctgtcacccaggctggagtacaatggtgcggtctcggctcactacaaccttcacctcccgggttcaagcgggaggcctcagcctcaagagtagctgggattacaggcgcctgccaccacgcctggctaattattgtatttttagtagagacggggtttcaccatgttggccaggctggtctcgaattgctgaccttgtgatcctcctgcctcggcctcccaaagtgctgggattacaggtgtgagccactgtgcctggccaggagctccattcttaacagaaaacagaactagaagttaggtaggtcagtgctgaagcttaggatgcaggaaaacttctgtctgatgttttattaattacattttgtctcatgctctttgtatattcccatataacaggatagtaatgttcttttttgagagcccagcattgcattaagcattatatcatttatacctgataacaatcatgcataataggttctattattgttaatttacaaatgaggaaactaaagctttgagaggttaactaacttacctaaggtaagggatagacctggtatttgaacttgactatctgattctttgcttactttatggttattgttgcaaaagtggggattctgtgagacttgaatagtaaaatcagaatcatacttcgtaggtttcttatgcagcatgatggtacagattagaaccatacaagagtggactaaagtaataggaaggaatgaacaaacctctgtttactttgacttcagctgtcatgctgcagtcacctgctcttcttgtggaagcctgatgtaatttctgccttccctggatgtaacatgcttcctcccacttgctttcattcctgtgtaacatctttgtaatctggatgaccaagattagatacttcattcttcacaaaaccttcctgcatcctagaactctcccaatactattagtatcctcttgtggcagttacctattttgatattacagttgacctttgaacaacactggtttgaactgtgcaggtccatttatcttggattttttttcaataaatatatcctaaaattatttgaagatttgtgacaatttgaaaaagctttcagacaaactctatagcctcgaagtaccaaagaaagaaaaaggtatgtcatgaatacataaaatatatagagatactagtctgtttcatcatttgctattataaaatttacacaaatctattataaaagttaacatttatcaaaacttacacaaacagagaccatacctggtgccattcaaagcagagagaaatgtacacaaacagtaaagacgcagcatgaaatcataaccacattaagattcactgtagtacatactgtactactgtatagtttcatagccacctactgttgctattgcagtgagttcaagtgttgcgagtatctgcttaaaacaccatgtgatgctgatcaccgctgtgtgatcagttctctctccagtaaattgcatatggcagtaaaaagtcattgcttatggttctggaatatttttcatcatgtttagtgcaaaccataaactttgaataacaggacagaatccatacaaagtgctactagtaatgctggaggtcctcccaagaagcagagaaaagtcatgacattacgagaaaaagttgaattacttgataatatatggtagattgaggtctgcagatgtagtttcctgtcatttcaagataaatgaatcccatgtaaggaccattgtaaaaaaaaataaaatgaaatttatgaagcatttgctgcagctacaccagcaggtgtgaaaatcttgcacttttttgtgaaacacctttcatttcatattgaagatgcagcttttatgtgggtacaggattactataagaaaggcattcccatagactcgaatatgactgtctatgggaaaagtgaagttgttatatgacaacttaaagcaaaaggaaggtggaaggatataaagctggagaatgtattgccaaccaaggatggtttgataattttagaaagagatttggctttaaaatgtgaagacaaaatgtgaaggggaagctgtttctgccaactaagaggcagcattaagacaccattaagaaaatcattgaagagaaaggatatctgctgaacaggtttttaatgcagacgcaagtgccttattctgagggggaaaaaaaagccacaaggaacatttcttagtagggaaaagaagcaagcatgaggagttaagacagggaggaataggctaactctgtctgttgttctgtgcaaatgcaatcaggtttatgatctgcacttatctgtgaagctgctcatctcctagccttgaaggaaaatgataagcaccggctgccagtcttctggttgtacaacaagaaggcttggacaatgagaaccctttttctggattgactccattgatgctttgtccctaaagtctggaagtactttgtcagtaaggggctgtcttctaaagttcttttgatatggacagagccccagccacccagaacacatgtgtttaacatcgaaggtgtcgaagtggcctgcttctccccaaacccaacaagtctaattcagtctctagctcagagtactgtaaggtcctttcaggctcattatacacagagctgtatggaaacgatcgttgacactgtggaagagaaaaagtctggaaagattacaccactgaagatgcattgttgtcatataaaaagctgtgaaagccatcaagcccaaaatttgtgctggagaaaactttgtctggatgttgtgcatgacttcacaggatttatgaaagaggcaaccaaggaaatcatgaaagagattgtggatttgacataaaaggtggagtgggggttgaagggttttaaggtacggatcttagaggaatccaagagcggatagacaccacacccgaggaattaacagaggatgacttgatgtagataaatgcttctgaattggtgccagaggatgaagaagaagacatagaagaagcagtgccagaaaacaggatcacatcagacaatgcggcagaaggattctgattattcaagactgctattgacttattttacgacatggacccttctgtgatactggcagtaaaactaaaacagtggaagaaggattgaaatcatatagaaacatttttagagaaatgaaaaagcaaaaaaggcagacaaaaattacaaagtatattcataaagttatacagagtgtgccgcctctcctgcctccccttccacctcctccacctctcctgcctctgcaacccctgagacagcaagaccagcccctcctcttcctccttctcctcagtctactcaacctgaagaggaggaggaagactgttatgatgatccacttccacttgatgaatagtaaatgtattttctcttatgatttgcttcataacattttctttagctttattgcaagactgcagtatttaatatatataatatataaaacttgtaattgactatgttttcagcaagggtttcagtcaacagtatgttattagtatttacttttttgtagcatcaaaagttatatatggatttctgtctgtgcaggaggcacccctaatcctcatgttattcagtcatcacctgtgctttgaaattgtcattgtgtactaggctcaatttttttctactagattacatgcatctttaaaaaaatgacttattgaggtatacttgacataataaatttctgatatttaaagtattcaatttcatgagttttgacatacgtatacacctgtgaaaccattaccacagccatggtgttgaacacttctttcacctctggaagtttccttatggtctttgacatttaccctccctctacccctttcccagtgtaaccacatgatctgctttctgtcactgtaggctcgtttgcatgtcctaaaattttatattaatggaattatacattattatgcattatttttggtcttgcttttttaactcagcataattatttttaggtttatccttgttatttaatgtgttattgactctgtgtgtgtatgtggaatagaattccattgtatggacaagcccagttttgttaattcatttgcctcttaatggagatttaaattgtttccaggttttgattatagtaaataaagctgctattaacctttgtatgtaagtctttgtatagacatatgtttttatttaacttgacttaatacgtaggagtgagttgtctgaatcagtgaatatatgtttaacttttccagaaactgccaaactgttccaaagtgtgtgtatcattttatattgccaccacagtgtgacaattcttgttccatatcctgactagcacttgctattatctgtcttttcactttggccatgtaaatcggtatattgacggcatctcattgtgtttctttaacaataatgatgttgaacaatttttcctatgcttagtggacattttgactgtgtttttttacttggtgtgttttttgtcttataattgtgttgtaagtgttctttatatgttggtagatacaactcccttgttcaatatatgtattgtgggccagacacggtggcttatgcctataatcctagtactttgggaggccaaggtgggtggatcacttgagcccaggagttcgagaccagcctgggcaacagcaaaaacgtgtctctacaaaaaatataaaaattagctgggtggccgggtgcagtggctcacgcctgtaatcctagcacttcgggaggccgaggcgggcagatcacgaggtcaggagatcgagaccaacctggccaacatgatgaaaccccgtctctagtaaaaatacaaaaattagctgggtgtggtggcgtgttcctgtaatcccagctacttaggagactgaggcaggagaatcgcttgaacctaggagacagaggttgcagtgagcccgaggttgcaccactggactctgacctgggcnnnnnnnnnnnnnnnnnnnncctgtctcaaaaaatatataataataataataataataataatgatgataataataatatattttatgtgaatatcttctctcaggctgtagtttgctattttattttcttagttgcctcttttgaggagcagacttaaattttgatgaagtacagtttgtcaatatttttatagttcatggtttctatgtactaagaatccgttgcctaccttaaggtaacagattttttcctccatattttctactgtagttatgaaaataggtttgtgattcatttggagttaattttttgtctatgttgttaggtgttagcgttgaggttaattttttttttttttttttttttgagatgttgtctagctccgtcgctgaggtgggagtgcagtggtgtgatcttggctcactgcaacctccacctcccaggttcaagtgattctcctgcctcagcctcccaagtagcggggattacaggtgcctgccaccacgcccagctaatttttgtatttttagtagagatggggtttcactgtgttggccaggctggtctcgaactccttacctcatgatctgcctgcctcggcctcccaaagtgctggaattacaagtgtgagccaccgcgcctggacttttttttttttttttttggtccaaatggttagctgtttgttctagtaccatttattgaaacgacatttattaggttggtgtaaacataattgcggtttttgcattgctgaaatttgctgtttgatattggaatacattcttaaataaatatggttatgttatacatcattttaatgtacatttctcgctttgtttttttgctaatgacttactactggctgtttaatttatatttagagtatggaaatgatgttagacaaaaagcaaatctgagcaattttcttatttgagtttaaaatgggatgtaaagcagcagagacaacttgcaacatcagcagcgcgtttggcccaggaactgctaatgaacgtaccgtgcagtgatggttcaagaagttttgcaaaggagatgagaaccttgaggatgaggagcttagtggccggccttcagaagttgataacaaccaattgagagcagtcatcgaagctgatccttttaaagctacatgagaagttgctgaagaactcagcgtcaaccattctacagtcgtttggcatttgaagcaaattggaaggatgaaaaagctccatgagtgggtgcctcatgagctgactgaaaataaaaaatattatcattttgaagtgttgtcttttcctgttctacaagacaatgaaccatttcttggattgtgatgtgtgatgaaaagtggattttatatgacaaccagcgatgatcagctcaatggctggaccaagaagaagctccaaagcacttcccaaagccaaacttgcaccaaaaaaaggtcatggtcactgtttagtggtctgttgctggtctgatccactacaggtttctgaatcctggtgaaaccattacatctgagaagtatgctcagcaaatcgatgggatacaccaaaaactgcaatgcttgcagctggcgttggtcaacgagaaatgtccaatttttctccataacaacacccaactgcacgtcacataaccaatgcttaaaatttgaatgagttgggctatgaagttttgcctcatccggcatattcacctgacctctcgccaaccaaccaccacttcaagcatctcaacaactttttgcggggaaaacacttccacaaccagcaggatgcaaaaaatgctctccaagagttcgtcaaatcccgaagcatggatttttatgctacaggaataaacaaacttatttctcattgagaaaaaggagctgatgtaatggtccctattttgattaataaagatgtgtttgagcctagttttaatgatttaaaattcacggcccaaaaccacaattacttttgcaccaccctaatacagcccgttgacttgacttggcaataccaagcttcttaaatttatatttagtgttttattgataccacaagttcagatattttttgttgttaatagaattcaaggaaataagtaatcttgaatggtttctgctaggtcatagaacagtgatgataaatttctccagattatcagaattcaatttttcactgattcattgttcttcaatttgatatcattttacttttaggtgttacacataatattgcattacttcgagaggtgataatcaactcacgctttgtaaaaggagacatcagcactaaatttctctccgatgtgtatcctgatggcttcaaaggtttgtatgcattaaaatattttagtgttttaaagttgttatttttatactttattgtaatacataatttcactctattttgaaattaaggccttttggcttatattatacttcatttttagaacatgcaagactgtttacattcatgattttgagtatttatggatgactcatgagtgtgataatctgcagtcttgtggagtgcagaattcaaccatgtgaattgttctatgagtccagtgttttggagcaaaacatgtagatagatcattagcctacctgacttcctggtttctgaaaatcaaatcagatttgtattttctactgaggtgagtatataaggaactcttctaaagtgatttttaagagatatattaatgaaaatagcactgaaaatttcagaaaaccagattctggtcctattaatgaaaatctaggaagatgatgattttattctgaaaaatgaagttttcaataaagtaatgagtggaatgtgaaatttaacacagcaaagttatcagcaagcatttccaggtagtagaaaaattgctcatcaaatgggagatagagaaaaccctttagtgagcattcaaaacatagttaacataagatattgagagataaacaagatttagactgagacttaatagaaatgttactcaggtgaaagcctctacctacatttttaatgagctagtgaggtatgaaggttagatagtctgtcccatatttcaagtgttctttgtatccattaaagtgttttaatgtaaaatgactcacattcatattaggagctatatatagattcaggtcaagttgatgtcgttgagttgttgggtgcatttataaagcagttttcagttcagaatttacaatacagagttttcataagactcaacagagataactgatttgaatattgttttaaaactttagtgttatagagttttatcattagtattaaggcaaatgaagaatggctctaagttgggatcttaaaacaaaaactaatgatttattaggttgtttttcataaacttttgaatttttaaaaatacaaaataaaatacaactaggatagtagttttatacttttgtgactattcttttaatatttgttggtttaatgaggctaagaaccccttacgtcattgcttttcattttatccctagcacaaaacatagtaggtactaagtatttgttgaattaatgaaaaaaaaaaaaatcttagccataatattgatgagaaaggattactttggatttttttttttttttttttttttgagacagagttttgctcttttgcccaggctggagtgtagtggcacagtcttggcttactgcaactctgccttccggtttcaagcgattctcctgccgcagcgtcccaagtagttgggattacaggcatgtgccactacccccagctaatttttatatttttagtagaaacggggtttcaccatgttggccaggcttgaactcgaactcttgacctcgtgatctgcccgcctcggcctcccaaagcgctgggattacaggcgtgagctaccgtacctggccgctactttggatatttttaatcatttatacatgtatccagataaccagttcattctattttgatcctaacatttagtttcttgtccttcctaaaattttaattaaaagttgtagtacgttttgaagtggacttaggacttccatgtttttatgtctgcctggcaattcagtgatggtgataagataggaaacagtgggcaggaggagaaaacagggaaaaactacagagaacctttagaacaaacattatatgcatgtatgggtatttatatatatatacacacacacaaatacacatttatatataagtttgtctatatgtatgtatggtgaagtatcccagagaagaagaaaatggggcatttaaattttctaatcagagttgattagtatgtgctggacgtttagcaacaatagagaatatcccaaattctgtagagaagggatccccttcaaactcagaaatgtacttaaacctagatattgcagttttctgtgatgcatataatatattacatttctttttttgtaaggaattaacagcttggacaccacaattttgttttttatgcttagaccaatttttaaaattggcatacattgcttttagcaattatttagttgcagccttcattttacatgtgaggaaactagagctcagagatatcagtaaagctaaatgaccagtaagataataatgccaggaattgaacctaggcttattcaactcctatttgagtagtctttgagttatgctggggttcaaattcataaatcacaaatgttttcaatcagggtatgctacatgttgttatattgcctctaaatactttagaaacacactcctatatttgccattcttaatgtctccctcttgttttattttcttattttcatatcagttcattcttctttgagtggttactgtctgtcattcttcttcagattgctgtattttccccctaaatcaggtcttagatattttaaactgtatcgtcttttgactgtttgatatatgtgcccaagagactgaaggaagtggtaactacagttaatccaggatcctctccatatgtttggggccaggtcattttgcccctttggggtttcccatctgcttcccatctgttcagctatcctaggcactattcacaggcaagcacctatttttatgactgcattaaaattttctattgtatatgtttattatcccacatttatttgtatgtagactaagccagttttactagagattcttagagttaaactttgaaatgattgcttctaaaattaaaaaataggatacatgagaaattattcttgtcatctctttagatgtggatgttgaaaagcggtttcccttgattctgaaaaataaatggaacatgaggaagaagatattttaagaactataatttcatttggcctataatgaacattttgggcttatttctctgataccttcctatacttcaaccccaagccccatcgaaagaaattgtcagaattatctcattcttttaagaagttacagatcttctggtaaaaatttcactcaacacaaaaagtatataattaattatacttctcttttttccactgaatttagtcaagtatatctacactttaaaaaatactactatgatatttggactgaattcaatcattaaagtcattcaacaaataattgatataggctctagaagaaaatcaaagatgggtatattttacctgctcttagtgagctgacatcatgagagaaataataatgtaaagtacccactatactacaggacaggataaagtaagtgcctggtaaagatgtaagcaaagtatcttgacagaagagaaacaaaacaaaacaacaacaacaacaaaacaccggaaacccagttccatttgagggaataaagaaaggctttaaggatgaggtagcatttagactattggaatacctctccggggactctctccatgggagctgggctgcacttgtgagagccatgtgtgcacatctttataagccatcctctttgaagttggtagtttgtaatcagccatgaagaaagtatttactgtaaggaaattggttgtaccctgcggcttttctccttcccccacaccccagttgtttgttaagcatttaccagcaaaccactgcctaactctttggcctgcatattgagcagagtccctgatgtaaaaaggaaaagaattactcatctagggaggaagacctagaagactcactaaggacaggtggtgctcagttttagagctgctgttgtaggaggcagatgactgtgcttactgaaaaatgggaagaacacttaaaaatactgaattagaggagaaagacttaatgaactaaaaaactgtgatttttctaaataaaacaattcagcagtcaatgtggaaggtaggatggtcactactaagatccaaattagtgactcaaaggaataaatggaagtatctcaaaatatgcagcaaaaaggtaaagagaatgaaatcatgtggaaaatgatgagagatatggagggaagatccaaaagattttacacataagtgcatactaggagtttcatgaaaagaaaaatggaaatgaaggataactttgaaagaaataatagagatttttttctcactgttcttaagaaagccttaggtattcttggaaagactcactgagattcagactggattaatttaaaaagtaactccactaggcatataaaaaacaaatactttttaaaatcttctaaaagaaaagaaagaagatgcaaggaatgtacagtgagattatgttcatactctataaactggaagttagaaatcttagaatagtgtctgctacataggaaagaatttgactcaagagtactatacccagctaagatatcgtcatcaatataaacaaatttgttttcagttaaataaggattcagaactattttaccatatatactccttttgaggaaattgctaaagaaagtactttaaccagttttgaggtaagatgatagcttaaaaatatacatatttttccccctacccccaaatccactaacttgagttttttaaagacacaagcccactaggaagaagaaaggaaatagcatttggtaaaatgaacagctgaaagatgattcttaactgacttagtaacctaagaaagttgaatcctaagctgacaatgagagaaactgagaagtagctcattaccactgcagaacccttcagaagtctcaataattattagctccagataccctgggaaattcctaaaggtagcactactgacctaaaatatctgtaaaattttctccatatcacttccctcactcttcagagtaaggcgactctctttccctcatcctggtgtaagctttcagattcttctctgcagaggataaaaaccaggggacaccaggcacagttggacaaaggatcgagggaacatggacataataaatgtggtgacactctctgccccagctttgttcctcagttggttcccaggggactggcaggcagactggtactcacagacatgaaagtagacgatccttgaaaaatctaaccccctggtgagatgacctaaagattccccaacaaaacagtccagccagattaccctacagacaaagctgccagtggtcaacaaagccatagcccacgaagagagaacgggcctggattagaatcaggacctctatctgcattatttaatacaacactgtggccgggcacggtggctcatgcctgtaatcccagcactctgggaggccgagtggggcggatcgcctgaagtcaggagtttgagaccagcctgactaatgtggagaaaccccgtctctactaaaaatacaaaattagccgggcatggtggcatgtgcatgtaatcccagctattcaggaggctgaggcaggagaatcacttgaacccaggaggtaaaggttgtggtgagccgagatggtgccactgccctccagcctgggcagcaagagcaaaactctgtctcaagaaacaaaaacaaacaaacacacacccaaaaaacagaaaacgctacatgtaatgggaaccagcgcgtagctgttaaaaataaatggtagacctaaaaccactcgggaaatacacaggtcaggcttcttgaaaactgcatcatgccaatgagggtggccagtagcatgagggtcatagtggcatgtcacaaagcttgtaggtgctgttacatggttttgaactccagtaattagtggcttaatgaacaaggagaggagataataaacattgtttaggggttgggacttttgcatgaaattatccccccaaaagtttaagaaggtaagagttcgttgtgaggaggaaggtttttcttctttcagtcacaaatacttatagagcctgttgggtaaaagattgtgctctaggctctgggaatacagaggtaaaactgtcaaaaagcctaaggcttttagaaccaagagttgcagctttttccagccatgtcttcactgaagagcccactgtgcccagcctcgttgacttcgcagtagaggctctaagcttgaatgttgtgaacgttccaaggctgggtttaagaaagccttagaactccatctagacctgtaacgagtacaagtgacttgctcctctgaagagtgcttgaggctgcatgtgtcctgcatgtgaggctggagctctcagtccttctgcctcctcaccacctgtattccacatgcacccagcagcacctctcagtcttctctgtcggggttgggggagagggtaaaccaagtgtcagattacagcactcttggtttacgttcacactcgctaaaaggggtaggaagaattggagagcttttaaaatacttaccgcgcccccaagttttaggtgtgtaggattcatcagtaaacagaaaaaggagctgccctcatgggacttacattccagcaggttagcaggcagcatgcattcccagctcccctcatggcagccaggcagggtttacacattagaagctgctcagaaaagggaatgaggtacattcaccttagcttactagcccagaatgcagtgtcagtgtgtctgactcaacaccaagctggtctaccacccccagagggcaaacagtggagaccgttcaaagggagctcaaggtcagagccagggaagacatgccttacttagtatcaggccgcaggggaacttgcagaagtcaagtccactctggcctgtgatcaggagtagcattatgctaaaatcgttgtaagaataggtcagttatgatcagacttcttatacagagcctgttggaactgagtaccccccttttgaagtggaatatcagtaaaatgcttgaagttgatgtgcatcatatcagtttgcctgggagatgtgatgaatgatggtccattttatttgggagacctctctcaatattgcctgagtccatgcactaatagttggttagaccagatgaaatactgattgagcatcttgcagtgaatgggttcccctaatgcattgcctcctcccttgctgatggtatatacggtgcatatgtgtctaaagaactgacttgtaaaggactttgattgtgaaccaccatgagaaatacattttacatcctgacatagtatgcacatataaacacacacaacattttcatgtaaaatactgtgtttaaagtgctatgataatttgtcttcctgcacatgacacattaaactggcttcatgaactactaaacagtttctttacacagtttgataaatatcagtccagaacagttgtattcaaagtgagatctgctgactggcagcatcggcatcaccctggagcttgttagaaatgcagattattaccccttgccctcataccttctaccagtcagtctgctggtgaagtgcacacagcatctttaatccaggtgattctgatgtttggtgaagtttgagaagcactggttctttttacactccagagagcttttgtgattatatatattgatatttaccacattataaattaaaactgaggaacttgaaaatatttattcattcattctgaaagtaatggtaataaatccattacgtgttgacatgcatgagagcagtgatgtcatcacacaatatgtgtcccttggatctgggaacctctgcagtatactcttgagaaaatgagagttaaaaaagcaaatatattttagtagtactatgaaaatcatttgaccttgcaaggactcctggggactcccagttgttggcaggtcatgctatgagaactgttcttctcaactgtatgttttgacaagactgagagcaaatttttgtaatacttcttatatagagtaattatgtaatcatatgggatgttttcatcactgcttaggtgtcaggggaaaatgaggaactttccaatgcccataagagtatggtttattaggctgttgtgaggatctagtatggaattcccagaaccagttggtagatcccatatttgtattatgttttatgtaatgtctaggtttgtctcaaaagagggtggattacctgtgctctccctgcccttcagggagcagatagattacttccctgtggaaaattgtgctgtagatattggaagtatttgtatcttaattttgaatatttttagtcttatttgtattttgagtgattttttagacataatgtttaaattacttcatttcttccaaataagtttaggcaactagtttttttctttttttgaattgtacatttgtttcttggtatctgtgggtgattggttctaggaccctttcaggtacaaaaatccacagaagctcaattccccagtgtcgtatttacatataacttagacatatcctccctgcactttaaatcatctctaggttacttataatgcgtagtacaatgtaaatgctgtgtaaatcattgttatactgcattgctttgaggaaaatgacaagaaaaaaaagcctgtacatgttcagtacagacaacaatacattttttttctcaaatattttcaacctgcagttgtttgaatccatggagggtcgactgtaaaagtagcaccttatggctgacgagccagcattcaagttgctcatactgtcccatttaatactctactatctgtatgtagtactctggtaaataaatagttttagatttgtggtgaagttacagagctgtcaagggatgtgttaacctatagaccctggagtatttgaatcctaccttgactcacaaccttcttgaagaattacgcaaattcttcaatcagtcactcaccccaggcctttgcggccagccgactatcccaggtccagctgtgtaatggtaggaagatactgtgagtgagaggaggagagagattggttggttgattgggattcatgcagagaagcagaagaatcacggcgtgatattctttggatcttcgcaccagaaagcatggcctcatctgtgtccttgaccagccgctctccttttctccagggacaggggcttcttgcacgctatcctcacttccctcagcagggaagctgggctgggaaaggacagagagaagcagatgtgaggagcttatgcttttcctggagatctctgtgtggatggttttttctttttaattgtctttgttctgtgcatctgttgaatatcttctttcccaaattaaacttctttcccaatataaacttcccgtgagcaggattttgttgtcttatttgaatggtcttgcttcctcaatgtccgcacaccccagtgcctagtacaatcctagctgcataatagatgccctataaaatacttgtttgaatgactagtaattctataggagagaagcacagatgttaaaataaatgattgattgattgattggttgattgatttccctcaggacacatgctaaccaagagtgagaagaaccagttattggcaatagcatcatcattgtttgtggcattccagttaagagcacaacattttcaagaaaattcaaggtatggtagatcatttaaaacagaataaatgagcagaacaatattgataatccagtctacataggaaatactaataaaagatgtggctgatctcagttctagagatcttatgggtctttggagaagtataataaagtcacactgtataaatatgatattgcttacattttgtttaaacaagtttttttaagttcagaaaggataaaaggatcttggcccttttaatttggacataagaagatagtctgaaatccgatgggaaatccattcgagtagtttgtgtttatgatttctgttttatttacttatcttgaaaaacgtttggagaagtatatttaaatgtaggaatgaatctgggcagttaaaaaaatatatatcagaaactagtgaacacacaagaaggaattaacaccaggttgagttagtcatttgtgagacacaagtgtgccttttagcttcctagtgacccaggtaaaaggagaacatgctttatatcagggtaagtagaaacaaaacctcaatgccattggtgcttctagagagaggattgtttattatgaatgtgtgtttacttgctggagcaatccctttaaaggaatcatgctgttgataaattgttacttcagtttcttttcctttttactttttcacaagaggaagaacaaagtttaaaaaaaagaaaaaaaaagatggaaggtgatgaactagctttgaaaagcacaaatcagaaactgaaattacttctgaagaattaggtagaggagaaactaaattggatttaggctgtatcttagtggctaatgtggttttattcaggaaatctcagtgtagttggtactcttcacttgttctctttacctagaaagaataggaagcttacagtgtatctttttaaaagttatgatttggtagctaccagggagagatgagaggatatagaatatcagtaaatgactgaatgactggacggaggaggaaaatggtcaatagaaccgtgaatctgcttgtgcatctgtttaatatcttctttcccaaattaaacttctttcccaatataaacttcctgtgagcaggattttgttgtcttatttgaatggtctttgctcccccgatgtctgtacacctcagtgcttgttgtttggttgtttcccccccacatagttgtgcggtctagtatgggaggcactagccatgtatggcaattaagattaaagtgaatggaagaatccttttcaaagttaccggaaacgtggctacatttcaactgttccatagccacgcgtggttagcagctcctgcactgggcaactctaagaggctttccaccacagcaggtgtgtttccatcaagttctgttggacagcatttgtctggagggatatgtgtgtaggagagaatgttgcttttgttttaaaacctgaatttcatattttttattcttttgataaatgcagtattcagatcctaattcctttaccttcagatgttatttggaccttgattatttcagaagttctgagtgtagctaaatatgactggtttgatttttaagaaatgtatgcaagttattttcagagagtgctgccttactgtgtggaagaatctgaaaagggcttaaaaagatggagaataaaaattacctgtaatcccataattattcaataattacttttaatgttttggtagaacccttcaaagtatatatatatatatatatatatatgtatttatgtgtgtgtatatatatgtatttttatatacatacatgtagcatttatactttgcataattagagtcataaacctgggaatatggtttgaattacttgtgcaagataaacagcagtatattgaacacccatgcacacattatctagcttcaatgactgtaaaaaatctatcttccttgtttcatttttacctctacccactccacactttccccatttgttaattttttaaggtaaaatatacaaacacacatatacacttcttacctgtacagtttttgtttttgttttttgagacagagtcttgctctgtcgcccaggctggagtgcagtggtgcgatctcggctcactgcagccttcatctcccgggttcaagcgattctcctgcctcagcctcctgagtagttgggactacaggcatacactaccacatctggctaatttttttttgtattttcagtagagatggggtttcaccatgttggccaggctggtcttgaactcctgacctcaggtgatccacccacctgggcctcccaaagtgctgggattataggcatgagccaccgcgcccagccttacctgtacagttttaacaaagggatgcttgtgtgtaactcagacgactctatctttacatcgtctcttccagtgcactccctgcctccttttgcttgtggtgctacctgcggtgtgatttcttcagattgcttttttggtaaactttttttttcttttctttttagagagatgaagtcttgcttttgtcgcccaggctgaagtgtagtggcacagtcataactaactccctgcagccttgaattcctgggctacagcgaccctcctgcctcagtgtccctggtagccaggattacaggaacataccaccacgcctggctaatttctgtattgtttgtaaagatggggtttcaccatgttgtccaggctagtctcgaactcctgggctcaagtgatccagtccaccagccttggcctcccaaagtgctggaattatagacctgagctgggcgaaaccttgtgtctgctaagtacaaaaattagcgggggcgtggtggcgggtgcctgtaatcccagctactagggaggctgaggcaggagaattgcttcaacccaggaggcggaggttgcagtgagccaagaatgcgccactgcactccagcctgggtgaaagagtgtgactccgtctcaaacaaacaaacaaataagctaaacaatctaataaaaaacgggcagtaggtttgacttagactttttatcagagaagataaatgaatggcacataagttcatgataagatgctcagcatcatcggtcagtggagaaacaaaatcacaaatctataccactacacacccactagaataatatgcatcaagtaatgagtgggtaaataaaaagtggcatatccatactatgagcttattcagcagtaacaaagaataaacagctacattcactaatgtgtgtaaatctcagaaataacatgtgaagagacagaaaccagataaagaagactatgtaatgtatgacttcatttatttgaaatttctagggaaggcaaaaagtataaagaacaaaagaaagatcagtggttgtctgggtctgggtatgggagcaagattgactgcacatgagttttattgttctaaaactggattggggtgatgggtgtacaactgtatgaatgtattacaatctcacttgatcttagccaaaaggccgagaagtgatataaatgtattacaatctcatcagactatacaattaagatgtatagatgttattggccaggtgcagtggctcatgcctgtagtcccacactttgggaggccaaggcggactgatcacatgaggccaggagttcgcgaccaacctggccaacatggcgaaaccctgtctgtactaaaaatacaaaaattagccaggcttggtggcgcatgcctgtagtcccatctactcaggaggctgaggcacgagaattgcttgagcctgggaggcataggttgcagtgagccgagatcacgccactgcactccagcccgggtaacagagcgagaccctgtctcaaagtaataaaaagtaaaatgtatagatgttatacaagtaaattatatcttaatgcaacttaaaaaactgtaaatgtggtaccaacaaagggcttgaaagaggtgggaagtattatgagaagtgttaagatgatggaagatacatgtaaaaataaattgtattcgaaacttgagtagaagcagatattaaggagtcaggttactgacttggaagacctggtggatggtggtaataacaaaagtgcaagagcagctttgaaaagaaaatatgagaagttccatttaggcagttgagtttgagatccttgacaggcataattgtagctcctaaagacttagcaatatgatatattcctatccctttgactgtttcttctttaataataatatatatgcccctttgagcccattaggaaatacttggggcatgcttttgtactcattagttccatgatttttttgtaataatcaaatgcacacagttttagacttcaacggtgttccttaatgtgtgctccatagagcgctagtttgggggagtattaaaatgcattacttaagaaaatgtttctgtgtttaaataaacgtggaaaatcccttgttaagttagaaacctcttagagactgtcatacaggcacacctcatttcattgtcctttgctttattgcacttctcagatattgcattttttacggattgaaggtttatggcaaccctgcattgagcaagtctttttgtgctgtttttccaacagcatgtgttcactgtctctgtgtcacattttggtaattctcattacatttcagacttcatcattattatcatatctgttttggtgatctgggattagtgacctttgatgttcccattgtaattgttttggggtgccacaaaccatgcacgtgtaaggtggtgaacttaattgacaaatgtgtgtgttctgattcactgacctggccattcccagtgtctctcactctccttgggtctccctattccctgagataaagtaatattgaagttagactaattaataacaaagcagtggcctctaagtgttcaagtgaaaggaataagtagcacatctttcactgtaaatcaaagggtagaaatgattaagcttagtggagaaggtatattcaaagccgaggcaggctaggcctcttgtgccaaatggttagccaagttgtgaatgcaaaggaaaagttcttgaaggaaattaaaagtgctattccagtgaacacacaaatgataagaaagtgaaacagccttattgctgatatggagaaagttttataggtctggatagaagatcaaaccagccacaacattcacttaagtgaaagcctaatctagagcaaggccctaactctcttcaattctgtgaagggtgagagaggtgaggaagctgcggaagaaaagcttaaagctatcagagcttagttcatgagatttaaggaaagaagctgtctccataacataaaagtggaggggaagctgcaagtgctgatgtagaagcttgcagcaagttatccagaagatctcactagcatcatcgatgaaggtggctacactgaacagcagattttcaatgtagataagacagccttctattgaaagaagatgccatctcatactttcatagctagaggggaaaagtcaatacctggcttcagagcttcaaagaaccagctgactctcttggtaggggctaatgcaactgatgacttgaagtagaagccagtgctcatttaccatttcataaaccctagggtctttaagaattatactaaatctattctccctgtgctctagaaatggaacaacaaagcctggatgacaaaatgtacatttacagcatcatttactgattattttgactccactgttgagacctacttctcaaaaaaaaaaaaatttttttttcaaatgattgctgctcattgacagtgcacctggtcacccaagagctctgatggagaagcacaaggagattaatgttgttttcacgcctgctaacacaacgttcattctgtagctcatggatcagggagtcattttgattttcaagtcttattatttaagaaatacatttcacaaggcgatagctgccataaatagtgattcctatgatggatctggacaaagcaaattgaaaactttctgggaaggattcaccattctagatccccttaagaacatttgtgcttcaatgggcaaaataaaagatcaacattaacaggagtttggaagaactggctttgaggtgttcaagatgtcattgaaggaaatagctacagttggggtggaaatagcaagaaaactagaagtggaacctgaagatgtgactcagttgctgcaatctcgtgatagaacttgaatggatgagagttgcttcttatggatgagcaaagaaattttgcttaaaaagcaaagtttttaagatggactctgcttctggtgaagatgctgtgaacattgttgaaaaggattttagaatattacattaacttagttgataaagcagcggcaagttttgagaggattgactctaattttgaaagaagttctactgtgggaaaaatggtatcaaacagcatcacatgctacagggaaacctttcatgagaggaagaatcaattggtttagcaaactttattgttgtcttattttaagaaactgccgcagcctccccagccttcagcatccatcagcctgatcagtcagcagctaccctctatcagcaaaaagattatgactcactaaaggctcagatgagggttagcatttttttagtaataaagtttttttttttggagatggagtctcgctctgtcgcccaggctggagggcagtggtgtgatcttggttcactgcaacctccgcctcccgtgttcaagcagttctcctgcctcagcctcccaagtagctgggactacaggcacatgccaccacaccccactaatttttttgtattttttagtagagacggggtttcaccgtgttagccaggatggtcacgatctcctgaccttgtgatccgcctgcctcggccatccaaagtgctgggtttacaggtgttagccaccacgccagcctaaactactttttaattaaggtttgtacattgtttttaagagctatcgcacacttaatagactacaacacagtgtaaacgtaacttttatacacattggaaaagtaacaaattcatgtgacttgctttattgaaatacttgcttcattgcagtggtctggaactgatctcacagtatctccaaggtattcctatatactaaaatgcattctgaaactcttaagagcaggatatagttggactcttacctacactctttttttcttgtgaaaacctttttcctaaaagctctttgaaaaattaatattccaatgaatgcttttgggaaacacagagtatgttatattgtgatttgtagtgttttagatagtttaaacacaacattccttagagattgttgaaatatttagggcaattgctttataaagtggaggttaagaagcaatctttatagtctttgctaatttctagctaaaattgtaaatgtgataattgctacattaaaaaatttaagtatcttattttttaactcattatcttttagaagttagaaacaaaatatgtatttatgaaatatgtagactgcaagttcacttatccagataattgcacatttattttctatacaacaagcaattgttcatttttggtgagtttattttctgttgaaaaaaaggtactatcacttatttagtattatcagtttattgtaaaattgctacaccctataacagtgtagagctgtaacatttagtaaatatagtgttcttcttcaggaagcataatcttgtgtagctaagtgaagctatgtttctggcttgcttactgaggaggtccttgacacctacatcatgaaagctgatgtacggtgtttgaaccttcacattttggctttagagtcatgttttcacaatcggcttgggaatggattctaagagtcaccctccaggtgtggctctgtattgctttgtcatgggtgtgtccgtgaaatgtttttccttccaaaccagtagcccacagcccttcctttgtgttgcttgttttggctgctgatcttattttcccaatttctctatgggcttcactctttcatcatttatgacttggaaaaacacattaataatacatacccctagtatttggatagtaaaacaatagtggttcattttagaaaaaaagaaaagttaatgtcagaaacaatagccattttttgggggatgactataaaatgaatttgatgagctcaatctttttctgacttaccatgaaggcttctttttaataattattcttaaacacttatattgacagaaatgaatcattaaaagctagttatattaaacaaccactttttttaaaagctaaaatgattttgttgacattgtagtttgatataataatttgtttcactaactggtaatgattggaagaaaaaatagtaaaggtaacattttaatcatttttagtaatctttatttttgctcaaaatgtctgttttttcttggatctggattcagctttcttgagaatcagcttttactttccgttttttttcctttctttctttctttctttctttctttctttctttctttctttctttctttctttcttccttccttccttccttccttccttcctttctttcttttctctctctttttctctttctctcttcctcccttcctccctttcctttctttcttttctttctttccttccttccttccttcctttcttttcttttcttttcttttcttttcttttcttttctttcttttctttctttctttcctcagtcttgctctctcatccgggcctggagtacagtggtgtgatcttggctcactacagcctctgcccgctgggctcaagcagttctcctgcctcagcctcccaagtagctgggattacaggcatgcaccgccaggcccggctaatttttgtattttttgtttgtttgtttgttttgagacggagttttgctcttgttgcccaggctggagtgcgatggcgcaatctcagctcaccgcaacctccacctcccaggttcaagcagttctcctgcctcagcctcccaagtagctgggattacaggcatgcaccaccatgcctggctaattttttttgtagttttagcagagactgggtttctccatgttggtcaggctggtctcgaactcctgacctcagataatccacccacctcggcctcccaaagtgctgggattacaggcgtgagccaccgtgcctggcctaatttttgtatttttcgtagagactgggttttgccctgctggccaggctggtctcaaaatcccaacctcaggtcatccacctgctttggcctcccaaagtgctgggattacaggcatgagccaccacgcccggccactttctggtttctactttatcctcataatttccctcttggtatttgagcaggggttaaagactcagaaaaagaaacaacttcactatggcctataatattaatggaaatacttcagcctgaaaggttaaaataaagcactccctttggtggaggatgactttggctgcatggaatcagtgtactttgtgctcaggcttaggagaacatatcaagttatcacggctggctacacagcctggtgtcagtttaactctttcagccacagtagcataacgggaaattacttcctcttgggttctttgtatgtgcagtcattgtgtctgcatttgtattgtattatctttcctcatctggcttcctgataaaatggagaatcgattttttagtgatttctgcctagcagagacaattatctgtttatttttctttgcctttcctggtttcagatatagaatttattcacctgttattaaattttcaattagatgataaaagtttaaggtttttgaaatatgatcttaaccactgaaagatgagtggggtgagaaacatagaaaaaagtaaccgtgtgaaaataattcccaaggaaaagccggtattgttgaacgggtacatactggctcttttactaagatgtcttctgaattaaaagagcatgtgaaattataacacatttatacgtcaatgaaaataaaacaacttatcataactcgtttcatactctcagataagccacttcactgtgacaatgaaggtgacgtgatacctaactatacaataaaaaaaaatagcactttaagtatatatttacaaacgtatgtatacactctttgtgtttggaaatagctacgttcatttgagcaaataaatcccctaaaagcaacaagatgggagaaaacattaactcaatcattatcacttaagcttgccttactttttactgtctctgttatgatattttcagttacttaatatgactgtgttgaagatggtttagaaatctatgtgagattaagtacaagatactaagtggataagaaagcacatttacatatttttgcttactattacattgtaaaatatttttattttgatcctactataagagctgagggaaaggcagaatagcctgattattgctggagaatttctctgttccctaccatgattccagaagctcttgcacacttcatcagtattattgtaattctttggctgcaggatatttggcagctgttgcaccccactggcaaatcctattcatacttctttcccattcaccattgccattggagaattgatttctctctcctctactctaacctttcccaattcattttggattgttcaatgtgaaacattttaatttcatatcatacagctattcagcttacaatcccttttttaacctgtcaccagggtaacagcatagcatgctttctttaggcaatcaagtttttatttcacatgcttaatgttgcattaaatgtttgcattttgtttaacccccttaaatagtttgaactctggatatgttttatagggtaatgaaatccttgatttttgaattgaaactaaatcaacaccatcagtgcatttataataaaatgtcaaaagattaatttccataatacaaagattattattaaaaacgcaagttagctgatctgtgtaaggcaattttctgtaggtaatggaggaatatttgtatatattatatttgtgttcagccttgttccaaaaaaagatttaaaagtggtttagagattgtcagtgagataagtaaaaaacttaaaaaaggaatagatttggtgcaaatgggaaaatatatcttttgaacccattatttgatttttcagtataatgcttttttctctgttcgtatatatgaagatttgattacttgatttttcagtataatgcttttttctctgtttgtatatatgaagatgtgattacttgatttttcagtataatgcttttttctatatttgtatatatgaagaccataatgatttatgcatgtggagatgggtgaagtaacgagatgtactagaatgagattagacatcttttctaggagaccagtgtgggcattgtgtgctttaatatctcttcatcagtttactttagaactaccttttccttaaaataagtaatttaataataatagattagtgaagataaaaatgcatatgtttagatattgattatttgacttgaattggatagacctcagtttccctttacagaactacctagtcatcttttcagccttatccccaataatatgttcaatgaaatttgttctgtgaataaatcctgtgatatttggaaaatactaagaaatgtgtaagacaaggtagagcagagactagcaaaccatgttgcttggaagcatggttcaaattgtaatgcccggggtaaccactaagaaaataactttaaaaaatgagtattagtaaaagaaaagtcaagggaattaaaataagacaatagaaaacgttgatttaaaacaagacaataataaaggaatagagggagaaaaaagatatgacatatagaaagtaaaaagcaaaatggtagatgtaaatcctacctgatgggtaattaattatattaaatgcagatggcttaagcctatcaagagcagatactgacagaatagatttaaaaatatgatcaaaccatatgctttacaagagacacactttagagttaaaggcataaataggtcaattgtaaaaggatggaaaaaagtatcagacagacattgtattcgtaatattattatcagtattttattactaataatgctgatgtcaaacaaaatagccttttttttttttttttgagatagggtcttgctctatcacccagtctggagtgcagtggcatcacaggtcactgcaagtttgaactcctgggctcaggtgattctcctgcctcagcctcctgagtagctggtactagagtgcatgccctaacatttggctatatatatatttttaaatagagatgaggtcttgctatgttacccaggcaagtctcgaactcctgggctcaagtgatcctcccacctcagcctcctgaagtgctgggattataggcatgagtcaacacacccagcctttttttgtattttttttttcttccagagacagggtcttgctctgtcacccaggctagaatacagtggtgtgattatagctcattgctgcctctaattcctgagctcatgtgatccttctgccttagcctcccaaggaactaggactacagatgtactccaccatgcccagctaatttttaaaaatctctttagaggtaggtttttcctatattgcccaggctggtcttgaactcctgacctcaaatgcctggactcaagtaatccttacgcctcagccttccaagtagctgggattacaggcatgagctgccaagacaaaatattgttcaagacaaaattattgctagagacagaggggtattttataatgataaaagggtcaatccatcagaaagctataacaagtataaacatatatgtacctaataacacaattcccaaatatgtgaagcaaaactgagacaaagagagaaataggcaattccacaatacatcactttgaaaaatggatagaacaactagagagaatatcagcaaggaagtaaaagtgtcggacagccctatagaccaaatagatctaacagacatctctagaataatctctccaacaacagcagaatatacctgtctcaagtgcacgtataacattctccaggctagaccatatttaccataccatatactaggccataaaacaagcctcagtaaatttactagaattgaaatcatccaaagtatgtttctgacaaattaaatgaaattagaaagcaacaaggaaaatttgggaagttcatacatatgtggaattaagcaatgtactaccaaataaccaatagatttacaaaattacagaggaaactagaaaatattttgtggttaatataaacatcacaacatctaaaaacgtgtgggctgcacataagcagtgcttagagggaaatgagagctgtaagcacatgtattaaaaaaagaagaggccaggcaaagtggcttacatttgtaatcctagcactttgggaggctgagacgagcagattgtttgagcccactagttcgagaccagcctgggcaacatggtgaaaccctatctctataaaaaatacaagaatatgctgcgcatggtggcacgtgcctatagtccttgctacttgggaggctgaggttggggaattgtttgagcccgggaggcggaagttgcagtgagccaagatcgtactactgtactcctgcctgggtggcaaagtgagaccctatctcaaaataaaagaagaaataaagctgggtgtgggtttggtggctaacgcctgtaatcccaattctttgggagattgagactggaggatcacttcagcctagaagtttgagaccccatctctacaaataataataataataataataataataataataataataataataaaataattcgctgggtgtggtggcacacacttgtaatcccagctactaagaaggctgaggtgggaggatcggttgagcccaggaagtcagggctgtagcagtgagccaagatcatgccactgcactccagcctggctgacagagtgagaccctgttgaaagaaagaaggagagagagagagagagaaagaaagggagaaagaaagaaagagagggggcggtgggaggagggagggagggagggagggaaggaaggcagtcaggcaggcagggaagggagggagggagggagagaaggaaaggaaggatcaattaccttatcttccacttcaggaaacatggaaaaatagagcaaacaaaagcagagggaataaaatactgaaaactagagtacaaataaatgaaatagatactagaaagcaatagaggaaatcaataaaagcaaaatgtgtttgttggaaagatcacagaaatgacaaacctgtagataggctgaccaaaagaaaaaaaactgaaattgtaaaatcatgaataatagggggtatgcctactgaccttacagaaattaaaatggtcataagggaatattgtgaacaattgtttaccaataaacaagataacttagataaaatggagaaattcatagaaagatacagactgccaacactttctcaagagaaagtaggaaatccgaatagacttatcataagtaaagagatggaactaatcgttgcaaaacttcttagaaagaactcaggaccagatgacttcattggttaaaaaagttaaaggaaaattacttaatactaatcctcacaaactcttccaaaatcccaatttacaagaccaatatcatcatgattccaaaaccagataaagtcattgcaagacaaaaactaaaggctgatatccttcttaagtattaatgcaaaaattcccaaccaaatagtggcaaactgaatccaagaatatatacagtgatatacatcataaccaaatgaggtttctcctagggatacaaagttggtttaacatacaaaagtcaatcgatgtgatacatcatattaatagaataagagaaaaaaaccacaggattatctcaaatgcaaaaaaaaaatctgacaaaatccaacagcttttcattatgaaaaacactcagcctactcggaatagaaggcaacttcctcagactgatgaggagcatgtgtaataaacccacacctgaaaataagggcatctagattggagagaagtcaacttacctctttttgcagatgacatgattttagatgtagaaaatcttgaggaattgacaaacaaatctgttagaactaatgagtcctggaaggatacaggatacaagaatgatatgcaaatatcaatttttgtttttatacagtggcattgtacaagccaaaaatgaaattaacaaaacaactctatatagcaccaaaaaatatacaatacttaaatgtaaattttaaacaagaaatgcaatacttgaacactgaaaactataaaatgttgttgaaataaagatgacctaaatgaaaaacaccctatgttttgaatcagaagacctaatattgatcaccaaactgatctacagattcagcacaatccttactagaatcccagctgcattatttttggaaaaatagacatctgattccaaaattcatatgaaaatgcttttgcattgtaaaagaggaatgaagttcagaggctcctacttcccgatttcaaaacactacaaagctacaataatcaagacaaagtggtactggcgtaagcatagacatgttgatcaatggaatagaatcgagactccagaaataaattgttatatttacagtcaattgagttcagtaaggataggaagaaaattgaatgagttaagattaatcttttcagtaaattctgcttgggcaattggatatgcacatgtaaaagaatgaagttggtctcccttcctcacaccatacataaaaatgaactttaagaatcatagacctaaatgtaacagtgcatacaacaaaattcttagagaaaaacataggagttaatctttgttacgtttggttaggtaataatttcttacataagatgtcaaaagtacacgcagcaaaagaaaaattagataaattggacttcagaatttaaaacttgtgctttaaaggacatgatgaagaaagtgaaaagacatccctcaaaatgggagacaatatttgcaaatcatatatatttaatagtcttttgtctagtatagggaattcttacaacttaataataggacaaatgatccagttaaaagataggcaaaggacatgaataaaaatttttcaaaaaagatatagaaatggccaataagcccataaaagatgctctgtatcattagttgataggaaaatgtaagtcataaccacaatgagataccacttcacacccatgaagtggtgaagatgtggaaacatgggaaccattacatgttcctggtgggaatttatgactacagtgatatgaacttgggaataatttgacagattcttaaaatattagacgattaccacatgacctagctattccacttcctggtatatacccaagggaaatgaaaccatgtgtgcacagaaatgttgtatacaaatgtttatagtggcatttttcataatagccagtggaaacaaccctaatgtccttcaaatgatgaatgagtatataatagtaaataaaatgtgatacgttcatagaatggattatttttcagcaataaaaataaatgaggtattgatattttctgcaacatggatgaattttgcaaaaatgctagatgaaataattcagtcaaagtagatcacaaattttcccagaataagcaaagctatagaaatcgaaagtacataacagttgcttagggctgaggaggggaatgtagagtaactgctctcgtatctaatgtttcccttatgaggcaatgaaaacgttttaaagttgcttgtggggatggttgcataactctgtgactatactaaaaaccattaacttgtacacttcagatgggttaaatgtatgatatgtgaatttcatctcaaactgtttaaatgtatatagtctgttacacattttatatttaagaatttgttttcctaatggtataatagatgttcaaattttaggaattaaatgaggcatttcttccttctagtttgatggagtctttgagaatatttcttttcaaattgtaaaatatgtttctatgtctgctctcaatttagtgcaagagtagctcttgggggtagcaatatcaagtgttcctgggctaccacctggaaggtggaagtagtagatgtatgtgaacccgcgttcttccatcttttctttcctcttctgccttgaaatgcaagtgacataaaattaaaacaacacggaaaagtttcagttcctacaatggcagtgtagtgtattttcaatgaattcctttccagataaataattataaactctggacaaaatataaagcacaactatttgaaggctgtcgatgtacaaccaaatacgacccctaaaagaagaaaactacaccagtgagatgcacatttatgtggcttttcctctgaaagcagtcactattgcatgcattaaggcatggctgtaactcagttattggttttaggtctcagagaatgatgttcagtgttgtcagaactgctggaaattaagcagggatatcatggcagaaagggagcaacagagtgaagagttccatatgtgaattcaggttctctcaaattgttggttgaccctggaaatgtgcgtaacaaagaccccagggatcccagaagatcccagaactgctggaatgctgaatgaactgagctaaaatttcagttgcctaccatggttatgataatgttggaatctgaatctcatcaatttgaggtacttgtaaacaccttgagctttccattaaaaccctggaaggaccatgccttgggagaaaagactgtttctggaataaatggtttggactttttatttattgagagcaaaaccaaatagttcctagtacaacataaaagtgagcctccacaacttcaggactggtaactagcaatgtaactgcctgctgtaataaaaatcagtacttttcagagggagataacatgatgagtgaagtctgacaacatctccacaatacagtttacttggcatgcaatctaagaataaagacaactataatccagaggaaaagcagtcaacagaaatcaaccgtgagattactaaaatgtttgtttcatgggcaagagctttaaagtagctattaaaatcattttcaagtattaaagatgaaaatgagggaaaaatgggaactatcagcatagaaatggaaattaaaacacactactaagtggaaattccatatctaaaatgtcctatatctgcaatggataatttgctggataggctgaaaagcatactggtgatggcagaagaaggaataggtaaccttgaagatagaagaatagagattatgcaatctgaaaaaagagaaagaaaaatgtgtttaaaaaattgaagagacacaaaaggacaaaggaaacttttggaggtaaaacatgtttattaccttgattgtggtgataatgtaatgaccgtatgcatatgtccaaactaatcaacttgtgtgcattaaacatgctgttttttaaaatgtcaaatacacctcactaaaggtgtttagccgaggtgggcagatcacctgaggtcaggagtttgagaccagcctggccaacatggtgaaaccctgtctctactaaaaatacaaaaaattagccaggtgtggtggtgcacgcctgtaatcccagctactagggaggctgaggcaggagaatcacttgaacctgggagctggaggagcttgcagtgagctgagatcgtgccactgcactccagcctgggcaacagagcaagactcctcaaaaaaaaaaaaaaaaagaaaaagaaaagaaaaaagctgtttaaaaaaaaatggaagacagcctcggtgacttgtgggcactataagttatcaggaagcatgtattaggaaggacaaaaagaaaggcaagagagtgaagaaacttcagaaaaaatatttaatgttgtcttcttaagattgggaacaagacaaagttgtctgtttttatcgtgtttatacagtattatcctggagatcctagccagtgcagttggaaagaaaagaataaaaggcatagaaatcagaaaggaagaagtaaagtcatttctatttacagaggtcataattgtttgcatagaaagccttataagaatctataaaacaattgctggaactaacaaatttagcaagattacaggataaaaaggcaatcaaatgcaagttgtatttgaataaactagcaacaatgggaaagtgaaaattaaagttccacttaacatagcataaaaataggcaaagcagacaccgtcactagttagagtatgaaggcatgcaagaaataacggagcctaatgattgcaaaggaagctttccacaccttaattggttacctaagaaaactctaaggagtctgccatacaatgaataaaactaaggcaaaaataggcataaagttaacaaaagagattcatgactaccacactttatgaaataaattaaaaatcagaagaagtaagagttatatcctgctcatggactggaagagaaaatattaagatgtcacttctctctacagtaatacagattcaatgcaggcccgatagtaattctattgggattgtatctcagggaggatgtggaagaaattggcacattgattttgaaatttctatggaaatgcaaagggacttgtattagtccattttcaccctgctgataaagacatacctgagactggacagtttacaaaagaaagaggtttaattgaacttacagttccacatggctgaggaggcctcagaatcatggacgaggaggggcaagtcacatcttaagtggatggcagcaggcaaaaagagttttgtgcagggaaaccccccccttttttttttctttaaccatcagatctcgtgagactccttcactatcatgagaacagcataggaaagacctgcccccatattcagtcacctcttactgcgtccctcccataacacgtgggaattcaagatgagatttaggtggggacacagccaaaccatatcagacctagaatagctaataggaacaaagttgcagtacttggtctacaaattttcctgaaatgggctcacccctgtctcctaccacacaggaaagttagagatgcatcatagacagatctacatgtaaaacatctaaaacatgtgagtatatcttctgaaactttgtatgtaggcaaaaaacttcttagcaaggacacaaagcactaaacataaaaggaaaaattagtgagttagattttgttaatattaaaaacttccattaaaactgtaaaaagataccactacatacctattagaatgtctaaaatccagaacaccgaacaccacgtgctgctgaggatgtggagcgacaggagctctcatgcattgctggtgggagtgcaaaatggtaagccactttagaagacagtttggcagtttcttacacagcataaccttaccatataatcaaggagttgtgctccttggtatttaccaaaatgagctggaaacataggcacacactaaaacctgcacgtgaatgcttacagcagttttattcataattgccaaaactgagaagcaatgtccttcagtaggcgagtggataaactggtatgtccgtacaatggaatattatttagcaataaaaagaaatgagctactaaggcatgaaaagacagtggaaacaaatacatattggtatggggaaaaagctaatctgaaaaggcagcattctgtatgattccagcgctaagtgacattctgaaaaaggcaaacctatggagatggtagagatcagtgattgccaagcattcgggggagggagggggaataaataggtggaacaggggacttgtaggcagtgaagctactctgtatcatactgtaattctggacacatttcattagatagttgtcaaaacccacagaatgtataacacagtgaaccttaatgtatggacttcagttaacagtaacgtattgatattggcttatcaattgtaacaaatacaccatacaaatgcaagatgttcataatagaggaattcatgtgggggaggatgtatgggaaattgaaattctgttgagtttttgtcaacctaaaactgctttaaaaaataatgtctttttttttttaaaaatctgctgaaggaaagacattgttaagaaaattcataagcaaaccacagaagagaatacttgcaatacataaatctgacaaaggccttgtatccaaaataaagaactttcacaaatcaataaaaataaggccaatgacctaataaaaatgggcaaaaacttgaatataaatggccactgagcaccataaggtcctcagcattactagtcatgggggaaatatacatgaaactatgataagatgcggtttcccagcctctagcctggctagaattagaaagactgacaatgccaaatggtggcaaggatgtagagtgactcattgcagtggaaacatggaaatgttgtaatcttttggaaaacaatttagcaactcatataaaattaaacctacatttagcctacgacctctactccctagattttttaccccccaagaaatgaagacatacctctttaaggggggaaaaaacaatcaagtacaaagaatatctacagtggctttgtttataacagccccaaactggaaaccaccaaaaatgtccatccacagaaggatgaacttattttggtgtgttggtacagtaaaatacttctcagcaagaaaaaaaggatgaactattcaacaacatggatggatgcacctcaaaaacattatattggtcaaaaaagccacagttttttttggagtctgttcttgtgaagctcagaacaggcaagcataatctctggttgactgttagtggcaggcagagccaagcgactggaagggtgaatgacagaacttaagatcttggaatttgactgtatgttagttgtatgcgagtaaaatttaaaaaaaaataacagttgctgaaacaaaagagagggatttcagatatttctgcacccaattatggtaacaataataactaatttagcatttatgtgccaaacactactctaagcattttacaccttttatctcatgtaagcagcatatgggttaggcattcttattatctttgtcttgctgatgaggaaactgaggcacaaggaggctaagtaagttgtggatggaggtcacacagcttttgtaggtctgcacttggtcagtgagacatggggtctgctggggtgacagctgtgccacagtgcctttcctggctaatcatgcccagtgtctaaattgagaaccttaagcccttatcggtggaagaaggaaagggagtatgcataatatttaaatatatgagattatgagtaacattacgtattctatcctagattcagatgtcatttgtgtaattatttgtaatgctaataacaccaaacttgggggtgttccctgtttctcagcatgattatgtgatacagactcttccacacagtctcatgtatttgaacatacacattttcaattgcatgtaggcagaattctaatcctcctctatgccaattcctagctttgaagaggttctctgaaaatgctgcttttatctttcttctgcagtgatgaactttaatgttggagtgttgtaagttctcacataataaggctcagatttttgtttggtttggcagtagacttctgtttaaaattcctttaatctgttcattctatgctttttatattcattttaataactgatggctctgtaaagaattttttttgaatttattgcactagttaaaaaactactaaaacttgtacttaactattcctccatctcaacgttctaaaagtgagttttccagtgaattgctgaatttttatcttccctgggagttgttcctccccttccccaaccctggggaaataagaaacaattcatatactagatctaaagtttcattaaaattgcttatgccctgtctcaggcattttaagtgggccatctgtctaaacatctctctctccttttttttttctgatcatttcctcgacttattcatgagccatgggagggctcctttgtagtctccatgtagctggttctgtctacccccactgaatacatctatgtgcttgcataacatatcttttcaccgtgctggaaattctctgaacttggttcagatgaatggcccactttctgaaggcctttttcttcctgcaaagatttgtatgcagaaactgacctcagtggccatggaatgcagcatattattctcgatcattttacagcccacccactgtgaaagttatgatgaagcatttcttaatgattccttgaccattagcattgttttaactcagtattttacttctaaagaggtgatggcacaacaaaaaccagcttttttgagtgtctgataattatggtttaaaatgcttataatcctttctaactgaagatgctgagagtttttatgtttatacagtcttcttttagcaaatgacttgtaatagcaaagtatttactcaaaagcacccttttgagtaaaatattccagtaagttaaatgtattagtattaatagtgactatcagctgacagttcttcaccatcaaatataaaaaatttagttatgtcgagcatattcatcctggctggctgatgataaagtggacagacctgggttagagctattattttatttgctttgtgagtcactgtttatgtgagttcttttttactggggtttttggtttttgtttgtttgttgaagaaataacttaattggtatcagctttgcaggtgactaataagttgcacagattaaatttttggtcagatgacagcatctttcactagaaatgtacttcgttaaaggaaactgtatcattactatggtgagttgaagttctaagaccttttccctattgtcagagagttgttcataaaaatcttctttgagactattttgaatttaatggatctgtgtaattcttttctaaacatttagcacataattgtaggtaattgttactatcataaatctgtctgtgctggttaaattaataagaatgtttcaaagtaagtattataaatgtattttcagtgattttgcagaaatagagcatgcattctttcaggtttgtattttttaaaatttatagcttatttctattgcagagcatatttatatctgccagttaactggcatatatgcccaacccatccattttatttaaaaacccaaacaaaactagtttcaaacttatgtcaagccagaaggaatctttgcaaattttgtttgtagaagagtgaacttacaaatagatttcacagtttcgactctgttttggtatttagaggtcttgcacagtgaagcctttttcctatatcctgttaacatatcaccctgaaagaaattgttagaaaaaggctgggtactgtgactcacacctgtaatcccatactttgggaggacaaagcaggaggatcccttgaggccaggaattcaagaccagtctgggcgtcatagcgagatccaccccatctcttaaaaaaaaagccagacctggtggtggcgcacacctgtaatcccagccactcaggaggctgatgcagaaggatcatttgagcccaggagttccagactgcagtgagctatgattgggccactgcactccagccattgtgacacagtgagatcatgtttcttaaaagaaaaggaaaaaattgttagaaaagtgccactgcaggagttaagtttgtagaagaagcagtagcttcctatcacttgcctaactctgatacacttttacaggtgtagaaatattggttcaaacagattgaataagttctcaggtacattgctagtagaacaggctgagatttagacctggatgttttaactcgaaaccctgtactctttccataaggcccctcctgggacaaattataatatatatgaaacagatgtgaatcaaaataaaacaatggaaaaataaatagtacttaggttttggagagtggcaactgtatctcatcaccatctataaggtccctttctgtgggaaaatgggttctgggttggaacaggatgtcaggatcagcaatgttccaatgcctctggaagcagagacttgttacgtgatagaagaaattctcaatccctactccatcaggctgctacagtttgaaaaatattacagcatatgacatagattaaatggaagaaagatctcttgagtttatgctataattaaggaacaatttgtgagggaggcaatattttccttgaaggatctgttagtgtgagaagcagagagatgagatgagaatccaaagtttctataaagaaagaggtttcagttataggggaaagtaagaatataggccgagagccgggacaactactcataataaaagctatagcatgtatacacctaatttaatcaacacctccctatcaatgcagatattgttacaatcttttatacatacataaggaaactgagacagacagtttgctccgggttttgtgtcagcttctgtgactcatcaaggcctgagttcaaaaccactgtcttgctctctgcctcatggtagcttggtttaagagtctgtcctaaccaaatagacaaatcagagaataagcagaaataaaattgaatgcaaaaggtgggttcttacttttaaggcattgaatggtagttaggttaataaagatgtaacttggtgtggggtagaaaacgatcaaatgatcatgagcaagatagtgacataattcttgaggaaagcacagattcaagaaagccaagttgcacggtcatctagatgtgaggctgtttctgcaatcacaatacccctgtgaaattggagtattgacctcattcgaagtgagcaaaatgaagtcttagtgagatgataggcgtagtccagggacacccagggagtatccaggagcttggggcacacagtcctgtcacacctgtgctcttgctctcctgggcaagtcagcctccccttctacacgtgcttggtgcatagtagacactcctcacagtcttttctacttatccctcatctctttgtctccatcctgtgccaggagctggagatacaaaaataaggaatgattttggtcttttaggagcccacaggacactgggagacaaacatataaacaaataaatgccctgtagaataaaggtgctaagaaaaaaaagaggaatactggcacagaagccctttcttcccttcttcctttctgctcagacctccttttctttccctctcctcctcccctccccactgtgtgttgtctccctcaactcccctgcacccccattcattcatactcttctgtgtgaggctctatcccctgaaacagttcttttcacactgccagaaagaatcgtcaaggcctgtgtgtacagtgtgcattattgttgatgcattttttttttacttttatttttacttccatggtatttaaaacatatccttatcttcagaataatgcagatcaagaagtggtaggtcaaatacaaatatgtatttaaattaataatattaatcagatattgaatctagaggtgattggattagaagcatagtttttgtgactctgatttttttaatgctgaatacacagagacttcttttgaaaatttggtgggtttaaatgaaaacataacttggaacattttttcagaactgtggtttaagctggagcccagatactacaaaatgctgatgtttagtacttggtaaatattacttcacaagtataaatatgcaatacctaaattaggttaattctgaaatcattaaattttgttactttaaaaagtcgtgggaaacatttatattctaaaaacacttttgtctttggctgcttgatacggattttctgaaccatgtaatactgataatatgcaagaaaagacccgtatgataagactaacattgttcatagatatggagtcctttctggggggttttaggtgatggggaaaaccagggctagaaaagaaataatgtgtaagtttccaagatgaggactgtgttttatttctctgtggtgccccacaatttagagccaagtgcttagtgtttgttgaactcataagtcatttagggttttgtgtgtgtgtgtgtgtgtgaatgtgctttattttagcaaaatttagatgttgtcctattatataataacataataagtgggtatctgagtaatgtttaaattcgttttttaaatttcgtgaatttttagtaataacattataaaataagtatagttttttttttgtttttttttttttgcaaaaaataattatatcggccaggcgcggtggctcatgcctgtaatcccagcactttgggaagccgaggcgggtggatcatgaggtcaggagttcaagaccagcctgaccaaaatagtgaaaccccatctctactaaaaatactaaaaattagccgcgtgtggtggtgggcgcctgtaatcccagcctctcgggaggctgaggcagaagaatcacttgaacccaggaggcagaggttgcagtgagccgaaatcgcaccattgcactccagcccgggcgacagtgcaagattccgtctcaaaaataataataataattaaaaaaaattatatcctagctaatgtactaagatatttctcttctaattgacatcatgaagaaacattctataagtagaataatgtagagaggttcattgtttaatacatttttagtctcatcaccagtaaagaacaaaatgattctctaggccacatcatgctaactcagtaattcattttatgtctctgaagtttaaggcatggcatacttacttatttcattgtaatttttttttaaaaaaaccattttgaatagtaaccaaatattgaaaaaaactaatactgcttcaggcagatgaatttgtgaatgactgtaacaattaggcaattcaaattcatagatacatgatgattcttagagtaggtgtttaaaatgttcgcaaatacattcaatggcagttttagcctgtgcattttatatcaaagggaaattagtttattgagaaataataatataaaattattaactctttttcttttcattctacttcagaatgcctgttattaaaccagacatagccaactgggagctctcagtaaaattgcatgataaagttcataccgtagtagcatcaaacaatgggtcagtgttctcggtgagttttctttctttattttcttggtaatcttgatgttatctatgaatatttaaagccatttttaacctgttcagtgactctcgtcttttgaatttgtagtacctctatgtatttttcatcttctttaggaagctgaatggaaatggaaatttttgttctcttatgcttattaggaaatacatttctagatttagccacatcctaaactcactttctgatacttgattcatttttcttttatgctgtgagaagtaatacttttgcctttgttacagagaagagcattttgaattacagttccaaatgtatgatagtggtggtaggtaaccatccttttaaaacaaataatctgaagcctcacataacattatctttaaatctcatgctgcaagacactcttgaggctaaatttaccttgtggtgacactctttttgttttgaagaacttaaaccccttggatatagggtccaagatagaactgccacagttggaattctagtctatagtgaacaagattacagtaagatttcagtgtttatactgtagtatgagtgatatgtttaaaactgtgatccgagtgtgccagaaaaataccattaagagttgctgttttaagtcgtatgccttcgtgttttcagcctgaactcaaggaggttgctattaatatatagttagtataatgaatattctgtttatctacatttctcttcttacggctaaattgcattgaaatgtcattttgttttggggaaacaagtgaatttttatcagaatattgaaataggatatgaacatcaaaacaatataatttcacacaaataagacctggtgtggcttgagaggggtacggcagtttcttgatctcagtgagaaaatatcacaagttgaagattcatgagaattcattcattccacaaataattgttgcatgcctactgtgcaccagatcagttccaagctgttgccctggagaagctgacattcttgtgtggtgtcagactcacagatcaatgatgtcagtccatgaactaagggtagtctccttggttttctttaaatgttgtgattcactgtatacgccaaaattgctgaaacgttagatactgaaagatacttcactcagctctcttaaaatgaaagctatgatggagttaaacagctgtctcatgagatcttgtgtgactctctacattccacctattgacatggtcatttcagaaaaacagctttgtaagtgcacatttaaccagagatcaggttgagtagcaaattataggaattgaatagtaaagagtatcaatattacaatgtagcatttttttttctgggggaagattaactttacaaaaatgtagagtttagcataattttcagttctatattgagtcaccactgaagccttactgtaatctgatattctgatacaatgttcttttaagtagtgccttaccttaataaagaaaactgtctagattacttttcagagctgttacttctttttttttttttttttttttttttgagacagagtcttgctctgtcgcccagaggctggagtgcagtggcatgatctcggctcactgcagcctcttcctcccaggttcaagtgatttctcctgcctcagcctcccgagtagctgggactacaggtgcatgccaccacacccaactaatttttgtatttttagtagagatggggtttcaccatgttggccaggctggtctcgaacacctgagctcaagtgatcctcctgtctcagcctcccaaagtgctgggatcacaggcgagcgttgcttctttatgtttgttttagattccatgttgaaaagtagagacctctggcctgactgcatacgtggtatctttcaaatttttttctgtagaattatctccagcttcactttttagcttatgaggaaaacagggctgtttttaaaacacatcaaaattagtgcattaaaaacttccctggaaaatatccaccttagtatataatatcagaaatgatttcctatatttattggcttagctactgtcagagcatcaatagcccaatgaaaggcatgtgcacatgatagtgtagccctttttcctaggcatatttaaatttagctactttcatttgacatcagtattatgaaaggaggcaggttgaacagcgtggcgaagtaaaggctcattggtagaaatatttcaatagtatggcactattgtctgcttttagggtcatagacgggagaactgtgattgttaacttagtttcccagatcacccactgtcacatcaagaaaaaaattagcctacaggtgacaagccaggtctgggttaatgactctggagatagtgcaggcaaaggctttactgagcacacagtaaagctttaggtgccctacatttccagagttcttctgtttaatttttaggagtttaaattataagatatttctaataaggaaagtacagcagatgttgcagattttccatacaggtctcctatttaaaaagaaaaatatatagattaaactaagtcctttctttacatcatcctgttccactttctcccaagtggtggcagctaacctgatgatgctgtgtgtcctttctgtatgtgttgttaagacttttggtacagatgtatacaccacaataatggtaaaaaggaaagttgcaacaatatacatacttaatggcaccatttatgtaaattttaggcaaagcaatttcatttacaatagaatgaaaaggactaaaatacttaggaatatatttgaccaaggaggcgaaaggcttacacactgaaaactataaaatgttgctgaaagagcttaaaaaagacacaaatatatggaagggtatcttgtgtcagggactagaagacttaatatggttaaaatatcagtacctctcagctacttggaaggctgagacagtaggttcacttgagcccaggagtttgtgcccagcctgggcaacacagcaagactccatctctggtgaacaaaagaaaaatgaaagaaggaaatgtcagtactacctgaagtgatctacagatacaacgccatccctatcagaacccccaaatacattttgttgcagatatagacaaatttattctgaaattcatgcaatttcaagggggtcccaaatagtcaaaacaatcctgaaatagaagaagaaagttgaaagccttatacctcctcatctcaaaacttattacaaaaccacagttttcaaaacagtgtggtactgcacatatatagaccaatggactaggatagagagcccataagtaaacccttgtatgtatggtcaaatggcttttgacaagagtttctaaaatattcagtggagaaaagacagccttttcaacatgaataaatttgggtccttttcttactctgtatacaaaactaaccaaaatggatcaaagacctaaatgtaagagctaatgctataaaattcttagaagaaaacacaggggaaggctgcgcacagtggctcatgcctgtaatctcagcactttgggaggccaaggcaggtggatcacttgagctcaggagttcaagagcagcctgggcaacatggtgaaaccccatctctactaaaaatacaaacattagctgggcttggtggtgcatggcacacacctgtaatcccagctactcaggatgctgaggcaggagaagctcttcaactcagtgggcaaaggttgcagtaagctgagatcgtgccactgcactccattctaggtgacagagtgagaccctgtctcaaaaacaaaacaaaacaaaacaaaacaaaaaaaccagtagataacataggggaaaagcttcaaggtattggatttggcaatggtttcttagacatgacaccaaaagcacaggcacaaaagataaattggactatgtgagagttaaacacttctatatatgaaaggagaatattttcccagaattttcatccctcctttaaaattttccattctaaacactataaatatataaatgtttcatgcaaatattttctcccattctgtgggttgccttcttactctgtttttttcccaaagtaaccactctgtcagagtacaatcaacagagtgagaaggcaacccacagaacgggagaaaatatttacaaatcacatagatgataagagtttgtttgtttgtttgttttttgagacagtctcgctctgtcacccaggctaaagtgcagtggcacaatcttggctcactgtagcctctgcctcccaggttcaagtgattcttctgcctcagcctcccaagtagctgggattacaggtgcatgccaccacacttggctaatttttttttgtatttttagtagagatggtgtttcaccatgttggccaggctggtctcgaactcctgacttcaggtgatccacccacttcggcctcccaaagtgctgggattacgggtgtgagtcaccacgcccagccctcccgataagagtttaatatctggaatatataaagaaatttttcaactcaataacaaaaaacaattaaaaatgggcaaaggactttcatagacacctctccaaagaagatatacgcatggccaataagcacatgacaagatgctcaatatcactaatcattagagaaatccaaatcaaacctgcagtgagatactacctcccacccgttagaatggctagtatcaaataaacagaaaataagtaccggtgagggtgtggagaagctggaacccttgtgcacagttggtaggaatataaaatgatgtggttactttggaaaaaacagtatgatggtccctcaaaaacttaaaagtagaattacatagtaaccttagaaagttggtaattctgatatgtgctatataacacagatgaatcttgaggacattatgctaggttataagccaggcgcaaaaggacaaatactgtacgattccacttatatgaggtacctggagtagtcagactgatagagacagaaactagattggtggttgccaggggcagagaggaaggggaatgaggagttattgcttcaagaatacaaagtttcactttttaagatgaaaggttttctggaggtagatggtggtgatggtagcaggaaaatgcaaatgtatttaataccactgaactgtacatttaaaaatggttaagatggtaaattttatacgcgttttaccacaagtaaaacatacacaaaacaaatcagtatttataatgaaaaacttaaaaggagggttgtggccaggtgcagtggctcacacctgtaatcccagcactttgggatgctgaggtgggtggatcacctgaggtcaggagttcgagaccagcctggccaacatagtgaaaccccgtctctactaaaaatacaaaaattagccaagtgtggtagcacgcgcctgtaatcccagctacttgagaggctgaggcaggagaatcacttgaacacaggagatggaggttgcagtgagctgagatcacgccactgcactctagcctgggtgacagagtgagactctctctcaaaaataaataaataaataaataaaataaaaaaggaggtatgaaaattctgggaaatgaatgcatggtaaaaatgaaagttaagtgaagtgttaatcgtaggagaagtgaagtattttatgtattttaggtctttattctgatttctgaatacagctgtctgaatgaatgacagaattaattaatagtataaaacctgctagacacaaagtagaaatattattcagcttgtcatggtgataagccgaaaagtacccaataacaaactgatttttattataattattttcatgattcccttctggattcccaggatgttttccatttctgtcttgctcaatataacacaaaactggtcaaaatagtttttggccaggtacagtggtgcgcacctatagtccatccactcaggagaaaataagtttatgatgaattaaaatattaacacagttaatatcttaaagatggtgaaaaactaaattcatattgaatgtgattcacttgaaagaaagagttgaaagaagagtgtcagagtagtcctaatgtataagaaaattagttagaaatttggccttcctagcgatggaaaaaggagcactatacatgcactttttgaaaaattttgcctgatgtttcatgtttactactaataaactagaaagcaattgtatatgatcctgtatattgaattgttacagtgggccaatgatagaaaattttgtaaggacctaagggtttttcgtgtctctgtctccttcagttcggctctgatcttagttatttcttgtcttctgctaggttttgaatttgtttgctcttgcttctctagttcttttaattgtgatgttagggtgtcgattttagatctttcctcctttctcctgtgggcatttagtgctataaatttccctttaaacactactttagctgtatcccagagattctggtacattgtgtctttgttctcattggtttcaaagaacttatttatttgtgccttaattttgttatttacccagtagtcattcaggagcaggttgttcagtttccatgtagttgtgcggtttcgaatgagtttcttaatcctgagttctaatttgattgcattgtggtctgagagactgtttgttacgatttccattcttttgcatttgctgaggagtgttttacttccaattaggtggtcaatttttgaataagttccatgtggtgctgagaagaatgtatattctgttgatttggggtgtagagttctgtagatgtctgttaggtctgcttggtccagagttgagttcaagtcctgaatatccttgttaattttctgtctcattgatctaatattgacagtggggttgttaaaatctcccactattattgtatgggagtctaagtctctttttaggtctctaagaacttgctttatgaatctgtgtgctcctgtattgggttcatatatatttaggatagttagcccttcttgttgcattgatccctttactaccaggcctgccttacaagagctcctgaaggaagcactaaatatggaaaggaaaaaccagtaccagccactgcaaaaacataccaaattgtaaagtccatcaacactatgaagaaactgcatcaactaatgggcaaaataaccagctagcattataatgacaggatcaaattcacacataacaatattaaccttaaatgtaaacgggctaaatgccccaattaaaagacacagactggcaaattggatagagtgaagagccaacagtgtgctgtattcaggagacccatctcacatgcaaagacacacataggctaaaaataaagggatggaggaagatgcactggtttttcctcatctttatggatttatctaccttttgtctttgatgttggtgaccttcggatggggtttttgtgtggacctcctttttattgatgttgatgctgatgctgttcctttctgtttgttagttttccttctaacagtcaggcccctctgctgtaggtctgctggagtttgctggaggtccactccagatcctgtttgactgggtatcactagcagaggctgcagaacagcaaagattgctgcctgttccttcctctgaaagcttcgtcccagaggggcacctgccagatgccagctggagctctcctgtgtgatgtgtctgtcaatccctgcgggggggtgtctcccagtcaggaggcattggggtaagggacccacttgaggaggcagtctgtccgttaacagagctggagtgctgtgctaggagatctgctgctctcttcagagccagcaggcaggaacgcttaagtctgctgaagctgcgcccacagctgccccttcccccaggtactctgtcccagggagataggagttttatctagaagcccctgagtggggctgctgcctttctttcagagatgccttgcctagagaggaggaatctagagagacagtctggcgacagcggctttaccaagctgccatggctttgtttattctctgaggggaaaaccacctactcaagcctcaataatggtggatgaccctccctgccaggttgacttcagactgctgtgctggcagtgagaatttcaagccagtggatcttagcttgctgggctccgtggggctgggatccgctgagcaagaccacttggctccttggcttcagccccgtttccaggggagtgaatggttctgtttcgctggtgttccaggcaccactggggtatgaaaaaaaactcctgcagctagcttggtgtctgcccaaacagccgcccagttttgtgcttgaaacccagggccctggtggtgtaggcttccaagggaatcttctggtctgcggggttgtgaagaccgtgggaaacgcttagtatctgggctgaatagcactgcccctccctcatggcacagtccttcacggcttcccttggctaggggagggagttccctgaccccttgtgctgcccgggtgaggcaatgccccaccatgctttagcttgccctttgtgggctgcacccactgtctaaccagtcccagtgagatgagccgggtacctcagttggaaatgcagaaatcacccaccttctgtgctgatctcgcggggagctacagaccggagctgttcctgtttggccatcttgccagccacttgagaaaaatgtctttttactgtttttgacttaaagctgttttatgtgataacagtatagctactcctgcttatttttggtttccatttggatggaacaattttttccatccctttactttcagactatttgtgtctttaagggtgaagtgtgtttcttgcaggcagcatatatttgggtcatatgtttattcagtcagccagcctccatctttttattttattttattttatttttttgagacagagtctcgctctgtcacccaggctggagtgcagtggcgtgatctaagctcactgcaagctctacctcccaggttcacgccattctcctgcctcagcctctcgagtagctgggactacaggcgcctgccaccacgcccggctaattttttatatttttagtagagacagggtttcaccgtgttagccaggatggtctcgatctcctgaccttgtgatccacccgcctcagcctcccaaagtgttgggattacaggggtgagccactgcacctggccaccagcttccatcttttaagtggagcatttaatccatttacattcagggttattattgatatatgaggttttgttcctgtcatatcattaattgctttctgtttgttttatatgttccttgttccttcctattttatattgtttatctttgtggttggtgttttccttcagtggcaacattagagtcttttctgttcctcatttgtgtgtttgccttaccagtaggttttatacttgcacgtgttttcatgatggtgtatattgtccttttgcttccaggtttaggactcccttgaacatttcttatagggcggatatggtggtaatgcattccactggtcaaattcggcgtttgcttgtctgggaaagactttatttctccttcattaatgaaggatattattactgggtatagtaccactgagtggcagtgtttttctttcagccctttgaaaatacgattccattctctcctggtatgtgtggtttctgctaagatgtcgactgttagtctgatgggacttcctttatagatgactagatacttttctcttacagtttttaaaactctgtatttggctttagatagtttgactataatgtatcatggaagagatactgttttgcattgaatctggttgaggatttctggaccttctgtatctggatgtctgtatctctcactagacttggggagttttcagttattatgtccttaaatagagtttcaaatcctttcattatttctttgccttttgggatactgataatcttgatttttggttactttattgtgtcccatatatcatgaaagctttctttatgttttaaaattactgaaaaatttttttgtgtgactgcattatttcaaaagacttctcttcatgctttgagattctttcttctgcttgatctagtctgttgaagcttttgaatgcattttgcatttcattcagtgaattcttcattccagaatgtgtctgattcttttttatgatacccatctttttggtaaatttctcatttatatccttaattgtctttctgatttttttgtgttgtttttcagatcactcttgtgtctcactattattagtatcaaaatttttagttatttttctggaatgtgaatttcttttggatgggatctgttgctgcagacttattgtattcctttggaggtatcatattcccttgctttttcatgtttcctgtgtccttacgttgatatttgaacatgtagggtaatattcgcttcttccaattttagaatttgttttcataggggaagactttttcctgaagatgtatccatgctgttggttgggtaggaccctttggctttgattctgggtgcatgtggtagtcactgtatagtgtagtcactgtatgatttctttggctgtaaacagtatcggtggtatctgtgatttctttagtggcttagggtactgttattagtagaggctgtaatgaggttttctggggacaaggatgccacatgggccactctttgggcctaatggtggtagtggtgggctgagtatgtctgtccttgggccccggggttgcatgtgctgacactgatgttagtgggtccaggtgagtaaatttaacaaaagaagtataaaacttgtattgtgaaacaaaccattgaaaaaagaaattaaggaaaatccaaataaatggaaagtttctaatatttgtgaattgaaaaacttaagatggcactgcttgcctgtattagtctgttctcacgctgctaatgaagacatatccaagactgggtagtttataaatgaaacagctttaatgaactcacagttccatatggctggggaggcctcataatcatggcagaagatgaaggaagagcagagggacatcttacatgcagcaggcaggagagcgctcttgcaggggaactcccctttataaaaccatcagacctcctgagacttattcactatcacaggaaccacacggggaagacccacccccgtgattcaatttcctcccactgggtccttcccacacatgtgggaattatgggagctacaattcaagatgcaatttgggtggggacacacccaaatcatgtaattcccaaattagtctaaagatgcaacacaattcctgccgaagtccaagctgtatttttatcagaaattgacaagctgatcctaaaatttggaaaatatggaaacttaagggacccagaatagccaaagtaatctaaacacacacacacacacacacagacacacacgaaaaaacaaaaaaacacgccagtcacattggctcagacctgtaatcccagcactttgggaggccaaggcaggaggatgacttgagcccaagagttcgagaccagcctgagaaatatagtgaggcccccatctctacaaaaaagttttttttagctgatggtggtagcatgtgcctctagtcccagctacctagaaggctggggttggaggatagcttaagcccaggaggtggaggttgcagtgagctctgatcacaccactgcactccagcctgggatacagagcaaaactctgtctcaaaaccaaccaaacaaacaaacccacaaaaatccagaattggataaatcatatttccatctttcagaagttactacaaacagccttgtaatcaaatacagtgtagtacttgcaaaatgattgtcatataaatcaacagaatagaattgagaatccagaaataagcccaaaaatatatggtcaattgatctttgacaaaggtgccaaaataattcaatggtaaaaagaataatctcttcaacaaatggtgtcgaaacacctgggttcacatgtaaaggaatgaagtagaaaccctacctcatattgattagtatacaaaaattaatccaaaatggattgaagacctaaatataagaggcaaaacatctttaaaaatagatgaattgttcaacatcaagattaaaatgtttgcttcaaaggacactaacaggaaattgaagacaaaccagagaatgggaaaaaatatttgcaaatgaaattttcagtaaagcacttgtgtttaaaatacataaagaacacttacaacttaacaataaaaaacagcccactctaaaaataggcaaaagatctgaatagacgtttctccaaagaatatatgcaattgccggtaagcacatatagagatgttctgcatcataaggcatggagggatccagatgcaaatcaaaaccacagtgagattgtcctttgtacccactacatagctctactttaaaaagtcaggtaataacaagtgttggtaggccaggtgcggtggctcacgcctgtaatcccagcactttgggaggctgaggcaggtggatcacgaggtcaggagatggagactgtcttggctaacacagtgaaaccccgtctctactaaaaatacaaaaacaaaattagctggggcatggtgatgggcgcctgtagtcccagctccttgggaggctgaggcaggagaatggcatgaacccgggaggtggagcttgcagtgagccgagatcgccacactgcactccagcctgggcgatagagcgagactccgtctcaaaaaaaaaaaaaaaaaagtgttggcaaagaggtggagaaattgaaaccttcaaatgctattggtgggaacgtaaaagggtgcagctgctttggaaaacaggatggcatttcctcaaatggttaaatatctgggttattcagaaccttggctctgttgtatcaggagtatttaatcttgaatatttatataagtatttatgtatttctttattactatggtgaatatatcttacctttcaaataatattgaagcaagttatttccctgacccctttgcgggaccgctttgccacggggtgcctcctttaatcagcctatagctctcaactccttgtgggagggagcacacgagcgaaggaggcgggaactgtagtgcaggagcactggaactgaccagccgttttggcgccagtgggatcaaactccactcatttgcacctgttgccttccacacctcgtaggagggagtgcacaggtgagtgggtgcaggaaccagagcaagtgcttttgggcgccagcaggagcgaactctgtgcaggccccatggcagcatccaggaggggtgcctgtgactcccaaagccccagagggcatgttacagtgctcttttagctctgctctccacaggcggcttaagtgttaacagctcagttggcctgctgctgccctccaccagcgagggcaaagggccagcgtaacaaccttttgtatccacacacatggctcctgaactcttgtctggtgtccaggaaaaatgaggtcacacgaactaattgaaggatggtaaatgcaggaatgattttattgccgatgaaagtggctctcagtgggaagagaggggagctgaaaaggggacagaggaggggtaggtgatcttcccctgaagtccggctggattttctccggttactccatcaagctgtccctctgaagtcaagtcccttctctccaacattcagctgcttctcctctctgctgattgagtctggggtctttataggcacaggatgaggtggggtggggccatgggtagtttaggaaaaggcaacatttgagctggaaaacagggagagaagttctcactttgggccacggtctcaggcttttcagcttgagggtggaacttcaccagggacccacacctgtctgcctagaatttctctgcctcctgtctctatcattgtatcaatatcaaacaatagttgttggcctacatgtcagtaatttaaagatgaattaaatggttatatatgataacatttatcagagacctttagaaacattcatattctttggtctactatttttacttctagaacatattccaagcaagcaatgaaaaatcgctaattcaacatataatattttgtcagggaaaaaataaattaaaggcagttgggcttggagatatccatgtaaacaatctgtacttataagggaaggcagagttggaagtaattaaaataatgtaataaatgcattaatagaggtgtcatcaaccagttaaatctatgagaaagaaagaaaggcactcaactgcttgggggaagggaaggatctgggggaagatgaaagaagttcctcttgggggagatgactgatgagtcacagcttagaacatattttttagtatatataagccagaacttgcctcaaaattattgtataaataaatgaggaaaaacattagaatgtggtagcatgggggagagcacctcagtcccccaagtagctgagactacaggggcatgctaccatgtctggctaatttttatattttttgtagtgacagggttttcgccatgttgcctaggctggtcttgaactcctgggttcaagccatctgcccaccttggcctctcaaagtgctgggattacaggcatgagccaccgtgcccagcctgtgatttcaagttttatccaagcaatattttttgagagcaatataagatttgagactgggtgcgtggctcacgcctgtaatcccagcacattgagaggctaaggcgggaggatcacttgagcccaggaggtctagaccagccctggcaacaaaaaaaattttatatgattagccggtcatggtgatacacgcctgtagcctcagctactcaggaggcccaagggggaagatgctttgagcctgggagattgaggctgcagtgagccatgattgcaccactgcactctagcctgggtgagagtgaaatcctggaccccgtgtcgaaaaaaaaaaataaagatttgagataggtaagcttttgtgtacaagagagtttgtgctacattttgttttctttataatgtttgttttggttgatgcaaaattgtttcatcttagatgcttgaggtggaaggagggaattgttttgtagtattcatatcattgaaattaccaccctatatttttctcctcaaagaaagaatatggtgatgaactaagaatagaaaataataactacatatggatgcataataagaaataattatatacgcattgtttgacgttttccttctctgctataactcaccctttttcctttgttctaccaccatatgttttgttctggatttcttgactaagaaaacattccaccatagtttattttaatatttaaagagcactttgaaagtttgattttttttttttttttgagacagagctcactctgttgcccaggcaggagtgcagaggcacaatcttggctcactgcaacttccacctcccaagttcaagttattctcatggctcagcttcccgagtagctgggattacaggcacgtgccaccacgcctggttaatttttgtagtttaagtagagacggggtttcaccctgttggccaggctgatctcgaactcctcacctcaggtgatctgcccgcttcagcctcccaaagttttgggattacaggcgtgaaccactgtgcctggccaaaaattcaattttaagtaaatctgtttaaatgtttttgtgtaacgttttcataaaaatgaaaaattcgatgaacttagaatatgccaagaatcttctgcacaaaataataactttgtgttctcaaatagtaatataaagaatctgtaatgtatcttcattaagaatttatacatgcattttacatcataatctcttttattctatgaatagagcataatactaaattatgaagttactggaatttttataggaacatgataagaatcatgtggttcttttaaagagttaattttggaacatcttttgttcaaaaaatagaacattattatatgtattcttttgcctctattgtcagtttttaggataggcttttaatcttgaacatgaaaaggacatcagtaaacaaggtgagttaactattacatttatgcctattataggcttttagtttaaaaattacctatggcttaaatacagagaaggcagacagaaaaagaacctttttttccctgagcattttaaagagaatactacagtaccattaggggtttataataaaggactataattctatttagaaaactgacttacagtacatgacaaatgatagaaaattgaggtaagttttttgaagtcatattttatatttattttttatttttcattaatttgtcttttgccagaattaaatgttatgatcattaaactacttctcttcttaggtaattttttcacttagtctttctacccctctacctttaaaaagtatactgaacaaagcagcaaaagatattctctttgaggaaaataccttattttctgtgaatagttttttaaaattaaaacataatgcataaacatagaaattcttttacattggcaagaactttttccttgataaaattatttttccatttgaaaaattattaggataataagtcaagataatgcttaaaaatgtaaaaattttctgcaaagaatgtaaaactgtcgtaagtgaagccaacaggtaagccaaaaaaccagagagaaaatttgcagttcattttagtcacaaaataagggatgcccttcatatatgcagaactcttacaaatcaatatgaaaatgaacaaaagccctggtaaaaaaatattcagagacagtttacagcaaaggacatgtggctcctgcacatatgataaaaagtgctaaaagccacacacacattcaagtgaaaatcatgatgagatacgattttccatgcacattttggcaaaaatgaaaaatgtgttaattccgttttgttttgattttatttatttattttttttgagaccaggtcttgctctgttgcccaggccggagtgcagtggcatgatcacggctgactgcaacgtcggcctcctaggctccagtgatcctcccacctcaggctcctgaatagctgaatagtcagcatgcccagctcctttttgtattttttatagagacagggtttcaccatgttgcccaggctggtctcgaactcctgggctgaaacaatccacctgccttggccttccaaagtgctgcaattataggcatgagccactgcacctggcctcttcctaagattgtagaaacgtaagctctcaaacgctggtgggagtataaatggatataacaacctccatggagagcaatttgacaaaatgaatttatactgtgtgttatgtccacctgtaggagatgtgcaagaatagtcatgttagtattatttcttagagcagaagactggaaagaactagcaaaaggtagtgaaaaggtagctcactccaaaagttttgcttagggttccagagttcatagtaatttcatttgtcctaaaacatcacaggactattttaaagaatactatgtttctccctgctattggtttaaggaagaatgtctaaaagtaacttactgtaccagtgtaacatggtatcaaactgcctgtcagactggaatagttaaataaatatgatacattcataacattgaaatactgtgcagcctttaaaaagttgagagtgtcttctatgtgctgctttctttttttttaagacggaatctcgctctgtagcccaggttggggtgctggggtgcagtggcgcgatctcagctcactgcaagctctgcctcccaggttcacaccattctcctgcctcagcctcctgagtagctgggactacagatgcctgccaccatgcctggctaattttttgtatttttagtacagacgtggtttcactgtgttagccaggatggtctccatctcctgacctcgtgatccacccgcctcggcttcccaaggtgctgggattacaggcgtgagccaccgcgcccagccctgtgtgctgctttatcaagtgacagaggcaaacgacattcattggcataaaaaagaatgtgtgtgtttgtgcttgtgatatccacagaatatctttggaaggagccacaagaaactgggacccatggttgcctgtgagttggggagctggagggctgactccataacaagtgagaaggatacatctcttagatcatatctttttagtattttttgaattttgaaccctacatgtgtattacctattttttttaaaaaacatttcaaaattgtgcagtggaagggtctgtaagatggagcagtgttgaaataatggagccttaattacctttcaagaaacttctgcagtgacttggccatccggggaagcaatcagaaaagcagctggctcattaaatggagagtgctggtcccacaggtgtaagtacacaaaacgcaatcactgaaattctttggctagcacttccaactcggagacagttgctggagatcacttaataggctctggttacaggttgatctaatctgaattaagaaattggaaaaagcaaagaaagagcagtaacataggtcagagtaaggaagctgagtccgaacagttcctccacagcctcctgtttccccttctgtaggtgtatgaactacccagagagattactgtgaatgtagaatagttggagagatgtgtttcccaatagcaaaaggcagtgtaaaggtagttcactccaaaagttttgcttagggttccagagctcatagtaatttcactcgtcctaagacatcacaaggctattttagagaacagtatgtttttccttactcttggttcaagcaagaacatccaaaagtaacctgatgtaccaatgtgactccttatcccaagctaaagaatatcctttcaaggcaaattcatccaaatcagcttgacatctgatgggagggggttggataaacaaggttgtagagaaatcaagtctgaagagtaaccttgcacagcttgatctgtttactttttaaatgcaggtttgttcagtgggtatcgcactctacttttgaaacataggactaaattttcacaaaaatgtgaagatcctgcccgtgtactctggaaaattgcttgtctaattgggtgcacagctgcacctgtaccctcttgaatgactcagtcatggtgtgctcaagggccaagtaacttgttatggtgctaagtgaagaacaaaaatatataaaattcagttactttggcaatgaaaaacactgaatggtattggttgttatattacagttggcaaatactgtaattaagacttcaagtgatttttagtattagccctggattcactttctgaagaattttatttagaataaaactttcagcgttgataccagatagtcacctttagttcagttcagtttcataaatctttataaaatatttatagtagtcaaggagcctattacgggtgctagtcaggtttctgcaacaacaaaaagtaaattaaagttggctgggtacagtggctcacgcctataagcccaacagtttaagaggctgaggcaggaggatcgcttgagcctgggagttggagaccagcctgggcaacatagtgagaccctgtctctacaaaaaaaaattagccaggcatggtggcacatgtctgtggtcccagctactcagggggctaaggtgggaggatcaagtgagcctgggaggtcaaggctgcagtgagctgtgatcgtgccactgcactttagcctgggcaacagagtgagaccccatctcaaaacaaacaaacaaaaaatgtaaaactcacaaatttaaaaaagttttaagaccaggcgcaatggctcacgcctgtaatcccagcactttgggaggccgaggtgggcagatcacctgagatcaggagttggagaccaacctggccaacatggtgaaacccagtctctactaaagatgcaaaaattagccaggtgtggtggtggtcacctgtagtcccagctacttgggaggctgaggcggagaatcgtttgaacctgggaggtagaagttgcagtgagccaagattgcaacattggactccagcctgggtgacaagagtgaaactccgtcttaaaaaataaaaataattaaaaagttttaaaattcactttggtatgatattttgacccctcaaagttgtttataaatagaatgaacagtggagccatctgttaaaatgccttggctgagtgactcagctagtagatgaattttgacatatttatagcaccatgcattgatcattttagttgtaatataacagctgtttattgagtaccttttatgacataggtcctggagaaccagtggtaatcaaaagagatgatacatctgacttctcacagtgtcatctgttgagggggacaaggatgaaagctgtgtcagtgaaggaggaaaattgagtggtaacagggagggcaggtgctgtggtgagcatgtatgtagcggaggccccgaactgaacacggaggtggttaggggaggcttaggaaggaaatactggccaggctgagacctacacaggaggtttgggggagggtaggggaaggagtcaggagtttgaaggcctacataaaaagtagatacagctataaagaacgagatcatgtcctttttagggacatggatggagctggaagtcattatccttaggaaactaatgcaggaacagaaaaccaaatgccgcatgttcacatttataagtgggagctaaataacaagaacacatggacacaagggaacaacacactggcgcctaccaaagggtggagggagaagatcaggaaaaataatggatactaggcttaatacctaggtgatgaaataatctgtacaagaaaccctcatgacacaagtgtacctatgtaacaaacctgcacatgtatccctgaatgtaaaatagaagttaaagaaaagaaaaacacacacacaccaaaaaaaagcagaaagagaactaagaaagttaattgtgtctgaagcaagagagaagttgtgtatgactgcagcacagaaagcttgaagtgtgggacctggtggcaggcagggagggggaaacgagtggtgagatgggaggggcaggccccaggggaagcagctgggacccggccatgtgaaagtgccagccctgaacctggtctggatgtgtgtggagtgcagtggagagccacagaaggcttgcctgcagggagtcggacagagttgcctgtttgggagatcactctgccttcatgatggagaataggtttggagaggcaagactggaggaagagggcctgctagaagcagtcatgcaggtgggcgctgtgagcctcagctgcaagtattttggagaaaaaatggatcaacatggaagagatttaagatgtagaattaaccgtgcatttattgagcagtaataatattagctaatatatattgcatatttaatatgtgtcaagcactgttctaagtgatccacatgcaatatgttatttaacaacaattgtagtcaacatgtacaatctactttcatttctattccaatcctataaagcataagtactattattagtcctatttttaagtataaggaaattgaagcatagagaggttacgtctagagaaataggaagacaattttagacataattttgaagggatctgtgagatacacaagtggagatgtttcctgggtcattgcatgtgaggttctgtggcccaggagagagtttgggggagattcggtctccagtagtataaatggcagttgaacacgggttgaattgaggagaaagtagaaaagggaagaggaccaagaaagatgaaaccttgaggtatgctaaagatttaaaggatgggcagaggaagaagaatcagcaaaggatactgaagaggagcattgaaagagactgtgtcagaaaacccaagaagttgtgttgtttcagaatttaaaggaagaggctgttttaagaagatgaggtcattgatgccagtgaatgtaagaagtcatgttaaaacaaaaaaaacaactaaggctgagatttatccattggatttagtgaaaataattgagaacaatttcagtgttgtaatggggccagaaatgaaattgtggtgagttcagacattgagatatgcggacaagtggagtgaatgactcttctaaaggcatggtcgttaagagtgggccatggtgttgaggggattgactttttaaaggtttaataaattcttaagtgctgataacaggtgccagaagaagggaatttttgatgattaaagaataaggagaaaaagaagaactaggagaagggcctctgtgcttttttttttttgaaatggagtcttgctctgtcacccaggctggagtgcagtggcacgatcttggctcactgcaacctccacctcccgagttcaagtgaatctcctgcctcagcctcccaagtagctgggactacaggcgcacgccaccacgcccagctaatttttgtatttttagtagagacggagtttcaccatgttggccaggatagtcttgatttcttgaccttatgaaccaccacacccagcctctgttccatttttatatgaaaggacaaaggagcgggtggagatgaagggagagttggtgacttattcacctgtgatggctgctgtgggggaagaggtgaggtgagactgggaggagttgattatggcattagaaattggaagtaagtggaatgttgttgaggctgggagcaagaattgacttaaacacaacagaagggctaggctaaccaagcttccatttgaagtcgtggagcaggagttgatggggtatcaatccatgtggtcagatagtgcaaggcagctctgcatgtccaggaggccaggacacagggaggctaggcggagaggtgccagtgagggaggtggagataggcagatcctgaagggcctttaaactatgggtttcgattttattgtgacattattcattatctagccagcttttataggagcagtttataaagtatgttctagggaatactattgatcaacacgtttttcaaaagtctaaattgtgttcaaattggtgtcttgtgagaattaatagaatacatatttagatcactttcataaataaatacattaacatcatattttcagtaagctcatatttgatatctaatcaaattcttttagtcatgaatttgaatgagaggttttttgggttattgttactgtttgttttgtcttctgtgtttttatatttggaagcagaattagcttttggtctcttaagtgaccccttagtcacttaagatggtgttcatttccatcattgtgcttatcatgcacttgagttctcgtgtttatttctttgtccacttgtttaatttcagcctcttcacactaaaataggagctttgtaaaggcaaggacctagtcttgttcactgtcacacttcttgtacttctcaggaaatattcattgggggcagggtagaggagttggggaaggaaggaaggaaggaagagagagaacagtgaagcgggaaggaaggagttccaaaaactgcttccctagtggtcatggaaactctttaataaattagaatgttgtctccaaaaaatacaggcagatatgcgttgacaattgcctttcatacaccttaacaaactagttacataatgggatatcaaaattcagtcaatgtgtttgctagtttaatttgttgtgattaaagaaaacaatgattttatttataaatttagcacctaggaaatgtgatttcaaatatcaaagcataggcattttttactctttttaaaattgaagggtcaacaaaatctgccttattcttcacagttttttctctgtcagtaatgtagcagtgtgttaatttccagaaatttaatctcttctataaaatttcctgtgacctgaaaacttttgaattggagttaatttaccaaactgtcatggaatgcctgaaatttccttggggcagaggaggtagcagagaggtggtaagttaccatgtttccattgtgtgaataactgataagtgggattccaaacagaatccatgtagcgttttaatgaattcacatttggagaaaaaagtcacagactttcaaaacttacaggaatttggctgtcctagggcaactcctcacttaacagcaagaggggatgagaaggttgagtgactcacccagggaagtgactcacccagggaaggtcaagtgactcacccaaggttacttggtaagtaaagagagaagccagaagcctggggcctcctgacggctcctgcttctctttttactaaggtcttctgccatgggaagaaactctgaatgttagcaaccatctggatggtgttagttgtatgtctctctatgtatgttgaaaagaaaatgttgaagaattgaatttctcctgcttatgggttgtgtcacatttaatagcgttctttaagaaaaaaacacgattgctcaatatgattatatgagctcaccataaccaatgacaggcagaaaatcctgggaggatagacactaacaccacattatcctgttgggataatatcccaaattctgaatataactttcttttaccactttaaaggccaaaaaatggctgttaaatggagtatttttgtcaaaccaagtttttaaagttttcagcagctgcttctgctggcttttattaactactgaagagtctttttttttttttttttttgagatggagtcacgctctgtcacccaggctggattgcaatggcgtgatctcagcccactgcaacctctgcctcccgggttcaagcgattctcctgcctcagcctccctagtagctgggtttacaggcgcccgccaccgtgcctggctaatttttgtatttttagaagagatgcggtttcaccatgttggtcaggctggtcttgaactcttgatctcatgatctgtacacctcgggctcccaaagtgttgggattacaggcatgagttaccggaccctgcctactcaagagtcttaattgaacatcaaaatcctggttttgtttataaggaaaaaaagttaatggtgcaactaggactaattctttgattaattttttaaccacttctacttagcaagtatatgaaacacattaaagactgatgcatctgttttgtttttgttttgagatcaggtagaagatctacaaaactagttggaggctggaaagaaatttcagatagtgatacatagaaatgttctgccttaactctgaatttttagtcatgaaatagtgcaaactcttaacattacttttgtggagctttgtagtccataaaaataacattgttgtagagcctctgtatgcgtcagctgtgactgagtgttttgatgtcttagcaaaaggcagaggagtgctttcctttgaaatgtgtgaggcggtttgagatgcagcttctcagatggatttaattagtccttcgtagaactggatgtccgtttgttgcaactgaattctcatttcattcatccataactagaaacacctcgcttcaaacgggtttcttcaaagaaagaggggtttagggttctatgttgtactgctttttgatgttggtttccctttaactgagaagaccttatgtttatacaactgttattattaagaaaacacagctttcttcagcgaggttccttttgcatcagcgctggttcttggtggcagtcagaggtctgtggaatggatctctgtcagactatcacagcagctgtgtgtttgcagattttgcttatgagaggcatgaactgaaaataggcgtaaacttgagtaattccctaaacccaaaatataagatagaaaccagtaactgaatctggtaacagggtagttgtttgtttcagaagcttatattaaccacaaaaacaaagtgaatcaactaacaagggttaccatgacccaaatagtaattgcattttgattcactttgcctacagtgcacaggtcaggtctgcttctcaataaatatgttgaaagaatgaaatatatccttcatagtaaaattatgttttttaaaaaatatgtcctactactaatattttttaaattatccctaaaccttcacatttcattagaatagctacttcaatttactctgaaaaaactgctttcttgtctttccagtttgtgtgtccagggtctgacgtgctccatcatcaaggcagcttttatcttctgtgtccgtgattctaattacatttcagggggttgtgatctctcccagaatcccgttcatgcattgtgtttaggatgaaatgcttgagggggtttggggctgtacactcatgggcacaggtttgcatatctaaaactttctttgctctaacatcctgatttgtataaaaatcctaaaagcaaatttcagacttctaattattctttgcctttaaggaaagacaaaattaatttagactgttcaagcttaaaattatcccaaagccacagatcacactgaaaacacatagtaatatagcccacaaattattttggtgtcttgtttccatattccatccaagagtctgtagaatctgtaggcttatatttctgtcttgtttcttagccataactgatcttttccatcttattcaccagactcagcactgcgtaactgtggcaatttctgaaactcagtggcaagggatataccaccattgaagagattaaaaataatcaacaaaggctttaaaaagtttaaaaaatgtatttggagcaataatagcaataggtcagaaaaagttttcacggaaagggccaatatacaattaggtttccatctctgtattcttgattgtgtgttttatgtcttgtgactatcttgtggagttcctaattttaaaagaattatgggtgtggctcaggaatattttattacatttgtgtaaattaaataattttttaaaattatggatgtgatttaaatattcttttagtggttctgcctttggtacagtgttccatgattttgtaatgtttttatttgttgaaaaagctctaaaaatcttggtagaaatatagaatctcagaaggcagaacatttggtaattatcttttatatcaatttgcaagacaacttgttagggagccctatttctagtagttgaagttaataagtaacaaatcacagcaatcacgttttttatcatgcagagtgggcagtcttataaaaaagaaacgtcagtctttttggatatagggacacaagcaatcatagttttcctctgttatctttagtttgtaaaaatcaacctatctaccatcagcatttacccacaaggtttagtttggagttacctaaggggatggtagagaaacaataatttaacgttatgctgaaaacaatagtctctgaagatagagaaacctctgtcacttaccagttgtgtaaagttggaaaagttacttagcctccctgaaccactgcagcagtggtgtttacctgaatgttggcatagaggaaaaccaagggtcacgaggcaggtggacttgagtttaaataccaatcctgaacctgctggctgtggaatccagcagaagttagttatcttttcttagccttagttttccttatctgtagaatagggatagtattctccagggtttttgtaaaaattaaatgagattttatataaaggctctagtacagtggctgatgtaataagcaccccagaaatgatttctcttccctctaaaacacggatattttgctttttaaaagaagctaaagtagcttttactttgcaagcagttcttttccattgtatgaaaaattcttggaaagttttaaaaataagacaaaagggagccacagtggcccaggcctgtggtcctggcacataagcagccgaggctaggcgttcgaggttagcctgggcaatatagaaacctcttatctatataataaaaataagacaaaaaataaaatgtgccaacatatattagcaaggtttgtcagtactgattaatatttttacattctaatattctttgttagaattgtatttattttatgaagccccttttgaatctacagcagactacctgggaagtagttatagaggtcatcatcgtgtcttggtgattcactttgggaaattttgttgagtgaggctggtgaacctagaaagctgcttcttctgcctccccatttctgtccccaaggccctgctgtggttcaaaagcccatataaacctgcagtttccctttcttccacgatagggcgcgcacctacactgttagggtatggggccgactggctcctgccctgtgggaggtttgatccttgtccatttagaggcccttccttattcatggacactctactgagtgtctgttgcaaactccctggtataaaccccagacgtcatggatttaccacactaattattagagtggccattatttgcaataaaatagtgacccttgccactgtgttttcctaccaaataaacttactgacaagtatctgcattggctgggtcgaggtgtcatcaaatcagcctaggtttggatgtgctgttttgctagctgtagacccttgagcaattatgtaacttctctgagtgtcagatttgtcatctataaaatgtggttagtaacgtctccattgtaggatcgttcctaggattctgtgagtgtgatgtatattaaaatacctgattgatattagggcctcagtcatgttcctttctttgctttagactcatttctctgaaaaagtaatacgatgtttatagttggggaaaaaaacccaaagagcgttcataatctggatattaccactattgaaatttctattttgattcagtgttttttttgaaggtattcttatttttaagagagggaattataaaatatgccattttctaactcagtgtttaaaccttaaaaaaagagacatttcttgaaatgttaaacctatggctttgagcatggctgtgtgtggctgtatttgctcttggccatatttattgtggcagcgtggtaatgggtttatgcttgttttatcgcttgtggtttttataaaataaaaactgtgtttggctgtgtgactgtcgttcagaacaagattaaggaaactagatggagattaaacatagcacaatcttctgttgtaaataaccatagacaaacttgtgagcagctaccaaattccccagttggacaaaaagtgcttctttttagctttgaaaacctagtgatgatgatttgagaactggcataagtctctttaatcattcaggttcagcgtgattagaagaagagttgttttaaatgtttttgtgattagatttgaaacaaagcttagaaggatttatgattttgtttacaaccagctacgaaaaacaccaaggaaatgtgaaagctggtagtaattggtgagcttgctgggagtggatgttgtttccagtagtgtaacttaacaaagattgaaggaagctccgtgccattttatttcataccactggtttaggtgcattaattgatattttaaccaaaattttaatctaaatcaagtcttttaggttcaacctattccactgggttttaaatgatcatatatgcataccacagcacatctcacattgagaacgttacctcagtgggaaggttgtttcattcttggttgagtatagcattccagcttgtaattaagctgcaatacaaaaaatatacgcacttgctagaaggatattcttgctagcattctgtatgtatcatttgcttattcaagcatataaaacttcaacaagaggaggtaattttgcttagatctcttgatttgaattgttccgctatttggcactgggtggaaaagggaaaaaaatcatattgaaagcattgttctgttaatgaagttgcttgtccttttttgtgccaaatttggcaggtaaaattaccatttattctacttgctagagctggagaatagactgttgaggaaaagtagcaatttaagtaatgacactagatagaatgtgctacattatatacatctcccatacttttagatattgacatgcaatttttatttctctttagtaatgcactttgtctttaaccactacattacttcccgtaagctccatcaactacatgcaatttgcttcagttgtgaaatttaaaaatttactattaattataataaagtgaagcattttgattcaagaagaaattaaagattgctgtattttgttctggatatttcagaagtattgtattctttttaattctgaatatttaacataaaaaagatgaaatagacgcattggttaatttgaagaaatacaatcaaatttgaggtattcatggttttttccatgttaaatatgctttgcctatttatatttgccttaatttttgttttgtagagtataaaagagaaactttaaactcgtatacaaaaatgggaaaatatctaaaaatatgactaggtagttttaaaaattactcacgtattcaaatgaaatgcataagtttagcatttgctaaatttgagatattttatttcatattatttgtaaatatatttttgtttggcgtgaatttgtaattcactaagtttcttgtagattaaatttttcttagttgtaaaacttcaggcttaaaaaaagtattattattgttacaatttacactataatggctaaacttgcccctcctccttaaaagaaatataaactaatttgcaaaaatatattttttgaaaagccaattggtgaatttgtagacttgtaaatgttaattcaggaacagagttgagtattgctggaccttctaaccatcactcatttctttctgcccactaaactaactggtaggcaggtgcagatgttacaaaatctagcatcgcaattgacactaattggcatagttgttggcagtcttatcagaaagcaaagggctgaatggttgaatgggtttagagaacttgaatggtaataagcatttttatatgcatcttgaattacttttgtgacccagactaacaggaacactttattctgacctcattcttcaatgaatagaaattgtagaaagcataatatgcagtgtatgtgatgactgattgtttttcaggtaaccttttacagctatctgctctgttgcctacttcctccccccactacctcccttcccagtgctcagagaaaccaaagtactgtaaatgtgtggaataaaaaggagataacaatcattaatgaatattgaattaatttatttgagtggtttgttgccaaaagcttgaggatgtcataagagttaggctaaacttaagaaaaagtattcattgaatttatggatgaaacaaaaggacgactgggacttgcttcttaatagtcttggagcaggtgggtgaatcagtggggatatggataaaacaggattggctttgagtggataagttttgaacttgggtgatggatatatagaggtttattaaaccattctttctgtttctatatatgtttgcaattttccagaacagaaaggttgtttgtttagtatgcggggtgacttcaccctctgctgttgtcaggttttttcaatacctgccagttcctttccaggatctgccttttctcccccagttccttttatcaaaaagtacccatctaaagtgagaactacatcacctgacaagctgttctgtgcgcttatgtataaatgagttattttctaggcagtgtggattttaataggagttttctaaagacactgccttaattaaaggaatggctcttgggttgggaattatagtgttggggtgggtctttgtgtctatatgtgactatatgtagaccactcttcacacttacagaagtgttaggtgataattttaggtgtaatatgatgattgatcttagttctttttagttctttttttttttttttttgagagttttgctcttttgcccagtctggagtgaagtggcgtgatctcagctcactgcaacctccacccactgggttcaagcgattcttctgcctcagccccctgagtagctgggattgtaggtgcccgccaccatgcttggctaatttgtgtatttttagtagagacggggtttcaccatgttggccaggatggtttcgaactcctgatctcaggtgatccacctaccttggactcccaaagtgttaggattacaggcgtgagccaccggcatggcctcatcttagttctctatgttagaggtaatgatgtctttttcttctgtagaaagactttccaaaaagaaagtgcttttctttaggactttttagaatatgttcaaaatactgatctttgactaaggagaggaagagaaaccaagatcatatttcagactattgtttcttttcccatggttttggcttatcccgagaattgacttgacgtgttcccttttttatttcaaagtagcattgcttgaaatattttagattttttatagctttctaaggaattaaactctaaaaacactttaactgtttttttgttgttgttgcttgtttgtttgtttgttttgatacagagtctcactctgttgcccaggctagagtgaagtggcgtgatcttgactcaccacaacctctgcctcctgggttcaagcgattctcctgcttcagcctcccgagtagctgggactacaggcgtgcaccaccatgcctggctaatttttgtatttttagtagagatggggtttcactatgttggtcaggctgctttcgaactcgtgaccttgtgatccacccaccttggcctcccaaagtgctggaattacaggcgtgagccaccgtgcccagccaactgtttttttgtgttttttttatttttttttaattgtatcttgggaggccttcatgagtgaatgtagcttgctcattattttttgtaccattcccagtcattttctactcattcctttccttactagttttcagtttggccatgttctgtgtacaatttctggtaagtgctaccaaaaccaatatatattagacatgctgtttttcaagactcctgaaaaagtgccaatcttattctcctttcagtttgggagcacagtttcacaaataatagaatagtcttactttgtttgcagaattagaaggatttatctaacaacttgaatagataattttttttttgtagacgtgaaagtgaaaccttagtattgggatagaattttaagtagcattttaaatttgtttcaaaatcttttcttattgcctgcctttcattaaatgagctatggtaagtatgctggggtgtatacgtgtgcgtggtgatgagatgtttacctctgtgtggatcccttgtagattttgtattgtaaaagtgcataatagagtcctttatatagctggaataactgtaatctgctattgtaagcatatatggatttttaaatacaaccattataatactttataggacattacaactgaaaatattttgacttaaaagttgctttattagtcttacaaaagctatgttgaagagttttttgttttttgttttttgttttttttttaaagaaccatgttgtcagtggtcaacaatcaaatgtaaaaaacacttagctggaaaacatccattaagataatgaaagtgagccacgatgcttgtgtcagtttttatattttagtttaaaacatagttttttagcaatcctataattataaatataagttagattttctctctaatttaattagataatttttattttaatacaatagatacttatcaaggatctgtcgttcttcaagatcagggcactgtgctgagttcttcatgagggccatgaaggaataatgcccaccctcacgaacttccagcctagtttggaggtgttgagattaatacagtaatgattgtaatataaggcttactctgataagtacattgagatataaagtgttacagagattcagagcaaggaaagacccagccctatttagcagtgggcaaggggtggtatgggtgggtggtattggtaggggcaggggggatgaggcagaaaatcaagagcaaactgaacaaaatgaatagaataggtgtcaggtcatggaagatggatggtagaattctgttaggctgaattggctagtccaaatttaaaaaatagtaggactaaagtttaggatatagtgcctgtgcacatttgctgaatgtaagagaaagtgggaagaaaaattgaaatgatagttagattgtgaccattagtacagaagacccagaggaccatgtggagaacttaattttttttttttttttaattaagcaaccagaagccaagaaggattttgaactgagaaaacttgtaagacacagtaaagccacatttgtaactggtctatcgaagtgaatacaactgtagcaggttggagatggggctttgggaaggttttcttgtttgatgggattgtcagtagtaaaagaaatgggaaggaaaagagttcacattcagcttagaagttgagaacaaaatttggggagatagatgagagagatgtcaggtaatagttgggggttgggaagggccaaacaaacaacactcagttattggcatgtgtgttaggccgtttctcacactgctgtaaagacatacctgagactgagtaatttataagaaaagaggttttagttggcacatggttctgcaggctgtgtaggaagcatagcagcatctgcttctggggaggtctcagggagcttccaatcacggtggaaggccaaagaggagcaggtgcatcacatggtgagaaccacagtgagcgggggtggggatgtgccacacacttttaaatgaccagatttcactaaggagatggcccaagtcattcatgaggaatccacccccattgttgcaggactttttcttggtttagctaaggatggggttctttgtcccatggccatgaaaattcaggcccacagacaatttgaatggtgagtaagacagggttttattgggtgaaaaggaaaaaaaacgggggaacagggactcttcaaggccagagtcctgctacagtgcttcctgcctgcagcttgaatgtttggttccacacaggaagaggaggggccaggttcctccctgctgcaaacactgcgaacttcctgaggccccaccccagtgcgcagctggttggaatttttccaagaaccccctccctcccacctggctgtctcattctcccctctaaagaagtacatctaactgccattagaatacggataaggacaaagaccgatcttaactgcttcctgctgacaggggatgctgttttggggaaacagcagtcagagatccctcaaaggcctatctaagcgttcccggcagaaggggccgttgtcagagtctccagttgcatgaccatttggagtttgatggcctgaaggcaagaacagacaaaccgggttgttagaaaacatgtatcaaaaggaaaccagaggacgggtaaagatagctaaaaaattaggccttttaccagtttgcacagggagaaggaggccaaaagcccgactggtcaggaaaacttcacacttttgctggcatgttgggcttctgggttcccttcccctgagcccagtcctaagccaacccgtttaaggtttgggaaattaactctttccagcttggaggatgcatctgaggtgagtgtatcatagtatagagacacaattacctatttgcaaagagagaactgaggaggagaaagaagaaaagaaggcgttttttttcaaaggagtcctgggggtcccggatgcattcaaaaggcgtacaaactgaagatgaatggctacctatctagaaagaggggagcaggtgtccctggttcccttctcttcctagcagatactcagggttagtgagggagagaagagagagcatcctctttcctttcttctatccttgcatccctgaatcccagcaaccttggtaggtgctgccatggctgtcaaatcaacttgcaccggtgaagcagggggcctagggggtgagaatcatccactcttacccacgtaacgccctatctcccctgctgtcagtagctttgaattctgtatgccatggatactaatgtggcctttatccatgaaacaggaagccttggggttggcttaatcagcaggaatcagccactctcacctgtgctgtgccttttaaccttggtgttgtcatctgcctctggatcccttacatccagttttctttctagggctttgacccgaagcttggaattgagtcgggaacacaaatgtgtctcgaggggagttgtgtggactccttaccataagtggaatactaaggtgaaactgtggaactgagtcctcctccaacaagggagaggaaagcatgtcttgtgacacacccagataactggtgactgtagttatgcttgctaggatttgggtgcatggtgcttggctttggttcactcccttggtcttactttacccaaaggaaacctcggagtgatgggcatcctatttattcccatcccctggcaggatttacaggataattgctcagaactagaatattgatccagacttttacattacccatccctcttgttctttctgagctgcagccagagattgctggttggtttacaggaacaagcagggttagtctaaaatgtaggtgaaaacttaaaaacaactagtgagtttagaatttaatgacaaatgtatgataagttttggaacataatttctctccagtcctcatttttgttaaacaaaaaaaaattatgataggactgagtggtttgcaaagtagactttagtcttattctttgcctgaatatttgcataaaatgcaacaagaataattatttctacataggccttttggattggctttgatggatgtctattccacaaggaatctcagataagaccttttaagccgagcccagccatggctttctatcctcaaatacttgcgagttgggtggtcctctccttttaaggtcccaagctaaacttggagctcctggacctgttaggaagtgacattcttttttttttttttttttttgagatggagtcttgctctgttgccaggcaggagtgcagtaaatctcggcttactgcaacctccaactcctgggttcaagtgattctcctgcctcagcctcccgagtagctggaattaaaggtgtgcgccaccatgcccagctaatttttgtacttttagtagagacaagatttcaccatgttggccaggatggtctcgatctcttgacctcgtgatccacccgcctcggcctcccaaagtgctgggattacaggcatgagccactgcgccccaccagaaagtgacattacttactgaccacaggtcagtaaccctttacagggactgcgtagacaggggtatgaggccattttccccactgggctcttactggctctgcaagtcaagattcactcctttcacagtgaaagccttggtaaaataaccactttctccaattgtgtcctgttgcaaaagaaaaatggattcttactacactgatgcaaacaactattttgtcataagttaagaacactcacagatagtttccaaattctagaggaagcaggaagagagaaacaaacatgctccaaaccttcatcacagtagtgtataccttacttaattattaaagtccgtaaacagttcaaaattggccgggtgcggccgctcacgcctgtaatcccagcactttgggaggccaaggtgggcagatcacctgaggtcaggagttcgagaccagcctgaccaacacggagaaaccccatctctactaaaaatacaaaattagctgggtgtggtggcacatgcctataatcccagctactcaggaggctgaggtaggagaatcgcttgaaccgggaaggtggaggttgcagtgagctgagatcatgccattgcactccagcctggctgggcaacaagagtgaaactgtctccccacccaaaaaaagagaaaaatagttcaaaataagtttccttgactctgaaaaactaaacaaggatcagcaatattccaagcaaaagtcaaaaaggttgcttcaggtttctgagttcactccattaagttctcttgttttgcttgatatttgtgaacacttcagctctttatgagtcttgtactttttcctttattttaatgttacaatcttcaaagttattagaagcctgtatttgagaggacctgttaaaattctatagcttattataaaccatcttttgaaaaggattaaaacaagacaacaattgctgtgaatagctaaatatccagggtagttacagttagaaacacaactgacaaagaagttcggttatctccatggtttacaataacttaacataacaaccttaattatgattaatagcatatacttggacattagaattttagaaatcccatacaatttgggaacacatattagcattattcacaaaaatataacctaaagaagattgaacatcattttggcaatcccatgtaaactaaacatgttaaataatcctgtttacctctctttctggacattccaggggccctctggactatccgaaaagccagttgtcaggaaagacaattttgaaactgaagtttgattttgagaaggccgttaaacgttcaaggtttaaatactttgtgttataaaatagaattccagattaccataaattatttattttgccaaagtaatgactcagaagttttaaataagtaaaaaccttttatagccctttacgaattttgccaaagagcagattagcgccttacaaaaaccttgttgtgtttttatttcaatgctcaatctacagaaaaaccatattataccttttggaatttagtcaatatgttcacatagagaacctcttctgcaagattcatttccacaattcttccaccacttgtttgaaccttcagctttttcctaatttaaaactgtcctttaacctagacaaaaatttatatttccatgcctccttgtaaccttttgctaaaaaacacattttactgttcttacataccttgcatgtaaatctatttccagtagtcttaattacatgttataatagtaactcctagcaatttttaacttttttaaaacttggggctgggcatggtggttcatgcctgtaattccagcactttgggaggctgaggtgggtggattacctgaggtcaggaggtcaagaccagcctgaccaacatggtgagaccctgtctctactaaaaatacaaaaaattatctgggcatggtggcgggcgcctgttatcccagctactgtggaggctgaggcaggagaatttcttgaacccaggaggcaaagcttgcagtgagctaagattgcacgactgcactccagcctgggtgacagagtgagactccgtcttaaacaaacaaacaaacttgataagttgttttaattgtttaattgtgtgctaagtgctgccaaggtttgccttcttaattaagagcatggttatatgtccccagcccttaccagttgtgaagccagcaagtcaaatagttcttaaaactcaaaaagcagcttgtaacctcaaaatacttagcaaactttgtatctgacctgcattgtttagtccacctatttacattttgacaacatctgctctttaccaataatccttaaggctgtttttgtttctcaatgattaaagtcacgtgaactgaaaggtatcacagtttttatcttccctttaaaaaatattagatccaagtgcttgtctttgtttaggccaaattaattagagctctttttacagataccacacacagtatatacacagacaggcaaaagaaaacccagtcactgggtggggccctttaagagacagggctaggaagacatgcagatatggaaccagagagggctcatcccctaaggcaggattgctaaacaaagccttgccactggagttagaagccatgccctcaggatgtaaaacaagatggaagcctgatttcacaaccaacaccttgcagagaatacaaacagtgatagttccggggtgggggtctggcctagtaaagtgttttctaaaagagaaaaaacttaaaagttaactgttgacagggtaaagtaggaaaaaaacaacaacaaaacaacagcaggttaaaaaatgcctaggaaagaaccttttattctcatgcaagtggttctttcaccgaggagagaagcttaagcttaattactgtccgatggagttgaaacccttggctggggaaggggaaggctccagtggctcgtggcagaaaatgccagccagccaccccgggtgcccttggaccatgtgtccaagcctcagcagtggaggagggaggtagggagctgctgctctctggtccctcccaaaaaaggaagaaaagggctatggaaaggtcgggttggttctcaacccctgggagcagcaggcggtgggggcacagtttcctccaccctcagaaatctcaggataaaaaggcttaggagccacagtgaaaggttttgagtccccatttcactcactgcttcttgagccccacattgggcgccaaaaatggttcctggacttttccttagttcggctaaagatgaggttctttgtcccatggccagaagaattcaggcttgcagtttgaatgggagtaaggcagggttttatagggtgaaaagggaaaaaaagggggaacagggactcagcgaggccagagttcctgctagagtgcttctcacccacagcttaaattcctacttccacataggaagaggaggggccaaacggtgcagatggtgaggacttcctgaggctccaccccagtgcacaggccagttggagtttttccaggggccccttcccgcctggctatctcaccatgatcggaacacctcccactggtccctacctccagcagtggagattacagttcaacatgagatttgaacagggacaactgtccaaactatatcagtgtgtcttttagagttggccatttttgtcacccccactcgtttatttatttttttgagatggagtctcattctgtcgcccaggatggagtgcaatgacatgatctcagctcactgcaacctctgcctcctaggttcaagcaactgaacctgttgagtagctgttgggattacaggcatgccaccatgcccagctaatttttgtatttttagtagagacggggtttcaccatgttggtcaggctggtcttgaactcctgacctcaagtgatccacccacctcagcctcccaaagtgctgggattacaggcgtgagcaaccatgcccagcctgtcacccgtacttgtgatatgattcaacaaacccgtttctatggccaaattggtttgctaattaatgtactatatggactgggattctttggtacaaaacgtgactgtccaaatagcctgactaattatctattttccttaattttttgccagggaaattttttttgtttttgttgttgttttgttttgttttgtttttttgagacggagtctcgctctgtccccaggctggagtgcattggcatgatctgagctcactgcaacctccacctcctgggttcaagcaattctcctgccttagccctctgagtagctgcgactacaggtacatgccgtgatgcccagctaatttttgtatttttattagagacagggtttcactgtgttggccaggatagtcttgatcacttgacctcgtgatccacctgccttggcctcccaaagtgctgggattacaggcttgagccaccacgcccagcctgccaggaaaattgtaaagtctacacacagtggagctactagtgtagtgagcaccatgtgcagttcttgcggacctctccttgcacaccactgtttttattctgaagtattttatagcacgtattgcagtcctgtaaattgatgctattttttttaaagtttgttgaattgcagtatcctaaattcccaaacccatgtccactgacaacctagcacactcttttttttccccaagagaaactcgtttcttattaaattttgcattagtgtcaaatcggttgactgttttttttgttaaagcactgtcatatttttttctataatatatactctttgacctactgtgaaatatatttaaagtagaagatttatgtgtatgtcagacaaattgtgaaagaaaatagtagcaaacttgttagttagccagataatgtgaggcagtttctcactgtctgtctttgaagggagttgcaaatatagaataggggaaagttaaaataaatcctacattgttgaaatgtttggaatcagaggtatcaatgtgaagtcattttttttttaatcagtagacacagaaacagatttagatgtatttgcttagggcttaactttacaaacttggcagaaaccatcttaaccagtaataaagtaaccttactggtaatgggacaggtgtgcctcttgattttttttttttttttttgagacatggtcttgctctgttgcccaggctggagtgcagtggcacgatcttgactcactgttacctctgcctcccaggttcaagtgattctcatgcctcagcctcccaagtagctgggattgcaggtgtccaagccatgctaattttttgtatttttaatagagacagggttttgctatgttgaccaggctgtgcctcctgatttgatgctgaaaaaagcacaacattacttctgtggtattccagataaaaatacattaatcaagaggaaacattttcccaaattaactggtctatgccctgcaagtctggaaagtgtcttagtcaatttggactgctataataaatataccgtagaatgggtggcttaaacaacagtcatttattcctccagttctgtaggctgataagtccaaaatcaaggtgctggcagatccggtgtttggtaaggacccacttcctggtttgcagatggccatctttcttgctgtgttcattcatggctgagagcagagggagaggaagcagctcttgtgtctcttcttataagggcactgatgccatcaggagggctccacccccaccacctcattacctcccaaaggtcctgtctcctcatactgtcatattgagagttaggcttttatcatatgaattttgaggggacacaaccattcagtccatagcacaaggaaaatcatgaaggacaagcaaagttaaggaactattcaggttgagagagacaccaaagagacatgaaaactaaatgtatgaacctaaattagatcttagacataccataaaggacattattagggctattagaatttgaatagagtttgtggattagttggtaatattgggttaatagtaaattcctgttttgttgactgcactgtgctgtcgacaaaatgttagtgacagcaaaatgttgttgatagcacagtgcagtcaacaacatcaggaagttactattactccagtattgccatctagttcacagactctgttcacattcactaaggagagggtccttgtacttgggaataaatgcggaagtattaaagggtaatgggacatcataaaatgtattctttactgctcagaaatgttagcagctagggaatctgggtgaagggtgtaagggaactccgtgtactattgctataacttttatgtatatctgaaattgttttacaagaaacaaacaagatacaaagaaatacctccccaggatgtttattagaacaatagaggctaactataccatttttctatttcttattaggtgcaataaaaggacactggtaactgtaaatttaacagttaaaagtaaggtcatggcggtggcttacagctgatagtgccctgtatactctgtacaagtgcatgctttattatgatcaacctaatggatagttagttttgtttttttttaaaccagggtcttccttgagatgtaatgggcacagagtaaacggctgattgttagcttattctgtggatgtatgtgatgagtgggtctggggcatcagtttctatatctcacctttacctatcaaagaaattggacaaaccatgatagcaaacaaatgaaaagaaaaaggagttttattgttcatgcttacaaaagaatcctgttaatcaatttgtaatccaccaattattttgggaataaaattgtagcaaataaatttaagatagaaacataaaactattaaacatgttatttgtattataatgtaaaatataattaatattttagtatgtacatattaggaataatgtcactggtggccccagaggctaaaaaacagaatgcaaacctgctggaaaatccttggtagataggagcatagaaaacagaatatcaaatgcatttattgttggccaggagacatggactactaggggaaattctgagtgtctaaggatagtactagaatgctaaacagtcacagataataatataaagtaggtaggattaacaagaaacagcacatcacagtcacaatgtgtgggaattaggcaaaggaaatacgtagccatttttatggacgtcttatagtccacttagacaatagatgtattctgtggtggtaaaccaccagcttaggtaatgggatttattggaggacatcagtggtagcaaaatacatatgaaaagcaaaagcatactaataggaatctgatgaaattaagagaataaataatggaggagatattagtgaagaacaagaaaaattgaagaacagtaaaagtaggcatgcttggaaaaggagaaaaatagatctctaataatcatttttggggaggagtatagagcgtcactaagttgaactaccaccaacagccagcattcattgagggcttattatgtactaggtgctgttctaagggcttgacttcattcctcacaaccactccttgaatatgcattttacatatgagaaaatggacacatgaacaattaggttacttgtggaactgaggttcaaacacaagcattgcgaccattcacggcaatactgcatagaaacacaggattccaccataatcaggtaggggagcgaaaggcagtttcaattgttctttatgtaaagaactcatctacctggagttattcattaagctgatataatttacagtgtgatctgcagagaatgaccttatcacaccaatccaaaagaaactactactataattaaactgtgggcaaaataatgtaggatatttttgtagaccgtaaaactgaaattaaagttgttactgatcaattaatgaggtgataattaaacagaaactagccaacctgactgattgtagaccaatacctaaaatttgtttttgcaattcacatcctttgagatatatttaattacatttataacacatggatatttaatataatcttttgtgacagattgacagatcttcactatcattatgtgtaattcctcttgatgtttttgtcattattacatatatatttgggagagaaataaaaggctgtttccaaggtgatggtgataaagagcaaacttataaaaatggttgcctccttttgtttgtataaaacaaccatctcatttccctctgggaggtcactagaggtatgatagctctgttttgaaataatattttagtaaataggaaagcagggtaaagaaagcctcccctttttgtgttatgttaaggtttaaaactgtgttacagtttatactaaaacattaagaatcaattattataagagcattaaattgtttgagttttgtcatgctttgcctagaaatcagcactgaagcgagtgacttagcaacgttattagatctattaaataattggaaatttatgtgcttattgtcagcatcttggctttttagaattttaaagtatgtttgtgcttcacatctctagttgcagtttatgtagaatttagtgaactataataacgttggatggtggtaatgtcacagtgtaattaactgcatagcatacaaagttctttgttaatggggaatgggatatacatcatctatttgatatataagttaataatcatactttttgttagcagtagttaaatgataagaactaaaaagaagcaataaacatctccatctctaaaacagtcttgcaaatatgcagtgagcatctactgtatacaagcactatatcttcatatttagattacatttgctattttgcttttcacatgtgaacttaagtgaaatactctaaggagtattgcaaggtaattgcccctataaattacataatttatatggctctttaacttttttagatgtaaaatgggaggaggagagcgttgagttggagtgtattatttctaggattctttctagcccacaagtcgaatcagaaaacagtggctcatgcctgtaatctcagcactttggaaggctcaggtgagaggattgcttgaggccaggagatcgagaccagcctgggcacatagtgagaccacacctctacaaaaaaaaaaaaaaaaattagccaggcatgatggcaaacatctgtaaccccagctactcaacccgctgatgtgggcaaattgcttgagcccagggggttgaggctgcagtgagctggatcccaccactgctttccagcctgggtgacagagtgagaccctgtctccaaaacaaaacaaagcaatcagaaatgtacagatctttttccacagtttgtgcagaacagtcacttctaagatatactatgaaagtctattacaggagcaggaactagttattcctttctgagaattagatataacttgaccaacaaatcggttttttatccttcatatcatcttcagaagtagaagcaagatatatgatcaaagtctttttaaaaatagcagaataccggggtttttattttatattttcactctgcacaatgctaatctccttaacatttgatgacaaagaaaaaacttggaatttgtgtatgacaaaaagaatgacttatgaggtgaatcgaaaacactttttacagcctctgtcttcctaaagtttattgtttttggaaatagttttttggcaaatattttgttttgtaagttttacatttctaaagttgaataaaattaaatgtttagcaggtgcttgttgtaatagaagctataatattttaactatgtcatgaggtatctctgaggaagtgtttcttttttgttttttaatggtaaaggatgtcagtaatatctctcaaatgtcaaattaatttagggtgtgtactttctttttccctatgatgacgtagataggaaaatcgaatgttccaaacaactcatggaaaatgttccacttcagcgttatttgtaccacaaatgcagtgaaatgcttttaatggaatccagagtgataggtggattatgacatgtggggagatgccttcttgaaataggacataaatcatggttttttttttttttctgagacggagtctcgctctgtcgcccaggctggagtgcagtggcatgatctcagctcactgcaacctccacctcccaggttcaagcagttctcagcctcttgagtagctgggattacaggtgcccacgaccatgcccatctaatttttatatttttagtagagagaaagtttcaccatgttggccaggctagtctcgaactgttgacctcaagtactccgcccgcctcggcctcccaaaattctgggattagaggcgtgagccaccgtgcccagccaaatcatgtttttgaacttgttttaaatatctgtgtgtgtgtgtgtgtgtgtgtgtatgtatttttttttttatggagtcttgctctgttgcccagggtagagtgcaatggcacgatctcagctcactgcaacctccacctgccgggttccagtgacctcagccgcctgagtaactgggattacagacactcgccaccacgcccaactaatttttgtatttttagtagagacggggtttcaccatcttggccaggctggtctcaaactcctggccccataatctacccgccttggccttccaaagtgctgggattacaggtgcgtgagccaccgcgcccgaccagtattatgtatattctttttgtttgtttgttttttgagatggagttttgctcttgttgtccaggctgcagtgcaatggcgcgatctcggctcactgcaacctctgcctcccaggttcaagcaattctcctgcttcagcctcccgagtagctgggattacaggcatgtgccaccacgcctggctaattttgtatttttagtagagacggggtttctccattttgggcaggctagtctcgaactcccaacctcaggtgatccccccgccttggcctcccaaagtgctgggattacaggcgtgagccaccgtgcccggcctgtcatgtgtattctaattataaataattttcaaccaaactgatatgtttggttaagctggggaaagttttcagaaaatagagtacactgagatgaatttcatgaactgtacccaccaaagccttgtcctggttaattcaaatttataatgccaatagtttaaattagcatttagcctttaagtgacggtggaatggtgaggcatatgatgtttttataccaaacactccgtgctccatgtcttttttggagtttacacttttcaaaaacaggcggcacttccatgtgtttatttccccttcatctctgtttagtgaatgattggtttcatctttacaaagattattctggctgtagtggggagaaccagttggagatatggaagatgtatgtggggaggccagagtatcgtggcagtctgcctgagagatgcagtggccggggtttggtctaagatgttattggtggagacggagagaatttgcggtatttgagagccactccagcctccattatttctaattctatgtcctctacccttctctgtcatctctccactgcctcccagccccttccactgtgccccctgtattgcccactttcagaccaacagccttttgtatcagccttttctggaatgttccactaattacttaccctaactaaaaccttagggtagttttgttctcataccacacgcacctccaagacaggaggtgggattactttcctcctcgtgtcattcaggacgactgctccgctctttcttgtaagccctttcttttttgaaatcacatcatcagtcttcactacctcatcttcctcttggcaaccttcagctccccttccctgtatccctctccctgcacgtgaagaccagcagccagttcctggtctgtctgtctgtctccatacaatcattattccctgtattttctctccatccacagacaccactcctgtttttacatcctttatccaatccctggcctggcattatagtcactcactcatgaatacccttaactgctcactccttcattcttccatcagtctcaaacttagaggaactctgcctccaccttccctatgcctgcgcatgagcaccttaccatggctggtgaacgtcccataccaagggcacagttaacatgcgtctgctggtcagggccagctgagcatcctacactgggcagaagggttgctgtttctctgataacttctcctcccttatcctcagtgattccttcctgtcttcaccactgtattcacatgtcccacgctcctgctgcagctgacactacttctgaatgtccctcttctctataccaccagggctctagatctgatcaccatgacttttagttttatttcctctaattcattgtccaagctatagcctgcatgatctttcaaaaatggacagtgtggctcacacctgtaatcgcagcactttgggaggccgaggtgggcagagatcaggagttcgagaccagcctggccaacatggtgaaaccccgtctctactaaaaatacaaaatattagccgggcatggtggtgtacacctgtaatcccaactactcgggaggctgaggtgggagaatcattggaacccaggcagtggaggttgtagtgagccaagatcatgccatcgtacttcagcctgggcaagagagtgagactccacctcaaaaaaaaaaaagaaaaaagaagaaaaaaaaggacagcagacaatggcactctgcaggtggaactgcttcatgtttcccactcctgtccctgttcttcaagagccggcctccccttctctctgctccatccacatgggtttcaaagaagcttagctctttctcaccccagggtttttttctttctttttttttttaaatatgatattccttctagaatattcccacacacccatcactagcatacttaattcctactcacccttccagtctttgctcaagatcacctcctcagagaggtccttcttcctgctgacaagtaaagaataatgagaattcagaagaggctatagaaattggctgggtgtgatggctcacgcctgtaatcccagcactttgggaggccgaggtgggtggatcacttgaggtcagaagttcgagaccagcctggccaacatggtgaaaccccatctctactaaaaatacaaaaattagccaggtgtggtggtgggcgcctgtaatcccagctacttgggaggctgaggtaggagaattgcgtgaacctgggaggcggaggctgcagtgggccaagattgtaccactgtactctagcctgggcaacagagcgagactttgtctcaaaaaaaaaaaaaagaaaagaaaagaaattgctgaagatttgtgatttttcacaatacagttttagtagtcagattatagaaggttatggggaaaggtgtatggtaagaaaatagctgcagagaacttgttttagaacctgtcagagaaaggaagagacacagttagggagctatggagtcgtgcatgtgtttgaaagcagaggcgagacgccagtgtagactgaaagctggagaacagcgaagttaaaaggattaactaagaagcagagagggcatgagatgggagtgaaggaaagagcatggctggttaggcgagaaaataaggacttgggcctatggcttcgattttggtaaagagaagaagtcatctgctgagagtagggggcagggttataattaatgtaagtttggtgcacttgagtccttggtcaatttcagggcaaattatataatctttgtttacattagcatggctgctaaacacctctagcgttgtgtctttggatagtttatgaaatacagagttttttgcataatttaaactactccagtgttttcacagtgctaagacattttgataatattgtctgccttgaaaggagcagattttacttgtgcctcaggatattatgtcatttatcacttcacttttggcttatttttctttttatccccacactgaatttgatttaatttgttagcttttattgtcaattaaaggcaaaatgtcaaaaagttctaacctcaaacagaggtatgtgagcaaaacactcactttataatattggaaatagccatattagaaattaaatgtctgaggtcagatatggtggctcacgtctgtaatctcagcactttgggagaccaaggtgggaggactgcttgagcccaggaattcgggaccagccctggcaacacagtgagaacctgtctctccaaaataaattaataaatatataaatctggaggtggtagctcgtgcctgtagtcccagctacacgggaggctgaggtgggaggattacttgagcctgggaggtcaaggctcagtgagccatgatcatgccactgcactccagcctgggtgatggagtgatgccctatctcaaaaaaacaaagacattaaccatctaaatacatctgaaataaaagggctttgtaaccacagaattatagatgtagcagagatatttgaccttgttagttcaggtctctttcagatgaggaagagagattatctgaaacacattgtaaaatttggtgttgtagttgaagtctgtaaatctacaaccagagaaatagaaattagtatccacctgttaactcaaatgcagtttaaaaaaaacagctacgatttattgtgtgcctactagtgaaaggtctgaagtggttgttgattgcatattgtaatgacagagaaaatgagcacacttcacttgaaaaaaaaactttagagtggatgtagtggctcatgcctgtaatcccagtactttgggaggccgtggcgggccaatcatctgaggtcaggagtttgcaaccagcctggccaacatggtgaaacaccgtctctactaacaatgcaaaaattagccgggcctggtggcaggcgcctgtaattccagctactcaggaggctgagacaggagaatcgcttgaacccgggaggtggacggaggttgcagtgagctgagattgcgagactgtgctgcagcctggtccacagagtgaggcttaaaaaaaaaaaaaattaatgtactgtatgtatatatggtacaaagttcaaaaagtccaaatggatttgtggggaaaaacaagcctccctttcatacctgttcctcagctattctgtcgctcttaagcatttgtccagagatactctttgcatttaaaaacacacatgtatagttatttttttcttaaaaaatgatagcacactgtatacactattctgtattttcttgaaaatggtttcaaatcaatatgtatagagatgactcatttttttaaagaaggggcactaagtttttacattctacagaatatgtatttatttgatatactttaaggaaatctttgctgggtgtaaaattgggggacaacatttccttttttttttagtacttagactatattgctgtgtggtcttctgtatctgtgttgcttttgagaaattagactgacctgagtttttttcctttcttgtacatgatttcttattttttattttttttgagatggagtcccgctctgtcgtgcaggctggagtgtggtggcgcgatctcagctcactgcaacctctgcctcccaggttcaagcgattctcctgcctcagcctcccgagtagctgggactacaggcacccactaccatgcccggctaatttttgtctttttagttgagacgaggtttcaccatgttggtcaggctggtctcaatctcctgaccttaggtgatccgcccgcctcggcctcccaaagtgctgggattacaggcgtgagccactgcacccagcccatgattttttatttctaacttaatacctccatactttctttttattctcttcttttctttcttttccttttctcttctcttttctttctttctttctttctttctttctttctttctttctttctttctttcttttcttttctttctttctttctttttttttttttttttgacagcattttgctctgtcgtccagcctggagtgcagtggcaaaatcatggttcagtgtagcttggaaggcctgggctcaagcaatctcccctgcctcagactcctgagtagctgagactacgggcactggccatcatgcctggctaagtaaaaaaaattttttttgtagagatggggtctcactttgttgcccaggctggtttcaaactcctggcttcaagcagtcctcctgcctgggcctcccaaagtgctgggcttacaggcgtgagccaccatgcctggccataattctttctctagccttaaagttctataaacataatcaatccacaaattccaggttttacttattttgacaagttttatcctgttatgtatctttgaatgtacatttgttctttttgctttgtgagcctctttggacagttacatattctttctaacccccttcctcctccatatctgttgtcttctcagtaaattggttttatattgttagtcttatctatttcattttatatgatttcttcagtccttatctttcttttagtcacatttattctatttttggttgcttcttaatgtggcttttatctcaataatgttatttttctctccattttttttctgagttctatcagcttgactttcatttccttctgttgttgtataatctcttctttgaacctttgtttttcttctttgagctctttttttatttttatttttttaagaggggtcacgtttcctatggttgcctttgagactttggagaactatttatctgaactcttcctgtgtttctttgagtagttcttgtgttatatgctactaatttacctttttctctgagttttttttttttttccaaattgtatgcagacatcgagtattggttgttttctgagtgttgtttatgttgaaataggccgggagggtaggtgaagcaggctacagccttttttttggacatgttacttagtcatttctcaccaaatctgttatttagtttgaaagggtaggctggttcttcgtgtcggagtctatcacgaaatgccacctccactccacatctgccccttcagtgacccttgactgaagggttgcatgtacacagtggatctggcatggtaacaaggattcttcggttcagccagcccacctttctctggtattaacccgtggttcaaagagacattctctacttctcctttggcctatacttccatctagattccctccttggatgctagcatcattagaatcactgtacctcttattcgggattatgtatctgtgtattgctagaagcctgagaaggcctgtgatggctttccacacatcccttgccccgcttatactggcagataggtttcagtttatgatttggagtcatgatagcttccttgtttcagttgtgtagggaagttgcaaatttctactcatgactcattgtgtagatgatgaaatgtagtgtattttctatcacctatcatctttgtcagaggccctctacctttagtagtggatggtgggaagaaaaatttgtgagtaaacaggatcttggcctctgttggtttaaacagtctctttggggtaatgtgtttcagttttcttctatccccagcttctgctgaggtgaggtctgggagcagtgagagaggcctttgggaatgatgcttagatctgcctcgcggcgctggcatggggagaacgtagactcacacgcagtcttcctgaggctttgctacgagggcctgggtgggtaaccactgagtaacatctctcgctgttgaggctttgaaagccttgaggaggcttctcctgtccttagacctactacagtcggcccatgggctctgcatctgtggatccaaccaactgcagatatttgggggagcggggaggaaaagatttggatctgtactgaataggtactgccttttttccccccatctttattccctaaacaatagaggataacaactatttagatagcatttacattgtattaggtattataattcaaaggtattataggtaatctagagatgattcaatatatggaagaatgtgcctgggttagatgcaaatactacaccattttatatcagggacttggagcatccccggattttggtatctgcagggcggggcgggggtggtgctcctggaacccgcctcccatggattccaaggatcacctgtatttgcctgcagtcatcatggagttccccatactgtgtggtcttcatcctgacccagaccttcactggtcagaacttcaggattcctatcacgatgtacttgggttatttgcccagcccctccctccagccatgctgcgctgttgctgccacgccatattcagaatgccacaaaactgagccctgggcttcactgcaagcctgcagcctcccctacactgtgtcccagaagcagacctcttgcctggatatttttagggcaccttatacttgtcagaatgttttcagcaatctttgtccactgccacccccgccctatccccaagggtccagcagaagaggaaatagtgaagtctctgataatctgattttaatgagtatcttttaagagaaataagtgatagtgggggaattgttagggatcatatatcatagttctgctgcaggtttatctggaaacttgagcaagattaagtatcaccttgttaggttgtctaccatataataataatgtcatctgtaagcctctcatattaaagagttagggaataagcatcagtgagtgaaaggaagaaaaccaatagttctttcattttaaattagctatgatttttaaatttccattacttttatatttatttggaaattattttttttcttttacgagtatccctgttttgaaagattatgggtctttttttgcatattcatgaaggatgactggatgaaatcagtcatttatgattgacagaaatatgacagaactttgcaaagtttgaatggacttttgatattcaacaccaaagaattttgtctaattaaagcttctgtttaattaagataacaatgcatagtccttcattaaaattaacacagaaaaagttcttccttggtccttggagaggatattatatgcaagccctgttgtgtgggttgcaagatgtcactggaatttatatgcattacttgtctaattgcagtaaatgtagcatgtccagataggtttcgagttagaaggctgtttgttacttacggaaatcacttgaagcctcagtacccggaggcagctgttcacaggtccttcacctctccccagagatgactgggaagacgctgttgttggaccctgtctttcttggctggagcagtaaacatgacaggttgtttgggagccatctgtttaaaatggctgctgctttgtatgcagcaatgaacttgagatcagttttctgtctttcttcatggtaatggtcttatttggtgtcacaacaggtggaagttgatgggtcgaaactaaatgtgaccagcacgtggaacctggcttcgcccttattgtctgtcagcgttgatggcactcagaggactgtccaggtgagtgttgtaaggatttccttagagggcctcctcaagtccagaatccttgtcagcacctgtgtggctaatacttagagctataggagggaaaagctgtattttattcaccttatactttttacagtcgaaaactttttcttttcttattttagaggatcttaagttttaacctgagcatttaatgttttcttttttcagacaatccaagaaggttcatgtattgtactttgttgtaaacaaggaattctgcaggcttttctaaaaatgctagattagctgtttttttttttcctctgtgggtttttagttgtaaaatacaacttactttgttacctttcttttctgtgcagttgaaattacgtagtgttaggctagtaaaacttgtgttattcaggttgactttccacagctcactgatgtcctttaaaaatttagtaatcttaacttattaatctttcttttcgcctcaatataaaatgtcctgccttgaggagatgccttggaacccagagtcgatagaacattttttgtaacctgtgacttccattttaaagtagaaagttatgaaaagagattctgccaaaattcttcaccttacctcatatttgaggtttagcgttttaggaaaaaaaaaaaaatcatggaacatgtggctatcacaggctaataaaaatctagccccacccatagcattaaatgctcattctttgttcttttttatgaaaatcatcttaacttgattttacacaggaaactggttttaaaaaccttgagaaatcaggataatcacagattaagactacttactccatacctgattcttatctacctctatgagagaccgggatagtggacatcagaatccacaaaaactatgtgatgactgaactgatttctaagtcagtttcaattgatatattatctctatggttccaagtaaccttgaactcttggtaataagccctatattttgactttggttttgtgacttgtcccagtatattttttctcatttttttaattttctaactcctgtcttttctcatattttataacttaactcatattatataactttatataatattatatcagtataaattatgagttgaaatagtttaagactcttgaaaaaaatatcactacataatttcacattacttagatccatgtattattatgtctttaaaaactgtggtgtctgggcacggtggctcacgcctgtaatcccagcactttgggaggccaaggcaggcggatcacctgaggtgaagcgttccagaccagcctggccaaagacagtgaaaccctgtctccactacaaatacaaaaattagccgggtgtggtggcgggcgcctgtattcctagctacttgggaggccagggcaggagaatcacttgaatctgggaagcagaggttgcagtgagccaggatcacgccattgcactgcagcctgggcaacagaacaagactctgtctccaaaacaaacaaacaaaacaaacaaacaaaaaactgtggttttgttatactggtttatgttcgatagactgtacagtgcatcgaatatgttatggctcaagtgtttgtcagagggacatagtgttaactctcagtagtcagaagaaagaggtacaaactcctattatgcaaattttttgtattgtgttactttcatcatccttttcagtgagtgcgcagatagttgtcttgatggcacttttacatgtagaatttatagctagattaatagggatacatatgtagaataatcaaaaatattttccctagtgtagggatcatgttcggtaaatccctttttaatcctgtaagtactttgctactaaaagaattaatgtgtctgaaataagtgaccccttaaagagagatcccttgactcttaggaagaggtcgttgcatcaagttaagtactctctaattggaaggaaataaactcagagaggtaaatggtgtactaggaaaaacagtcgtttacctaaaaaaaaaaaaaaggtaaggagagtttttccttgtgaaaggggatggattttatttactttctgtaggcattagcattatatcgactctttccaaaaatgtaatgtggcccctatgaagataataacaattgtagtaataataaataacacacagtgcttactgtgttatcaggtgtagttttaagcatagtacagatatgaacttctttgatcttcacaattgtatgaagtaggtgctatttatagttttataaatgagacaactgaggctcagagaaaagtaagtgacttactcaaggtcaccagctagtaagaggtaaagccatgattttttttttttctttttaaatgagacaggatctcgctctgtcacctaggctagagtgcaatggcacaatctgggttcaccgcagctttgacctcccaggctccagcgatcctcccacctgagccccccaggtagctgggactacaggtgtgcctgccaccacacccagctaattttgtttattttgtagagatgaggcctcactatgttgcccaggctggtttggaactcctgggctcaagcaaccctgcctcctccccgaccccccctaccccccacccccacccccaccccccccacaccctcagcctagatccatgatttaaatccgagcagtcttgctgtaggtaggatccttgccatcaagcattgcaggatgctgaggcaagctatgtaacttcctgggcatcacaaagctaggaagaagcagagcaaaaacttggtccgtggcagtcatgtgtgctttcccccactatgctatagtactttgcgatttttcctatcacattcttcttcaaattataattacctgtcattcatgctttaaaccagagatgcttaaactttaatatgcttcagaatcaactagaagccttgtggaaactcaagttgttggacccacccatagcttactctgatttagcaggtctgggctaggtctgcatttctggcaagcccccaggtaatgctgctggtctgggccacatttggacaccctctgctttaaacctttgtagtcagagaatgagctgaggagtggtgtgccccagcaaggtgggtaggaaccgagtcacatgagccttattaaggacataggagaggctctactttatccctaggtcagtagggacccgtggaagagctttcagtaaggaagtgatgattgaacagaattgtagcttacgaggtttttttggtttttggctgctttgtggagagtggcttgaagaagcatgaggtgaagattggaggcaaagagagaagtcagcagatgttagggattcggaggtaagaagtctcagcagctgtggggatgagggcactgtgtgcagaagggatctgcaagcgtgacaggagaaagaactggtggctttacagtcatctgctgatttctcttctgaccactgttagcatgggcaaacctccaaattctattcctgactcccccttttctctctctgcttgcttcctgggctgcattgctccaagagttccagcttaacacctccaagcagatagctacgaaatgcaattataagtgtttgtgtgtctctttgcaattgtttattctgagaaataagggatgaatattaccaaaggcatttttcaagtgattttacagtaatcacttgaaattgattactgtagtaattgattactatagtaactgtaggtactttaaagtaataactacaattcttttttctctggatttttgagcatacatataaactttatattcttaaatagtattaaatattactatttatcattaacttgtatcattaaattttattattaaacctcatttaatataaaataatatgtattattattattttgagacacagcctccctctgttgcccaggctggagtgcagtggtacgatcttggctcactgcaacctctgtctttcgggttcaagcgattctcttgcctcagcctctggagtagctgggattacagacacgcactaccatgcctcgctaatttttgtatttttagtagagatgaggtttcgccatgttggccaggctggtctcgaactcctgacctcaggtcatccacctgcctcagcctcctaaagtgctgggattacaggtgtgagccatcacacccagccaaaaatatttattatatctatataaaagctaaagaatgacccaatgaaaacctgtttacccactatctagattaaaaaaaagaaaacaggctggtcactgtggctcacgcctgtaatcctagcctttgggaggccgaagcaggcagatcacctgaggttcggagttcgagaccagcctgaccaacgtggagaaaccccgtctctactaaaaatacaaaattagccaggcatggtggcgcatgcctgtaatcccagctactcaggaggctgaggcaggagaatcccttgaacccgggttgtggtgagctgagatcgcgccattgcactccagcctgggcaacaagagtgaaactccgtctcaaaaacaaacaaacaaacaaaaaaccaaaacattatcagtgctatttgtatcattcttccttgattaaatcctcctttccagtgtccctgaagaacaccattatgagttttaaattgatcactaccttgcttttctttagggatatttatgaatacaccaacactgtgagcagtatcttgttgagctgctcttgtttttgaaccttgtaattgcccccatcctctctgtgttcctccaggagttgtcttctccccaccagcatgatgtttgtgagcctggcccatgttgctgcctatagctgcagtttatctacttccatacatcatattaatattaccaccaattacttattctcctctaaatagacatctgtgttattttccttattttgttgtcacagtgatgcttgtatgaacaccctacttcctgtttcctcttgacataggaggttctccaggtcatgtgccggtataacagccatgctgtggggcctgtgctttctcattcctgcatggcaaggccaggtgggtttctctgtgtggctgtaccagcttatgtgcccatcagtagtgaagatgatagtcacaatgagaacaatgaactaaccttattctgtacttattatgcccggcactgactgttctaagcactttgtatgtatgaatgcccccaaaaacccaataaagtacgtactagtgttatccctcattttgtatttgggaaaacagaagcttgtagaggctaaattgctttcccatctggtagtaaatgggagtgccagaatttgaaccaaggaatctgtgcccttaacattttttttcacatcctggtgaacccttggccttcccagactacttaggtttttcctgactggtgggtttagatggcatctcattatggttttaatgtatacttccctgattagtatgacaatgaacattgaaaatatatatttattggctctcttgttttctcttctgtaaaatatctgctcatgacttttgcccactttttaaattggattatctttttcttattgactcataaaagttcttcctgcgttatggctcctttttgtcgtatgtgttgataaagtagcttctgtttttattgttttaagttatccaagttaagttttaaggcaagatttaatgtcagaattttcaatattttcctttatggtttgtgtgttttgcgtttgtgtagataatcttgttctactcctaagctcacaaagatacctatattttcttttaaacctttttaaattgtgcttttcaaagttaactacttaatcctcatgggattgatttttgtacacggtatgagtggctcacgcctgtaatcccagcactttgagaggccgaggtgggtggatcacgaggtcaggagatcgagaccatcctggctaacacagtgaaaccccatctccactaaaaatacaaaaaattagctgggtgtggtggcgggcgcctgtagtcccagctgcgtgggaggctgaggcaggagaatggtgtgaacccaggaggcagaacttgcagtgagctgagatcgcgccactgcactccagcctgggtgacagagtgagactccatctcaaaaaaaataataataataaataaaataaaatacagataccaggccgggtgtggtggcttaagcctgtaatcccagcactttgggaggccgaggcgggtggatcacctgaggtaaggcgtttgataccagaccagtctgacctgtaacatggtgaaaccctgtctttactgaaaatacaaaatattaaccggggatggtggtgcacacctgcagtcccagctgctcaagaggctggacccctgcactccagcctgggcaacaaagcaagactccatctcaaaaataaataaataaataaataaataaacaaacaaacagataactcgttatgccagcacaatttaatgatagtcgtgcttctcttcccttactaccttgccaccacctcacctttccaaccccgaaattctttaaaagcggtttctgtgattctcaattaattgtaaataaaaagatgatttttcgcttaatacgatcctcagtatatttgcttctgtgagctctcagtcagttgcactcttttattttttgttaatcttctggaaacccttagccaagggcatcagatgatatttgagatacaccttagaaaaacgtgtttgtgaatcaacaggcaaattgggaagtattcatttagggaagtaatgagagctaaacatggaaaaataggttggaggaccagatagtgaatgagagcctgaagaatctatgcttttcagtcagcagtggagatattacaactttttgcagagtacagtaacgtccatcaaaatgccattgtagaatattaatgtgtcctcataatagaggaggggttaagggattgaagggtgaagtggagatggagttcatttagaagacaatcctattactgccttcatcctccactagggtgcaagcagtgtagagaaaaagggggttgagtttgagagaaacctatgtttccatgcatagaaaccactttctgtttctatgaatttgactactgtgggtatgggtaccgcctataaatgaaatggtatagtatttgtcttttgtgactggcttatttcacttagcatactgtcttcaaggttcatccaggttatagcatgtgacaggatgtctttcctttttatggctgaataatattccattgtgtgaatatactacatgttgtttatccattcctctgtcaacggacatttgggttgtttctaccttttggctgctgtgaattatgcttccatgagcatgggtgtacaaatatctgtttgagtaccccattcttttgggcatatgcccagaagtggaattgctggatcacgtggtaattgtatgtttaattttttgaggaacctccatagttgctgcaccattttacattcccattagcagtgcacaataatttcagtttcgtgccatctttgttaacacttgttattttctgttttgttttgttttttaataatagccatcctattgggggtgaagtggtatctcattgtggagcaggacttatctagatagtaactgaagaaaaagcattccgaatacttctaggatgtgtccttcctatattggtattactctgtaaccagttcactgcacaagtggcacttttttcagtccaagtagaagcaagtttcttagagctgtttttttttttaaaccctttatttcaacttctttccttcccatatataaaaccacataccattctaacagtctgtaatgttgctaccaggtaataaacaagccatactgtatttgggagaggagggtgtgtttcaaagtctagttcattgtaatatcaaaactggtaaaacctctcctctctaaactcagtttgacctcacactgagaaacctttactagtgcagaggagaatgttgctttcttcttgcttgctttatattgtaggggcaaaagggtgtgatcccactcctccccatcataagggtgtccatggcagacactcctataacaaaagacaggttaacaagagaaaagtataactgatttatttaatcaaagttttatgtgacatgagagtcttcagaacagagatccaaagatacaaggaaagctgtccattttaatgcttaggtttaatgaagaatgggcagccgtgtaaaactgatgggacaaagaatgtaagtgaatgctagtaggctgagaggaacccagcaaggcctatgttcagatcttcctggcctctcttgtactatttcttcctcccaggtatgggacaagacccatctgggatgacggtcttatgacctgctactgttgtagagaagggtaggccagagaatttctttatgagcagctcttagaaaggcagggaggggttagagtcctgtttctggtttcatagttgtctttgcgggagaggaattctgatgtctgtgactcatctcaggagagaatgaggggtgagagacaggaaggcagaaggtcagagatcttagttctgaggttacttctgaggccttctctttggggtatcattttctgagcctcaacaatacccttttctacttgagagctgctatattgggtctctcagaatttgcagtatggggtaaagatgagaagagcatggcaggaagaaccaggttttctggggcagaggcaacctggcattcactctcttggggcatggcagatgtccaaagctggccggtagccctgggatactttcatgtggatttgggggaacttctcacctgcagaacacttaatgcctcctgtcttttccagttgcctttggtctcctgagcaactactgtgttgactctgaatgttctcactgggcatggtccctcataatgaccccgcctgcttttctcctgcacaatccacgtctggccacaggaaatagtaataagtccttgcctcaccaaaccaacaaagtacaagcttctcttcttggtctgtctctaagaattcgcatgaataagtgattctcatgaagtcgctttcacgtagcttaagcagagttcagccttaaattctaagcttaagaattcgacctcctcaaattaattttcctcttttattcttttaaggtgggagatggacagtcactggtcccacagcttcctagcacattctaccaggtagccttggctagcatctgacttaaagatgtatgggtacttggcgtctacttctttttgttgctgaacccctgtgattccatgaaaagtagtgcgttcatctgttcttatattgctataaagaaaaacctgagactgcataatttatcaagaaaacgggtttaaatggctcatggttctgccagctgtacaggaagtatggtgccagcatctgctcagcttctggggagggaggcctcagggagctttcagtcatggtggaggcaaagcaggaggaggagcatcacagggcaagagcaggaatgagggtgagagagaacggggaggtgccccactcttttaaacaaccaagatctacctctgtgatccaaacacctcccaccaggccccacctgccatgtcgagaatcacatttcagcaagagatttggagcggacacatccaaaccatattaaggagcatttaacttctttatctgattagatgagtaagtagttgggaaggcaacttacctttgcttcaggaattagctcccgattcatccagtccgatcacgtgtattcatgttcctggttttcattggtaaacttcataagtttaatattacccattaaattcctttaaaagtaagttgtattttggtgtatactgtcactggtagagggtcatgattgcaagttatccaggttcttggcgttttgaacaaagaattggacaacatgtccagcaaagcaaacaatgaagcaacaacagaacaaaaacagggatttattgaaaacaaaagtataggcggccaggtgtggtggctcatgcctgtaatcccagcactttgggaggccgaggcaggtggatcacctaaggtcaggagtttgaaaccagtctggccaacatcgtgaaaccccgtctctactaaaaatacaaaattagcctagtgtggtggtgcatgcctgtaatcccatctacttgggaggcaaagacaggagaattgcttgaacccaggaggtggaggttgcagtgagctgagatcgagccattgcactccagcttaggcaacaagagcgaaactctgtctcaaataaaaaaaaaaagagagagagagaaagaaaatgaaactgtactccacagtgtgggagcgagcctgagcagtggctcaagggcccggataccgaatcttcttggttccaaatacctgctagaagttttccattgattactttatactcacctcatgtaaatgaagttgcagcctataaggttgcagaaagcagccaaccagaggctgaagtgaagttacaaaggtcacactcctgtgcaaacatgttgcaaagttatactcttatgcaaatgaagacttggctggcaatcagtctgattggttttggacagcaaccattcagagactggagtgaagttacaaagttgcaaagactggacccacagtcaatctgattttctgatttgttattggatgggaaattgactgtccgatttcccatctgccacacagaaaaggtgggtggtttgcaaagggagtagcccctggtccttttattacttaggtgtggaaagctaggattttcctttcaatttagttctaggaagttggcgtgaaacagccttgggttccctgcctccagaccctattctcctgcctcagtgctatcattagaataataaatttcataggttattaacctcttttaattgatctaaatcacctgtttccttttggatttgacttttaattcccactgccctgctgacttctcggcgcatataaatgctcaataattggatgaataggtgtgggtgggtgaatgggtaagtggacagtcatcttacattatagaatgttttgctgattctttttagttcctgacctcccaacatttgcgaaatccatactccattagtgtggctggtggacctctcttgatacagaataaccatggtttctgtgagagcaaaaagaaacaagagggctcccaaggacttgcccacagaggcgctttgctcaccaagcatggttctttcctgttggcctctgtttgctctgggtagcacctcggctgttttaggcccacagtatcacctattgacaagtgtagatagctattgatagtatcaataggtgtaggaaagggtctgcctcctgctattcctggttttctctttctcaaaggcttgtgcatgccctaggctttctcactgtccgttgctgggtgaggtcatatcagctcttactcccacagaaccacccgcacctgctttaagtacgctgcctttctgacttcaagaaaatcatactctcggaaaaagtctaatcattgtggataactttgaatatggagctagtgatatattacctaagggaggaggaaatcacatattttgaaatgataaagaaccaggggcataaacattgagaactcttgaaaataattaaaagttctcttcagaattttaaagtctttttctattaatttctctaataatttagccaacttttcttcaaatatcatcatttaaggaaaatgaaataactattttatatttatttgtttatttgtttttttttttaccagtgtttctgttttcattgccgaagtagtcagttggtaatgacgtttattaaatagccttatctaatagaaggctaacacaagccatatttaaaatttctttgttttaattaattagctctttgttttgttttgtgtttgagacggagtccgttgcccaggctggagttcagtggcacaatctcagttcactgcaacctccgcctcccagactcaagcaattcttctgccccagcctcccaagtagctgggactacaggcacctgccaccatgcccagctaattttttgtatttttagtagagagggggttttaccatgttggccaggctggtcttgaactcccgacttcaagttatctgcccgcctcagcctcccaaagtgctgcaattacaggtgtgagccattgttcccaactgtcatttaaaatttcttagtagtcatattaaaaaagatgaaacaagtggaattaattttactaatacattttatttaaaccagtgtacctgtggagacaaaagtgattccatcttaattgctaatgcaccatgttgttttttttttcttgaaggcaaaccttgttgttttaatgtaatttattttttattttactttttttttaatgatagggtcttgctctgttgcccaggctagagtgcagtggtgcagtatggctcactgcagcctcaacctcccagactcaactgatcctcctgcctctgccttctgagtaggtgggactgcaggcctgtgccaccacatgcaattaattttgttgattttttgtagagatgagggcacactatgttgcccagaactcctggactccagtgatcatcccgcctctgcttcccaaagtgctgggattataggcctgagccaccactcccagcaaagccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttctgtctgtaagttcccccaagaaaacaccctttaccaacaaattgagtttctttgccttattctttggtttcttggctccctccgcatttgggggctgctttgcatttatggccctttcacagaataataccccaaatgttgtcatttcaacatgaaagacttttaaaaattactaatgtgataccagaaacaacatagacattggcattaatacaacagtatcttaaacaatggaacggtcagagtggaatgtagtcctaccaaaacaatggagttgggtttaacagaaaattacactgcttcagttttaaaattaacattaaatacaattgaaaatttaactcctcagtcacaccagtcatatttcaagttctcagtagctacgtgtagctagtggttactgggttagaccactcacaggcaaaattttttgtaaaccagagagtgtttacagatagagaaaactctacataatggtttttaaagtattcccccttaatgtcaaccacagttttggtttttatctcttaaaatttggaatagatgagttgaatttatttttaaacagaagatgaatttatcatctagctgacaaactttttaaatttcccattagaagatttaaaaaattacaaccatttttaaaacgtggaatgatttcctgcctgtggcatataattaaagtgatgaaacaaacagaagattcgctgtgtcctggccatggtgagctcactctctgttttcctcacaaaccccagaacctttgtagtgtggaacctgctggatgaatagaagttttttattttattttatttttttactatgtctatattcctgtgaagtaatttttttgaccttgaaagaagttcttcaattttgctgttctctatttcttacagtgtagtttgtgtaccgggatttaatgtattgtttgtcgttagcgttttacatactagattttcatcgtgcatagtcacgttgtttgaacatttgcaagcagagccgactaactgctgttggcctgtttctttgtatggcgtgatttcttctatccacctgctcacagcaggttgccttcaggcctgaggagtagctaaatacttttgaaaatatcttgagatcctgctaaggtctaacaatttctgcatttgtgtgatgtgaagctattcatgctgtacctttgaagacttttttctttctatttctcatattcttgctcaaatattttcaaaagaagataaatttattataaataacagtgcagagctgattgtagcaccactgcattctatattgaataggtctttgatattcagctaagtggaactaattttctatgttaaagcagacaaatttggaatagtgtcacatgaatctcatgttatttactgaagaataccagattaaatggattagttgtgaaatgactagagtattaaattatatatatatatatatatatatatatatatatatatatatatatatatatataaaacgtgataacttaaaatgcccagtgggcctatgtaatataaaatattacacaagcacatgaatatgatggacgagatgttattctgtttgcagattgtgaaactatctgtagtatatatacaaatggttgtccacacagaatttgaatcaattttaaaattgtaaccttaaatttcagttttgaagaaaataaattgttgattttcatatctacttgagaggaagttaaaaatgttattttcttttcagttttttttagattaaaatagctcccacaccctccaagaataaactttagttttaatcctaataactgtttatagatagtaaaattaatattttaattagaaaaataaagcggcatacatttttgcctgtactttgctggtacacaaatgaattgggaagtaattgtcttatgttttcagtcctaaagtgttttacaggttttaaaaatgttccccccacccccatctgtttgaagtcattattattttgtactttacacatgtgatttctctagaatcattgcatgtgacatgacactctcaggatatataggatatataaatatataacttagaataagtagaggttggtatttttcgaatgaagtaggaaatgaaagagtaattattaaccatatcctttttacattcctgacatatcaatacagctacacatcttagaaacaagctcaccagtagaacagaaataactctgttgactctgctttaaaatatttcaaggcagtttaacagctgggatgtatttacagctatggtataaagtattaattttgatgcaaggctacctgcttttgtaatgtagtcctagaagcttagcagttttctgggttttataatttggagttgcttttaaaatttaaccgaatgggaaaatgtctttctgaacttccccttcccacacccccacacatacaagcttttctcctcttctgttaactagaaaattatattttcgttgctgcctgaggaagagaattttgagtagtataaacactgattgtagtaaatgtggaaaataatacaaacagctgcactgcagaccgataagacaaatcccacagtaatggcctttaaaacatattaccaagttggaaatcagtgaggggaaaaagaaaactattactatttcttcctcttactgttcagtgacattatttttaaaggtgaaattacctctggttttattatcctaggaaggtatttttggaacatttgatttattgttttgcaaatgtttttgcctttgtgtgaataactttgctaattttgtatgaatttgattctaacaaatgttgaagtcattttgttaacaaaatcttctaaagtattttttaaagaaataaaaaggaatatattatgtaaacattggagcagactatcaaaataagaaaaggagaacatttttatctggctttggagtgccatttaaaataggaaaagggatgaaatatttgcagaaaatattttaataagcgtggatatgtttcatcaaatacaagtcttaatttttatgaagaattttgctattagcatatcaagtggtcagttcatatttgttttggcatgcattagactcatgataggcattgaatactttgttttttgtggattctaaaactgaattatcttaatcctaggctctaggaaaagtatatcttactgctagggaagattgaaataaattccagttctgagtgaaattttatttctgtttttctttacatcaatcttttctttttccttttttcttttttttttattttttatttttgagacagagtcttgctctgtcactcaggctgtagtgcaatggcatgatctcagctcactgcaacctccgcctcccaggtttaagcgattctcctgccttagcctcctgagtggctgggattacaggcgcgtgccaccatgcccggccaatttttgtatttttagtagaggcaggatttcaccatgttggccaggctggcctcaaactcctgggctcaagtgatccgccttccttgacctcccaaagtgttgggattacaggcgtgagccaccacgcctggcctgtccttccttccttccttcctttacaaactgtgggagagtggtgaaaaaaaggtgacagtcattatatatgtaattgtgacctgctttaaattgaatgcaatgttaaggacagcttattggtacttatacctatggtcacacattcattgatacagtttgtttttaatgtgaaaatttgtttccattttacataatacaaaattacttctatttgcctgggaatgaatctaacctttgtagtgtcagccaaaggaatgataatattgttttagtgtctcctacatagaagggaacgcccagtatggcctaggcagtgttctagactctgcagatagaacaaggaacaagacttaccttccagcagggggaagtagatactaaacatgtaaatacctaaataaggtgattttagtactaagaagttggatgaagactatgaaattgatagaaagtcactagagaaggcagctttagcaaggatggctaggaagtcctctctgaatagctaacactgagctgagacctacgaagaggagggggcaaacgtgcagaagtctgggggaaggaagtcccaggtagcagaaggggcaaagcagaggctctgaaacgggacaagcttgttttgtgtgaaggccagttggggagagtggaacgaggaagacagaaccagatcatctaggggccaaagaactgttttgttttgtgttgtttctttctattcatgttgtggagcgtttggagggtttgggtaggagagtgatgtgatgtgattttttaaatcattgcaggccttggggtagagacagagaaatcattgatttgaccattgcagacctcaggtgagaggtactggtggcttagaccaggaggcaccgtctgtttctatggggctcacaacttgagtggttattacatttttaaatagttgggggaaaaaattaaagaagaatgtttcatccagcctgggcaacatagtgagaccttgtctctacaaataatttttttaaaaattggctgggtacaatggtgcatgcctgtgggtccagctgcttgggaggttgaggtgggagaatcgctggagtccaggcagttgctgtggagagctgtgaccatgccactgcactccagcctgggtgacagcatgagacactgtcaaaaaaaaaaaaaatcaataatgtttcatgacccatgagaagtatgatgtcacattcagatcttattgatgataagcagttaactagaacatagccacattcattcatttttgtctgccatgtatagctgcttttgcagtttttgtcgtatgaagctgaatgcacagactttcttgccacgcagcagttcagtgggttattgtgatttttttttttttaatctcaggaccaagattaaagttttttgtgcagagttgcaggtagccaaattactttttgtattcctgtgccttagattcctcatctgtagagcaaaattgagatcgtctttcaggtctgtttgctctccacatcctaaggtcctaggtctgaatcagacttagttcttctgttgtggctgcttagcacatcaggctcctaactgaatgattgtagtggtgttttactcggtctcctagcctcgtccttccccattctgtgtatcttcagcatgacctcagaccaccgtctttctaaaacatgagcatgtcacactccagttcttaactgtaagaactttgtcaggtatgagctctctttgtacaagatctgacctgggtttataattccttcctggtttcctttcttgccacttccaccttcatccaaccctatttctggccacgctgaactgcttaacattccctaaacttgccatgccatcgtgccatcccttaatctgaaatttttgttaactgtctcatcagcccacaatttttttttttttttttgagacggtgtctcgctctgtctcccaggctgaagtgcagtggtggtgcaatcttggctcactgcaacctccacctcccaggttcaagtgattctcctgcctcagcctcttgagtagctcggattacaggtgccaccaccacgcccggctaatttttatatttttagaagagacgggatttcaccatgttggccaggctggttttgaacaacctttttttttttttttttttttttttttgagacggagtctcgccctgtcacccaggctggagtgcagtgatgcaatcttggctcactgcaagctctgcctcccgggttcacgccattctcctgcctcagcctcccgagtagctgggactacaggtgcccgccaccatgcccagctaatttttgtatttttagtagagatggagtttcaccatgttagccaggatggtctcaatctcctgacctggtgatccgcccaccttggcctcccaaagtgctgggattacaggcgtgagccactgcacccggtggttttgaacttctgacctcaagcaatctgcccgcctcggtctcccaaagtgctgggattataggtgtgagccaccgttcccagctgtttttcagttttcttttggaaaattcctgctcatttttaaaatttgtaattggtttttaattgataaattaaagttgcatatatttgtcatcctgtcttagtagtgtcttttgtgttgctacaaaggaatacccgagactggataatttataaagagaaaaagtttatttggctcgtgattctgatgtctggaaaagttgaggattaggcatctgatgaggacctcaggctgcttttattcatggtagaaggcaaaggggagctggtgtgtgtggaggtcacagagtgagagagaagggagggaggtgccaggctcttttaaacaaccagctttctcaggaactaagagcttgaactcgccctcaaagagggcattaatctattcatgagggatccttcccaatgatccacacacccccattatgccccacctccaacactggggatcacatttcaacatgaggtttggaggagataaactttcaaactttcacacatgtacaacatgttttgaagtacacacttcaaacagtggatacactgtggaatggctacattgagctaattaacatatatgtattacctcatatacttattctgtatgtgaggtacacttaaatatactcagaaaatttcaagaatatattaataatacgtcgtcattaactgtggtttctatattgtataatagctttctcgtacctatttctcctttataactgaaattttgtgggttttgattaatatttcctcaacaccccctccccaaccaccattctattttctactctatgagtttgacgtttccagattcttcatgtaagtgaggtcatatggtatgtctttctgtatgtacctggcttattttacttaatgtaatgtcttccgggttcatccatgttgttgcaaatggtaggattttcttttttaagtctaaataatattccattttgcatattataccacattctctgtatccgttggtccatggatggacacttaggctgattccctgtcttggccatcatgaatagtgctgcaagaaacatggggatgccagtatctccttgacataactgatttctttcctttggatatatatgcagtagtgggattgttggatcatatggtagttctatttttaatgttttgagaaacctccgtactgttttccataatggctgaatcttgttcatgttttttttctttcttttcttttctttgtttttttgaaacagagtcacgctgtggtgcccaggctggagtgctttggcacagtcggctcactgcaacctccaactcccaggttcaagtgattctcctgcctcaggctcctgagtagctgggactgcaggcacctgccaccacgcccggctactttttatatttttagtagagccaccgtgttgggcaggctggtctcaaactcctgacctcaaatgatccacccaccttagcctcccaaagtgctgggattacaggcatgagccaccgcaccctgcccctgtttgtttttaaatatccagctttaatgtctgtcttaacctatctaatgtcttccttattaacctttctgctcatttagtcggtctgtcctcttatcccataatactttgtacattttgtactatgcatttatcgtattgaattatacttatttttccaataattctgctgtcttttccttagtctcttggaaggtgggtcttaattcagccagcagtgcccaacacagttgagaggtagatggatgattagatggatgaccaacgtagaaatgccagtgtcaaaacctaggaatcaaccctccgttcttaactgagtctccctaagacacaggaaaggagtctattttattccattttgttttctgtctttttttgcctttattaagttcaacatgtgtgtataaaagaataggaaaaacagataagtgaaaacgagagtcaactaatatttttgcctagaaataagttttatgtgcactaattctagaatttttctgtaacataattttttacaaggcttattctgaacatattgttttgttcttcttgcccttagaaataaactgtaagcgtttttcatatcttgaaactttttaaatggcaggctggatatataccacaatttacttagctagtgtctttccccgtcatttacatttcttgccattgttcagttctataaactacactgtgatatttgttcagctttatttttctgcctatccttacattttttcctcaggataaattcttagaagtaaaatgggttggctgggcgcagtggctcacacctgtaatcccagcgctttgggaggttgagggagcgggttatgaggtcaggagttcgagaccagcctggccaacatggcaaaaccccatctctactaaaaatacaaaaaattagccgggcatggtgggagatgcctatagtcccagctacttgggaggctgaggccggagaatcgcttgaacccaggaggcagaggttgcagtgagccgagattgtgccactgcactccagcctgggtaacagagtgaaactttgtctcaaaaaaaaagatgtgaaatgggttggttgggcatggtggctcatacctgtaatcccagcacttttgggagctgaggccaggagttcgagaccagcctggccaacatggtgaaaccccgtctctactaaaaatacaaaaattaggcagatgtggtggcaggtgcctgtaatcccagctactcaggaagctgaggcaggagaaacacttgaacctgggaggcagaggttgctgtgagccgagatggtgccattgcgctccagcctgggtgacaagaatgaaactctgtctcaaaaaaaaaaaaagaaagaagtgacatgggtcaaaatgctcccatactgattttttttctactctataccacactgccttaagtatgctatctagattaccattgtgtcaatttacttggcaatatttgcaggtaggggaaaacattttgcattaaaccactgtctttcttattgatctaacctccctccgtcaaggaaccgaggactcagcttgatttctagaggttcactctgggttctattacttctgtgatcatagagatcagagttggtaaacctccacttctgtaaaaaggaatgaaattaggatacatctgtatcgtaatgctcatggcatgtagttgagtgaaagccactaatactctacatctgggaacttaaaaaaatgatgctggcttagttagaactgctttatttgtgtgtgtagtctttgaagtcactgagccctctctgattagccagaagaggaagaattctgaggaatacgttaggattaagtagagcaagttttttttgtttttgtttttgttttttgagacggagtctcactgtcatccaggctggagtgcagtggcaggatcttggcccaccacaacctcacctccgcctcctgggtccaagcaattcttctgccttggcctcccgagtagctgggactacaggtgtgcaccaccacgcctggctaatttttgtatttttagtaaagacggggtttcaccatattggccaggctggtcttgaattcctcacctcgtgatccgcctgcctcaacctcccagagtgctggaattacaggcatgagccaccgcgcctggcccaacagaccagttttgtaggtgagaattatctcacagtgtagtcagcttccagtgtactacttattcacccatttttagtagcagtagtagttacttttaactaaaattttaatagtcatagtatttacttttaattaaaattcaaacaagatatatgcaagtgatatatttgctgtaaacaaattttatttataaataaatgaataataaagaggttatttctttcactactctctggacatagaattgcattgttgttttaaacaaatgctaattcattttctataactattttattgagatataattcacacaccatacaattcacccatttaaagttacagtttagtggtttgtagtcaattcacaggggtgttccaccaccaccacagtcaattttagaccatgtttatacccttgagaaaccccacaccaattagcagtcatctccatgtcctcccagacctcctcttggaggcatctaccaatctaccttccatctccatggattttactattctggacatctcttattaagtggaatcatataatgcatgatccttggtgaccaacttctattgtagcatgtatcactacttcattcctttttatggccaaataatattccactgtatggctatactatattttgtttacccatccatcagttgatggacatttgggttttttggctatcgtgaacattacatacaagctgtgcagatatgagttcattttatatctcttgtttgttttttagtgtctttctcgagaagcaggtggaaacatgagcattcagtttcttggtacagtggtaagtatgaaatcattctttattctcttaatttacagagaaaaaatgttcaactagttgtagctcatgtgtttgaacttggcttcattactgctagatatttaaattacctctacttttttgcctttacaaatgatattctagggaacaacttcatatatttcactttattttagtgtttggaattattatcttttttgagacagagtctcactgtgttgcccatgctggagtataggggcacaatctcagctcactgcaacctctgcctcccgggttcaagcgattctcgtgcctcagccacccaaatagctgggattacaggtgcctgccaccaagctcggctaatttttgtgtgtttttttctaaagatgaggtttcaccatgttggccaggctggcctcaaactcctggcctcaagtgatccatccacctcggcttcccaaagtgcgggattacatgtgtgagccatgtccggcctggaattattttcaaatgtggataagatatttttaaacatgtatgatatattttctcccaaatagaatcaaagtcataaatagttttatggcttattatacatgttgcccattattttatgtccctttagaacaccacccatcatatattagaacacaactttgcattgtcacctagtgtgagttgtaattttcaagattagtaaacttgatctgctgaagagtttcaatttattattactattttacttataagtttataattagtattagttactataattttcaaactaatttgtttaaaaaggtaccttatttggcttggtgcggcagctcacgcctgtaatcccagcactttgggaggctgaggcaggtggattccaaggtcaggagtttgagaccagcctgaccaacatggtgaaaccctgtctctgctaaaaatacaaaaattagccgggttgtggtggtgggcgcctataatcccagctactcaggaggctgagggaggctgaggcaggagaatcgcctgaactgaggaggtggaggttgcagtgagccacgattgtgccactgccctctagcttgtgtgacagagcgagaccccgtctcaaaaaaaaaaaaagtaccttattttaattttcatttttctgtttattgctattgtatttgaatatttctccatgtattcattcaccagatatcatttctaatctgtgaaatgtctgttcatgtcctttgggtacctcattcaggatatggattcatattgggcatttcagataactctggagtttattaagaatatcagaggtattctgcaagaatatcaagaggtatttcaggcgagagagcttgcgtgaaaaagggttttgcagccattgagataggaaggatgttaataaaatgtgtgtttactgaatgctttatcgattatagagatgtatatataatttatgtatataaagtatatgtataggtacttggtcaatgtaacctaaattttaagtattggaactaagttttgtgattattcttgtttttctgattagtaaggtaatacatgcttattgtaaaacatttgaaatacaattcaaatgtatgtcataatatgttgcattagtcaagattctccagagaaatggaatcaacaagatgtgtgcgtatgtgtagagagaaagagaaagatagatctaaggaattggctcaagcaattgtggaggcttggcaagactaaaatctgcagggtagatgagcaggctggagacccaggggagcgttgcagttcaagtccaaagacagtccactggctgaagccctccttgcttggggaggtctgtctttttctcttaaggcctttaacgggttggatgaggcccacccactgtggagggtgatctgctaaactctaagtctactgatttcagtgttcgtctcatctaaaaatatcttcgatgatacatctcagtgtttgacctaacatctgggtaccatggcctcgtcaggttgacacataaaattaaccatcacagaagtatatatcctatccctagaggtttttaagttattagcaatagataattcttccagaaaattatgcatcttttcatgcaataatagatcttggacacctttctgtgtcagtccgtaagatggacctcagtcgccttaagggccacacagagctgcattacgtggatggagaggactgctttcactcctcagtgttcgtgctgggaagtccactcatgctgtctctgctacttagcatctctactgggtttctaatcggtttctcaacttcatgtatcggaaactgagctcgaaaagtttctccctcagtttttcctctctctgaaaatggcaacttgaactaatccttgattactttctctcctcttcctctctctcctcttcccctcctctcctctctcctctctctctctctctctctctcttctctccttcctctccctctctgtcctcttcctctcctctctgtcctcttcctctcctctctgtcctcttcctctcctctctctcctcttcctctcctctctctcctctctctcctcttcctctcctctctctcctcttcctctcctctctctcctcttcctctcctctctcctctccctctctctcctctccctctctctcctctccctctctctcctctccctctctctcctctccctctctctcttttctccctctctctctcctctccctctctccctcctctccctctctcctttcctcctcttcctctctcctcttcctcctctccctctctcctcttcctcctcttcctcctcttcctttctctctctcctcttcttcctctccctctctctcctcttcttcctctccctctctccttctcttttttctttctcctctttctcgctcctctttttcttctctctctctccttttctcttttccccatctgtctctccctgtctccctctcccctgtctctgtctctgtgtccccacgccccccactcctggccctgcctttagccatctcttgtttggaggatggcagtagctggcgtccacctcactgccatgctactccctagtccatcactaatagagcaggaaaaggagtcctttgaaaacatcccttggttggccttgttgctcttcttcagacctgctgggcacatgccttagggtctctgcccttgtttttcttctactaagaacatctgcccctacatgtctgctcaggggtttcctcactttcttccggtctttactcagtaggctccttctgaaggaaggcttccctggtcacgccgcttacagttctggtcactctttccaacatcttattccccctcgcccactttatttatttatttttttcattagcagttaccactgcttgacatactgcaattttccttttttgatgtatttgttgtctatcttcctcacctggaagtgataagctccttgagtgcagggtgatttgtctgttctgctcagcgtgctctgcccagtgccctgaacaaggcctggcttggaggaggtattcagtcagggttgggcaaatgaatgactgaaattggccaatgtaggacctgagtgttagacttgaaaagaaaactaaagaaaggaaatacaggcctggctcggtggctcgtgcctataaactcagccctttgggaggctgaggtaggaggatcacttgagcccaggagttcaagaccagccagggaaacaaagggagaccccatccttacaaaaaattagctgggtgtggtggtgcatgtctgtggtcccagctacccaggaacatcacttgagcccagggaggtcgaggctacagcgagccgtgatcacaccactgcactccagcctgggtgagagtgagaccctgtaccctgtctcaaagaaaaaagcaaatatgaaaacaaatggaggccgggcatggtggctcacacctgtaatcccagcgctttgggaggctgaggtgggaggatcacctgggtcaggagttcaagactagcctggccaacatggtgaaaccctgtttctactaaaaatacaaaaattagccaggcatggtggcaggagcctgcgatcccagctactacaggaggctgaggcaggagaatcgcttgaaccttggaggtggaggttgtagtgagctgacattgcaaccactacactctagtttaaaaaaaaaaaaagaagaagaagaaacaaatggagaaaaagaaagtgcagggagctttttgggactgtggagctgaactaagctgtcttccatggataaggaaactgtatcttagaaaaggtcacttgacttccccaaggtttcacgtctggctggtgtgtagagcactaaagggtatacagatttcctggctctcagttcagggcctgttccatcagcaggtgcccttcaatttcactcccttttatccacttcaggcacccaaaacatgctagcataaaaaaacacaagaaacaaaaacacaccacatgtacacacccctacttaaatggacaacaaaagtcaccggaaaaaaggaaaaaaagaatgtctttttgatttgttttgttttgtttttgtttttggagacagagtctcactcagttgcccaggctggagtgcagtggcgcgatctcgatatccgctcactgcaagctccgcctcctgggttcaggccattctcctgcctcagcctcctgagtagctgggactactggtgccggccactacacccggctaatttttttgtatttttagtagaggcagggtttcactgtgttagccaggatggtctcgatctcctgacctcatcatgatccacccgcctcagcttcccaaagtgctgggattacaggcgtgagccaccgcacctggccaaaaaaaaaaagaatttcatgtagctgacactttcctctgcccctaataaatcatagattccttgccaatgagttctaaaggggctgtgtccactctgtttatacagtttatacctagcaggaatgtcagtttcaggtacaatttctagagtaatttctaattactgtaaaattcacagtacagcatagcagtttggatggccaatgtgctttgttttactgaatttttctgtgtgtgttattagcaatagtagatcagtctgaaagggggaaagaaatagtttgaagatagtagtggtcctgttacaacaaatacagattgattcctagctagcatatgttgcttcagtcaaagatgtctaaagcaagtatagtttccaagacacacaggtcaggaatagcagcatgtcccatggcaaaggtgatgctttccaggtatagatttgtctttgtgagaatccttgtagaattttctatataagtttgtttttgtcaatattgataaacatgatcttcaatgttcaaaggagagttcaattttagactaagagaagtacttctgttgtgtaaataaggttcaaaaataaggttactgttcaacttagagaaaatacaaacttaaaaataattcatttcattttttattcactctgaacttttaaaaaaagctggtttgtgattttcattttcagtaaaacaaatctcattactttaaaaaaaatgcttgtattagatattatatatatgaaatattatactttacattcttataaaacatttataaagaatgatgatacaacagatttgcatacctaagtgtaagacttgaacaaaagactaaagacaggaaatacaggcctggcttggtgactcatgcctataaagccagcactttgggaggctgaggtgggaggatcaaatacatcaaaaaagtaaaatatgtagtatgtcaagcagtggtaactgctaatgaaaaaaagtaaataaagtgggcaaagggtggaataaaatgttggaaagagtgaccagaattgtaagtggtgtgaccagggaagccttccttgagaaggaggctactagcctgaagagtttttaaaaacgtaaccattagtttggaaggtctctgtgttactcccattctgtcactcattctctccctgcacaaggaactaacatcttcccgacttgtatctattattctttgcttttctttataattttcccacatttatatccctaagtgatatacatttttgttttacgcgtttttaaacttgatatacatagaattatattctggaatcatctgtgacttggtgattttgctttgtgtttgtgagactcgtatgttgcatggaggtataattcatttatgctcagcaatgcaggatgctgtggtgttgataaactagcctgctactcatggataattgggtagtttccagtgttttgtgctgtaattctcactactacccgaagcattttggtacgtgggtatatgtgtactgatggcacatatgcaatcgtttctttcttttttttttgagacagagtctccctctgtcacccaggctggtgtgcagtagtgcagtcttggctcactccaacctccacctcctgggttcaagcaattcttctgtctcagcctcccaagtagctgggactacaggtgcatgccaccacactcagctactttttctatttttagtagagatggggtttcactgtgttggccaggctggtctcaaactcctgacctcaaatgatccacccacctcagcctcccaaagtgctgggattacagatgtgagccaccatgcccggccatatgcaatagtttctttagggttttgtgcattgagtatgcagtgaatgagttcactttgttccacatcttcacttggatcttcttaatttttgccagtgtgaatagtgccctcattgttgtttcaatttgctttatcctgatattaatgaagtagaacatcttttcttatttattggctatttctcttcatcagccatttggtttccacctctgagaagtacctcttatagctttttgtgtgtttctctatgacatgggactgcaaaaatacatgaatttagtatgtgaatgatacaaattaagtatatgtcatttggcttttcaataaggcaagagggttaggtgtggacttttatgactcattcttgtagggcccaggcctttggggcttagcgggtgttctcccggtgtgcggagacgagagattgtaataaataaagacacaagacaaagagataaagagaaagcagctgggcctgggggaccactgccatcaagatgcggagaccggtagtggccccgaacggctgggcgcgctgagtacaagaccagggggcagggtaaggagggtgaatcttctaagtgattgacaaggtgaagcaagtcacgtgatcgtagaacaggggggcccttccctcttaggtagccgaagctgagagagagaaggcagcatacgtcagcgttttcttctatgcacttataagaaagatcaaagactttaagacttttactatttcttctaccgctatctactacgagcttcaaagaggaaccaggagttacgggaggaacatgaaagtggacaaggagcgtgaccgttgaagcacagcatcacagggaggggtttaggactccagatgactgcgggcagactgggataatatccagcctcccacaagaagctggtggagcagagtgttccctgactcctccaaggaaaagagactccgtttcgcggtctgctaagtaatgggtgtcttcgcagacactggcattaccgcttgaccaaggtgccctcatgcgggcgtgacagagggctcacctcttgccttctaggtcacttctcacaatgtcccttcagcacctgaccctatgcccgccggttattcctaggttatattagtaatgcaacaaagagtaatattaaaagctaatgattcataatgtttataatgattgataatgtccatgatcatctctatatctaatttgtattatgactattcttattctaactattttctttaatatactgaaacagtttgtgccttcagtctcttgcctcggcacctagataatctttcacgcacacgttctgactatgagctatgaatggaagtgactgtcaatgactctgaaggttctgagatttatgctacttgctggctgacaaatcagcctgcgacatttcatagatgctgatagaaaacatgagactccaggatcagagatgaaggacagtttattacagcagcagcagtggtcaggataccattgtctttgtaccatttccctgaacccagattcctctagggcaatgcaaagagacatgatacctgcacacataatgggttgcattataggagaggagctctgagtttagagaacctgagtctttttatactgtgcagtaatcgcacctgccctttgatctggagggagacactctaccaaggccatttactgtacaagcatctttgaaaaggtagttcagagcaaagaacaatcagtgtcttgctcacaagaagtggaaaaatgcaagagacctgggggtgaattgtctcctggtagtgatgtgtgtcacttttggtcagagatagctaagagcaagtgtgagccctctagtccctgccatgccccccttggaggttgtgtgtgacgctgatgctcctgtcagcatgagttccttctgaagagtggcagtgagcactgctacttgcaagctgtagtagactgggatctcagtgttgacttattgctaatgcgtagcccagcttatcctgatacatagtctgggaacatgaaggaccaccttctgtttatagaaccccatgtctgcttatagatttcagattttatagagattcattaggtttattctgtctactttcagtcctttcgcttataaactttcaatccaagcataaggtctttttcctgttacgctgtttgaactttgtttaaaaattgtggccaagcatggtggctcatgcctgtaatcccagctactcaggaggattgcttgagcccaggagttcaagaccagcctgggcaacagtgggaccccatctctacacacacacacacacacacacacacacacacacacacacacacacacacagtgggaccccatctctacacacacacacacacacacacacacgcacatatacacacagtgggaccccatctctgcgcgcacacacacacacacatacacacacacacacacacacacacacacacacacacacacacacactagcggagtatggtgacgcccacctatagacccaggtactcagaaggctaaggagtaaagatggcttgagcccaagagttcaaggctatagtgaggtatgattactccacttcactccagcctggggaacagagtgagaccccacctcaaaaaaatcaaaaaagcgaagatttaaaaattaaaataagattgttagccagttttttgtttaatgaaggaaaagttttccaaattaacagaatgggacattcagataaaatttgtgcctttatgacccaggaggatggcctgggtgtacatacaagtactcaggacaccacattctcacctttggtatctatccgttttattactctgccactcccaaacagtaatacataggattccgtgttagtttcctagggctgatgcaacagattagcacaaaccgggtggcttaaaataacagaaatgtgttccttcacagttctgggagccaggaatctaaaatcaaggtgtgggcagggttggcgcctccctagaggctcttagggagggtctgttctgtgcctctctcctggcttctagtagctcctggcagtccttgccttccttggcttgtggctatgtaattccagggtcttctgctgctgtcacatggccttcttccctatgactgtgtgtgttcattcacataaatccagcaccaccagtcatcagatttaaggctcaccctaatccagtgaaacctcatttaactcattatgtctgcaaagaccctatttccaaataaggtcacattctgaggttctgagtagatatgaattttgggatgacactattcaacccagtatgctatatagatctgaaagcctacttgacacacatgtaaagctaaaaagtgactgaggcaacttacctgaaaatatattttacaaacagagcattacttcttaggtctcatttgagtactaccatttatttccctagtattttcatacatcacctgtatgactgcagttcgtaccccatactcaaaaatgcaggaacactgatgatggctatgcctaattttcagaagacaaaagtgagcatagaaaggttaaaataactatcctatggtaataactggtagaaacaggatgcaaaaccagccctcaccaactttgaagtcaggctgttgaacatcagaggaccttgagaacaaattgcttgactgtggaatccagggagctctctgcagtaactgctaagtacaactgctcaggctgccataatgaaacaccattgaccgggtggcttaaacaacagatgtttatttctcacagttctagagcctgggaagtctaagtaaggtgccagcagattcagttcctggtgagggccctcttcctaggctgcaggcaaatgcctattctcccgtagcagagagagagtgcaaactctgatcttccttcctgttaagggcgctaatcccatcatggggccccaccctcatgacctcctctaatgaactctgaaaggctgcgtctccaaatactgtcacattgagggttaggcattcagcatatgaatttggacgttcagtccctaacatacatttggttggtaagctgcagatcccagaatttttccaggatatctgtgcccatttcaaattgcaaattgtctgggttttgtttgttttgtttgcatgttttggtgaagctgtgagtctgtgtacatcagatagtgtaagctcacaaagaaatcgaagagagctggtgttttacttaaccagaattccttacttgaactgtgcttcacaataagaataaatattttgttattaaagaatgcagaagttaccattttattgcaaatttttattataattaggttttaaagtactataataaggcaaacatatctcagtgagactgactttttttcccttataaaaacaatgtttgtatgaaagagaaaataagcttagactccattgaacagcttcttcatggctgcagtattggcattcacccaaggactcttgagaaacgatcaaattttcagtatctttgaagcttagccagagatctaatgaaaccaaatgatgctaaagttcttaaagctaatttaaatctcaaattatacattttaaattaagtttttattgataataaatatactttatttcatattacccttgaaagcttgagtgataatattagtagaataaacatgttttacaaagatttaccattaagaatgctattaatatgacccttgatacaccagcacaattagatttcaaagtaagcacttatgaagtaacagcgattaatgacaaccatcgaaaacaattttgaactccatcagtttaactcaggagggtaaacttaatatgataattcatctagttgaattgtatcagcttagcaggaaggtatgtaaatatgtgacccttacctagcttctaaatggatgctgtgctgatagatttatcagttccattaaagaactttggggaactttggagtttcagcaattgttcccttggaggctgaaaacccaacctgatctcatactgggaccattctggtctgcatatttccataatttgcctttgctactaatatgacagcaagacacaaataactgtttctaataatatcagatggagttgtggaggacagcattttaatgtagtaaaagacctccccgtggggttgttattgctactatagaacagcagctacacagttgcaactgtagtctcttaattgattcgtttaattagcaagagctgaagcttgggctgtatcttgtcatctgatatcataggactcgaaatttgcatcattcatatttatagatatgtaaacatcatcaaaaaggtcttctgcttctgaaaattcacttacagatatcaaattttaatagagcagactcccatttgtttgaaatttaactaattaaaaaatgaaaagaattaagtttgttactgtttttctttatctgtactcttgagaaataagtgatgtcatgcatttttggttgtggatcatctcctaaacataaacttccagagaacttcttcagtcttccgtatctcataattccataagcagtccctcaactgacatgtctgacttaagttgatctctcctctctgtcccatccctttctctgtgtcagtgtgatttcaggaatgacatgatggcttactggggtttcttgcacacgtgtgctgtaactttccacctgtccctgcctgcctttgcagctgctccaagtcctgctagggtaggctgtctgcttgtgctgtggtttggtgggtcatctggctgagttggctcttggcagttacctgcctacccaagctgcattggtccccactttctctggaggggaaaagagaaacggatagaaagtatctggcatagaaaccagagcctttctagtctgtttaccctcaactccacagggcttcctccctgctcggtcacactctttgtattcctgacccttttctagtccaacaataggaagcaggtggcggtcacagagcagacactttgtggaggggtgatgaagttttctgatgttcagatatattttacagtgctaagaaaatctatagcattccttcctgcatttgcccctaaatatacaaaatttcaggcaaaatatgggtagaataagattttatgaaatggaatataaatgtagtcttaatcttgaacattgtttctgtggtaatgtgtgttctgtgtgccatgtaaccaagctaagaatgaacttttggaatataactacgtttttattcttttgaaattggcatgctctatataatataaaagtttggttattagtattgcagtgtgatgcattctgaacaaaaatttaaaagaaatcattgcctgcctgctatactatgtgctaggaagtgggttagttgaacatgacttggtccctacccttaagtagcacactggctggtgaagacagacaaactgataccatgcaaacatggtatcagtgctgagatgggtaatgcataggctcatatagtagcagagcgaattgtagatctgttagctttattatttgtttcttttattgataaacagtacagtccatagggcgtaggtctctggttaagaatttgcattttatttgtcaagtacacctcaataaacacagggaaaagaagaactgtatttcatatcttattagacattactttttgaaaatgagcacaaaacctagcatttaatggtagtcatgagagtcagtcagtcatcttacactggtgacagacactgaattctggcaattcaaaggaaacaaatatccctgcagtcattgggcccattgtcacctaaggatagagaaatgtaaatgactgattaccgtgataagaacgctaacagaggtgtatacgaagtagagggattctggggctgaggtgaagaaagtggagaaattgtgaacagtttttcagtgtttatagctcatgctgtgactttaaggatgaattgagtttgcaggagaaggcatttcagatagagggaacagtgagcctggagatagcaggttgtagaaactgcactctgtactgatgatggagaaagaggacggaatgaaattaataaaggcgcagaggtattaagatgtcccaagtgtttaaggaagagcagattggcttatgagggtgatgggcagggcaacaaagatccctttggaagatgaaattagtctgttgggggcaagatgacacaagaccattccaaggaggttgggtggcattccctagattctgaggttcattgaaggagttgaaagaagaatcataatctcatcagaggtggttggttttattggtgtggtttttttttttttttttttttttgacaacttatgggagtaggcaaagaaagaagagggtacatttgagagccacttctttagaatccagtgtacaattctatgtattgggcagaattgaagataattctgagatttctagaggtgataactgatgcagttagggaggaaaaacaggaagaagagaagaattgtaccagagaaaaggtggactctattaaaaagatggatttaaccaatttaagtttgaaatgccaagagacatctatgatataagggaaatttctggtctggagagcaagaagaagattaagagtgagcacgtaagttgatgccccagcagaggtgaggtcctaagccatgcagtagatgaacctgccaaagggacaatggcaaagcagaggccaggcccagaatggagctccaggaaatgcccacagctaaggtggaggcttgtcctctctaatggagtcacttacaaaatgatgacatgtttattattgaaatcatttatatatactattagaagccagttcattgtaacctcagttatgatttcacagtatcctagggtatcactaagttatttcaaagtatctcaggatctgttgccacctgccaaagatcttcaaagtaaaattaatatttataaataatgccttacgcgtgtatggtgctttagggctttagaatgattctacatatgtcagcttacttgattccattcaattgctaagatgaataagccatagcacaccttagagtgagtggtaaaaattagacatggaatacttcttgcagtgttttccatttaaaatatttgagattacaagttatgtgttcacaggaaattaccacgaaccactgccagattgctagtgaacaggatcgggcaggggtgggggaggaataagtagagtttgtcttcctgcatttgaatcgcagatcacctgtctcttagctttgtgaatttgaacaggttgcctaacctccctggtcctcaattttttcatcaacagaatagatattatctgcttttatggagatggcaagggctgaaaaagaaaacgtttgtaaaatgcctgaaaatagcaggcacttggcaaagaatagctcggtttttattgtagctccccactctccctttgcttcattttccctttcatttgtcttgcttggagacatgctatcatctgaagtgatagtctccaccgagtcttcaatttggtgcttggcctacagaaaaatccagagggaaaatattgttcccttttatttgaaaaaccaaatttgtgttaatcccctggttatgaccccttaacatagttaatgttttgtaagtgaatatggaatagaaagcacatacttaaatgtgtaccttgtggtggcagggtgcttaaaaacatctgtttccttgaagaatcttgcgaatcaccaacaccaaacttgaccagggaagaatttggtgccttgtgtttaaactgtgctgcttaaaatatattcagatggaaagaatggcaaaaccattctgatataggacattttatgacagtgcctatgagatgttctttcttctactggcctcacttttaaagggatatcattttaggtaggctgtttcagggcactgtcatatgttactgtggactatcgatctcttgtacctatgaattatttgattgtcactctttaatttatagtgagaaggaagtgggaatggcagctcttctcttatagaagaaaaatctgagtcagtggttctcaagttttatcatgcctgaggatgaccaggaaatcctggtgaaaatacagattcccagatctgttcctagaaaagctgaccccccatgtctgatgtcgaaatcggcttaaaatgcaccaggactagaatttgcaatatattttgaacattaatgtagaattactatctagtttggaaagtcaataccaaaagacacatgatattcctggccccatgagccaagcttaggagcagtgttctggatccttttcagaatgagaagataggacaaacgtttgattatttgtgctaattaacatgtactttcataatacatacttttttaaaatcagggagtgacatgataggatctaaagtataattaggtccatagtgtcatcaactgtatcttttaagtttacttatcatctgtataattctttagattcagtctgagttatttcaagtcttatagacagtgataatttttatttttgccctagagcagggcagtgttatctgtttgggcagtattaacattttggacaattctctgttgtgggagactgccctatgcgtaataggatgtttagcagcatccttggcgtccaccaactagatgtcagaacatgtctccagatataacaactaaaattgtctccaaatattgccaaatggctgcacacagcttggttggggagagactccagaacagatgtgaaacttagtggctggaagcttacaaagtacacatgtcatgacctacttgaataccttatgcgaagaaaataaactttacccgtcctgatactggatttgctttaggaacatgtttagcgaatagctgtttggaagtgtgtaaggggtactttttctttatcttcctcatattggatcatgaaccaggtctaccatggacagccattcatggaatttagggcaaagtctagtttgtgtgattgcattgtgttcatttgggttctttttaccatttgagtagatgtactgttactgcttaccaaagacacattttgggtatacagtgcgtgtgcagctcaataccttattctagaagctgctgctcttcattttgtcttcagttttgtaaaagccccgtaatcctgctggtgagacatattagagtgtgataagcatcacttcacagtgacatctgtgaagttcttctgttctttttgcagctactatttaattgtttggctatttaatattttgtggcgcttccccccttgtgcaaggaagtatatggcaggatgcctgacaagacacgtaggaagccacacagtagtcagcatctcaagtgtgtgttcctgagaaatagccttcccaagccggcatatgttttgtatggtgtaaattctcaagattgtgaggggaacagctaaggtaattcctaaggtatccgtgttaattacctaaggtaattaccaagcatcagggaacatagcaacactgcaaagtcaaagtaccctcgtttgaaatagaatctctacctgatttaggggttagggaaagaattagtggataggttctaacaattacccttctgaggtcacgagtttgagaccagcctggccaacatggtgaaaccccatctctactaaaaatacaaaaattagctgggtgtggtggtttgtgcctgtagttccagctacttgggaggctgaggcaggagaattgcatgaacccaggaggcgggggttgcagtgagctgagattgcgccactgcactccagcctgggcgatagagggacagtccgtctcaaaaaacaaaacaaaacaaaacaaacacagttacctttacagttcaccatggccaaaagattgtaccactcctttcctgtctcagccactttttgagtgactgtaaagtaggttggccgggggacgatcgttgcttgctgagtgcctgtaggtacctagcaccgtatgtttgtcattctcattgaagtctcccctttgagatcaccagtagaatccccatgtttcagatgcagtaacacggacaggaagtaagggatttgctcagagtggtttatatcagaagagcagctgtaggaccaaacccagatctagtaacaaatgtggcttccttcacatgagcatctgggtggttgggagttagttattcctgactgttgggtggagagcaatttgatgggacaaaaccagttcttctgtgttgaggcttagacaccagccacttaacgggccagacagctgaggtccggatttctctgcttcctgagccagttactcttgtatagcgggggaggagtgggcacattctttttttgagatggagtcttgctctgttgcccaggctggagtgcagtggcacagtctcccctcactgcaagctctgcctcccgggttcaagctattcttctgcccagcctcttgagtagctgggactacaggtgcccgccaccattccagactaattttttgtatttttagtagacacggggtttcaccctgttagccaggatcgtcttgatctcctgacctcatgatccacccgccttggcctcccaaagtgctgggattacaggcgtgagccaccgcgcctggcatcaagtttgattgtgagagtgcagcaattcagtcacatgtccaagctccactcctagttcttttgctgttttccctacatctgcagttacttcttgaacccctcaaagtcacccatgagggttagaatccagttcttcaaactcttgttcatgttgataatttggcctcttcccatgtgaattcaacacaaatgttcttaatagcatctagaatggtgaagaaggttttcaatttactttgcccagatccatcagaggaaacactgtggcagctgtagtcttccaaatgtatttctgaaataataagacttaaaagctgaaacgactgcttgatccatgggctgcggaatggatgtcgtgttagcaggcacaaaaaccacattcatctccttgtatatctccgtcagagctcccaggtaacaaggtgcattgtcaatgagtagtaatatttttaaggaaatatttttttctgagcagtaggtctccacagcaggttttaaatattcagtaaaccatgccctaaacagatgtgctgtcatccaggctttgtttttgcgtcctagagtacaggtagggtagacttagcatcattcctaagggccctgggattttcagaatggtaagtgagcactggcttcaactaaaagtcagcagttgcattagcccttagcaagagagttggcctgtcctttgaagccagaggtttacttctcctctctagttgtgaaagttagatgacatcttcttccaacagaaggctgttttgtctacactgaaaatctgtagtttagtgtggccaccttcatcggtgatcttaactagaccttctgcgtgacttactgcagcttcttcatcagcacttggtactttgccttgcacttttatattatggagatagtttctttaaacctcatgaatcaacttctgctagcttcacacttttcttttgcagcttcctcgcctctctcatcctgtgtagaattgaagagagctagggccttgctctggagtaggctttggcttaagtgaatgttgtggctggtttgattgtctatggagaccactaaaacttaggctgggcacagtggttcacacctataatcccagcactttgggaggccgagaggggcggatcacttgaggtcaggagttcgagaccagcctggccaacatggtgaaactccatctctactaaaaatacaaaaattgagctgcaacaatagaaagatggtggagcaagaacaaagaaacaatccctttgactgggcgcggtggttcatgcctgtaatctcagcactttgggaggctgaggcgggtggatcacctgaggtcgggagttcgagagcagcctgaccaacatggagaaaccccgtctctactaaaaatacaaaactagccggacgtggtggcacattcctgtaatcccagctactagggaggctgaggcaggagaatcgcttgaacccaggagacggaggttgtggtgagcaaagattgcgccattgcactccagcctgggcaacaagagtgaaactccgtctcaaaaaaaaaaaaaaaagaatccctttggttccagaaaatctcctgaaaaagaggaaggcttattaagccttcagagctacccaggcaaagcaggtacttttggcaaagaggaacaaaggaaaggaaaagggctcaggtttaagggactggaatcctacatgattcctggcggcagaaacatgacaaggtgggtctcagacgactagaagtgaaacctcatgctttggaattgccagataaacattccttggcctttcttgtacgtatcaaaaggattgatggtgtggccgggcacggtggctcatgcttctaatatcagcactttgggaggccgaggcgggcggatcacaaggtgaagagttcaagaccagcctggccaacacagtgaaaccccatctctactaaaaatacagtattagctgggcgtggtggcaggcgcctgtagtctcagctactcactcgggaggttgaggcaggagaatcgcttgaaacccggaggctgaggttgcagtaagccgagatctcaccactgcactccagcctgggcgacagagttaggctctgtctcaaaaaaaaacaaacaaaacaaaacaaaacaaaaaaagtttgatggcgtgtgagtttactggtgcagaaaaccattgcaagattttgcctaaagaaagtttttagtggtgtctttgtaaaagtcaccccctgctgcatgtaatgggatcttatgtgacctggggatttccaaatctgaattttctctgggaactgattttgaaacgtggtcaaggtcaagaataagaccatccctctgacagacaacacagtggttgcggagcacctggggaagtatttccaggagacttcatggttcttgcgtcgtttccacctctcagtggcccatcatgctaccaaaaatagagtgggcttcctcgagatgggcacacctggctatcggggtgaacacgtcaatcagctcatccgccagctgaactagacccaggtgccaaactgcagtacatttttatcagtgaagtggaagcgtgtgttttgggtttttttggggaatttttatcaagtatcttcagagaagattatttcctgcttaatcttcaaaaactggaaaggaagggtcaaagaaaagacagtagcttatgtttatggcgggcacctctcatcacagtcattcccaaggaaaaattccagagttttctacattggcagctgcctcgtctaaatcaacacattccatgtgcatcttctatccttgggtttaatgttgctaaatgagtaactctagcatttgtacaagaccccctaagactctggcagcagtcgaccaagcccagggacataattgaatctggagattcctgaggccttgttttgaaaaagacttgaaatacacataggaagaaaggcccaaaaataaatgttcacttgtctctgcaaaaaaataaaaataaaaaataaaattaaattaaaaaataaaaatatgaaaactagctgggcatggtggcttacgcttgtagtcccagccactctactcgggaggctgaggcgggagaatcgcttgaacccgggaggcggaggttgcagtgagccaaggtcacaacactgcactccagcctgggcgacagagtgagactctgtctcaaaaaataaaaataaaaaaacttttcatatcagcaacaaggctatttcactttcctatcatccatgtgttcactggagtagcacttttaattttcttcaagacatttttcctttgcatttacaacttgagtaactgcacaagagacctagcttttggcctgtttcagctttccacatgctttctcagtaagcttaatcatttctagcttttgatttaaagtgagagacatgtgactcttcctttcacttgaacacttagaggccactgtagggttattaattggcttaatttcaatactgttgtgtcttggggaatagggaggcccaaggagagggagagagatgggggattggccagatagtggagcagtcagaacacacacaacgtttattatagtttaccatcgtacatgggcacagtttgtggttccccaaaacaatttcaatggtaacatcaaagatcagcgatgacagatcaccacaacagataacgacgaaaatgggtttcctaataatgcagaggtttgaaatactgcaagaattaccaaaatgagacacacagatgtgaagtaagcacatgctgttggaaaaaatggtggcaatagataaagggttgccacaaacctttaaattgtaaaaagtgcattatccttgaaacacaatagagtgaagcctaataaaatgaggtaggcctggattttttggatacttgatagtatctaagtttcttctcaaacacagcaaacatttcacagttcaaatttgcccatcggtagagttttctctgtggatcttctctgttaatgccacatctgtctagagtaaaagttcaattcaatattgtgctatcaacttagcaacttgttgaagatgaactaacataagtacatgctgtgtgtgtgttccgtgtgcagacacaacacaggtgagctttccgtaagcctggatcttcccaatggcggtgcttctcgtgtgcaggccaactagggagaaggggacactggggcccacccggagctctgtgggccttgtctcttgtgacaaggatattttgctccttagctcagcagagtccaggttcttgtctcaggactgggaagaagtaggcaggcggacacttggagagtgagtggagtagaatgcactaagggaaaggaaaacttaaaggaagggtcttgaaagcagattgtggttctcccttcacagtggaatacaagggcttttatatacctgctgatggggctgcgttccctatttctgtaagcgcgaattcctggcggctccacccgtccttccaatgcagacgtgggcccttagtctgagccactctacattgatttatttcccttactgcgcatgtgttaagggacagaacttttccaccgcaagcatgtttgggcaaggtccctgggcacgacgaccttggtgggtcagaggttctccggggaccctcccctgtctaccggggagagttctctgcttcctgcctccatctactccccagtctgcagtctggccctcggtggtcctgcagatctggtgttgattttgcagggtgtttggaaaggtacctgcgtattttcatttatggaagtgactgagtgccgacgaggagaggttaatgcccttgagaggagaatttattacttcatcacctaagagaagggggcacacccctccatgcagggcacaggggaaccaccagtgtgggtcaggaggcagaaaggagccagagaaaagtgtgggtgggaaccttagtggggcttcctcgggaaaggcagtgcgtggctggtttgaataatgatggtgggctttggggtggtctctatttgcctggtatctggccctgggatgttttaaggcagggaaaatactggcttggtgtgtgttagagaaaatgggcagctggcttacttccaagttctttactaaattgaggaattagctggtcttgggagaggcagtgtctttctgggtctgtaagtccctggaaaatgttaaagtatcataagataaaaaaaaaaaaaatttaaacctgattaatacactgtgaacctagaagtaaccagattttaggaaactgacctatagtgagcaaactcacagggattgatagctaagccagaatatgcatttattagcttgaggggaggaatgtttcttccagtgaccaaatctttaagtctgccctccagaatattgactaaatattctgccatctagaatggaataattaggaaactcattagtcaccttaatttcaaactagtttggtttatgtggtaatcagagcaaacggtgacgtggtgtacctgtgccgcgcagggacttggtgaattaatctcttctcccagaacgccccacaagggccaccgccgtgccttcccttttctttgcctctgcgctgctgttatcttcccacagaaaggccccctgcagtcgattaggcttcagctacctaaacaataggcacagacccaaacgatgtcaaactacagttttctcctgcccttagggtggcactcaggccactttgattggaattttgagtgtccccaaactctggttgtactctttcacagatgggcaattacagtactgctctgtggagttttaccagtatagctctcagaaattcctaagaattttctatttcttaggttacactctctatagtacatacactcagacagaaaaatatatttcacgaagagagccttgaaaaatctcatctctagtcccagtgatgccttaaactggttgtgtgaccttcgtaaacctcagttttctttgttgtaaaatgaaaggtcggggtcggtgacctctagagtctatcccacccctagcctgctccgagagtgattgcatttggcacaatatgcagtttgcttcgcagcagtagcaaaatgacacatgcaacttattatcatcattgtctatcttttgatttccttgagttttccagtctcattaggggagacatctctggcttatcgcacaatgacatcgtgtcttgtaacttaatttctggggacaacacattgtgctgccacaggcacagtgctaataatcaaggttgtctgttctgcttactgtgacttttttgtggtttctggagaaaaaatgcagatgcttttcaattattctaagggaattttgatgaaccccctgggtagagttccctgtgccacctgccatgagaagtgagttttatcgaacagaaggtagggaattgaattgctcatatttgttttctttctggtacctatagtattatttcaagctcaagcattttaataaatatttaataaatacctgtctaaaataggccaaaactgtcataaactaaacctcttttcttcttcaattttaaatgcaaatgagttaatttgacttttagtggaatttccaagataaaggcccatgtttttcctttatgtatccgaaagttatttttgatggtatagtgaacgtcctgcttactacacattttatgtattagcctttggaagcaaattccttaagtttattgcaacgttgctgcttttgttgccattcttataattttatgtatttactgtttctctctctctctctctctctctctctctctgtctctgtctctgtctctctctcatattgagacaggatctcactctgtggcccaggctggagtgcagtggtacagtcatggctcactgcagcctcgacctcctgggctcaagtgatgctcccacctcagcttcccaggtagctgggactacaggaatgcgccaccatgcctggttaattttttaggtattttttgtagagaagggattttaccacgttgcccaggctggtctcgaactcctagtctcaagcgatcctcccaccttggcctcccaaagtgctaggtgtgagccactgtgcctggccgtatatgtccattttgcaggccagaattctttgactgtttgatttacagagaattttcaaatatctgcctctaaggacttttgtagcaattttattgagatacaattaacgtataattcacccacttaaaatgtaggatccagtgggttttgtttcttgtttttgttgtttcttttgttaagagataagcagcaaatacatttttagtataattatgtttcattcaatatttgggacatatgctaacacttgttattattagcattattattagcattattattcaagctgaggtctcattctgttgcccaggctggagtgcagtggcttggtcacagctcattgcagccttgaactcttgggctcaagtggtcctcctgcttcagcctcccaagtaagtgggattataggtgcaagccacagcacccagcgattcactggtttttagactgtccacagagctgtgctgccatcactgtaatattttaaaacattttcatcaccccaaaaagaagccccctacccattagcattcactcctcaccccttccacccctcccgcctgtggtagccactgatctactttctgtctgtgtatagcttattctggacatttcttaggaaaggaatcatacagtatgtcgtcttttgtggctttcacttacatactggtatccacattgtagcacatgccagtacatcattcctgtgtatgggcaaataacatcccattgtatggatataccttaacattttatttacctgtcagttggtgggtgttggttcctgtcttttcggctactgtgaataatgctgttatgaacattcatgtacgagtttttggggcgacaaggttttaatttttcttgggtgtatacctagaagtggaatttccaggtggtgtagtaactctatgtttaactttatgaggaattctcacactgttttccaaagtggctgcaccattttaccctcccaccagcaatgggagcgatccagttcttcccacatcctcactgacactcgttattgtcttttttattatggtcatcatagtggctatgaagacaggcttgtttttaaatattctctatgtagtattctgctttcttccctagaaatcataattaatgcagaagtagcccaaattgtgtatgttaatttgttttatttttttaaaacaaacttgaccccccaaaagcaacaaagcacatacatttcagttaatatatattttctaggacgttattgtctcttctcaaatgagatgatttcgatatgaagcacagagttcctttcattttcctatgctcattctctctctttttaatggtatcacatactgtgcaggaaggtcattatataaggagaggaaaaaagaataatcagcatagaagagaaaattaatgctgtttgtgtaatttttaataggaatgttgtaaaattttgagatttaaaccaactactaatattttttatacattactgggcagtttcctcttgttgcctgtgaactgatactttgccttggaaactcagatagtaaaaatatttgtcaaagcttcaaataccagtgttttaattccttagtcatttagatattaatcctgttctggagaccacctacatgtgtttgtaagggatgtgataactgacactgtatttaattagcactaatattgtgaaaaaagcaaaacatattaagtatctttccaagtcactagtttgaaattagcagaagtgaggaagagaaagtcctgtccaccccccacccttagtttgcatacccatggaagtttgtgatccatttactcattcatttatccaagtatttgataggtacatattttgtggtggacaacattccaggtattgtggaaatggaccaatttcaataggacagaaatctgaatcacaaataagcatccagtggcaaccagctggtgtacacactgcacctaaatacaaattcataggtatcaaaatcaccttcatgtgtcacacagtcacctttcttagttcctcatagcaaaactgggggactctgaggtcagtccccagagtacctggttgaggggtggggcagggcagttgaataagggagtagaatgaatgaaaactttagactctgaagctcgtcactttattctgccatattttagttttgtggtattaaatctctacagaaattaattatcttgcttcctttcttgaattccttttcaaatgttatagttactacttcagtaattctatcccatctgtttatatacaaaaggtaatttaccgggtaatgaccgagggcacctgctttaaagtcaagtgcatactaatttactggctatttgcttggcctcatttacgctctctcggcacagtttctgggtctgtaaaatgagagtgattgtaccatctacctcattggcgacagtgagaattaaatgagttggtgcatgcataacacttagtacagttcctggcacaatgttaccactcaataactagcagtgtggaaatatttcacacctaagagtaaagttttatttacctttaggagacaggatcctgggaactttctggttgccatagctgcttcctcaaggcaactaagttagatgtggagtttctaattcctgttggaaattcagtgaataagaaaatactactgaaagttatactattttctgcatgttaatgatttgatattatacagctttaagttctcagtgctcattcgggtagtgcaggtgagagacggcggctttaggggcaaggcagtgaccctgtggatgatgggaagagagttgttaagaaataattgtttaaatcatccagagagtactgtagcaaggattgttcctaaaaagaactgtggtaatccttgttgaatagcaagtttggacagtatacggtagggaaatctcaggaatactataaacaaataaaatgatggggtgagccctatgaagcgtgtgttctcctgtgggcagtggcagagttacccttcacccctgagtcctgatttctcagcctcttcatgtgactgtctccttggctcctgggaaagaaagaagcctctaccttccctggattgaatgcagcccttcttgtcccgtctgcagagcatgaggaacagctggccacctgcacctgacaaggcctgtggccgcgggcagtacccagccctgcgctgacggccgctccaggttgttgctggatgtggcgagctcgagctaatcgggccttttaggcttttgtttcttagcaaatgatcagctgtgaactgcccttggcctaacttggccttgttagctcagaagcccgcaattcattgcattttaccctgaagaggaatggtaggtctgaggacatatttatttttctgtggattttttttccccttgatccaggaaattgtctgtcttcaacaacctagtcttgtctcctccagagaaaagttttgaatcctctgaggagcggtctgtcgccattgtggcctgtggtcagtgggtcagaccagagccctgacaactgtctcccttcctgggcccaagtggacaccagaggagtttggggctctgggatcagcctgctctggcgagtgtcctttccctcccactctggaactgtagcttctcagccctcttcttgatgctgggcgggtgcctgggaggccccaccccttccctgggtacctggggaggtccccgactgagaggtgggaagacctgtgtcccctcccccagcacactctcagcctctgacttagttctcataggaggaggcaacagcttccaggagctgctgctgttaccctcgacgccatgatgaggaggaaattgcctggtcaggagggctcgcctgcctcttcacagccaggcgtactgtagcggcctcaggagcggtcaccctgggagtgactcctcacctcctaagcagccctggggcatgaacactcgtcctggaaatcctgctaggctggcttaagggagttgcttctagcatgcctttctggataagcctagtagaattgctttttctactataaaaaggaaagaatggggctcctcatattatagtaacagaattcttggtactagaactggtaagccaagagaaatggaagctgaccaacttttctctctgcacagggttcagagggatagaaacacacaatttgactctgcatgcaccagaaccttctcactcagggtaagggacagccacagtttctgggacgttacctaaaaacacaataatcccacttattctctgacagataatcatcagtcatagccccactactcacttttattaaagaaatagctgggcccttttaggtaaagccctttatatactgggaaaaaaggtcatgttatccattcctcaaatcccaggtaaactcctgctggttactcaaaaataaaaaccaaaatgaaagcccattcatcacagggatgcctaatcttgtaatgagggaatcactgagtgtggcacagggaagactcctgagagattctgatggggtacaagtgtgctgaccaacgtcctagatacagtgggcccttgaacaatatgggggctagggatatcaaccctgtgcagtcagaaatctacggataccttctgactctcccagaatgtaactgctagtagcctactgctgaccagaagtcctaccaataacatacagtcatttagcacgtatttggtatgttacatgattatatactgtattcctgcaataaagtaagctagagaaagtgttaggaaaatcataacgacaaaatatatttattattcattaagtggaagtggatcatcttaaagatcttgatcttcattgtcttcacgttgagttggctgaggaggagggggcttgatcttgctgtctcaagagcagcggagtcataagaaaatgcacatttaagtggccccatgcagttcaaatccatgttgctcaaggctcaactgtacaccgaactgaaaaatgattccatttttagtaggaaatggcctactctaagtcctactgcttccctttgcacttgatggcaagggtctttaactgtgtcagtggagctggtttggctccactgatagagactccctgaccatctgataggccacttttgttagaggagaaggtacccccttgcctacctgttcttttcttacttcatgggtcttgattcctgactcaggagcacccattacagaaaagccctgggactagatctaattttatttaatgaaaaacctatggagcatttactcttgcttctaataaattaacaagtcagggctttcttctgaataggagggtctcttgactctttgatatttgacttttgaaccagactagatgaggcagagcttcagcacatattttaccagtgtcttcagcaaatgcctttctctttgcaaagctccatattactaccaaaaattaacccaactaaattgtaatttctactcacccacatttattgagtactgtgtttccttgaaagatctcaaacaaggcaccttcttgcaagatcttcaccaccagaccttcatgatagtcacctcctcattaggctgagacgcatacacagtgattacgttcagacacagggactcctgtgtcttaagaccttgtgtgacccttgtaattaaagcattacactttgcaaaggctgacagtggtataggggctgtctgaaactattcagccatagcctggtctctgctttctttttacaaatgggaggttggctaaggcagacacagggatggctaagagggataaaggacgtgacttccatagaaccttttgttcctagaggaacctctccatgaaacacacagtgaaactagattaaaccaaaaaacgccctcagctccagcagatcctgagctacaaagcacctcttccctaccgagccttctcacccatgcgcactgagtttctgagtatcagaaagtcaggtttctgaatccctagagaaagtaaaaatttccttggacacaatgggttttctttgcttcctgcatgacagtcacgaaggggaatctgaaatagagaacttgaatatgcggcttgctgaagggaagtgtactgtacagtagccccccttctccacgggggatccatgtcaaaatccccaggggatgcctaagactgcggatgggaccgaaccctgtatacgcttgcctttaatgccttttccatttcagctcggcacttagcccacactgtggctgtaacttttgtagttttaggtacagcagcaaaactagcacaaatttctttgtcctttttcacaatttcatggatagaagattgattcttactgtagatcttagcaatctcagcatacttttttttttcttgagaactttcaccttttaactaaaggaaggacttcatggctggtttttggcatatccagattgccagcatcatactcttggaactttgaggccattgtgaagtcaaataatagttcctgccaggcacagtggctcacacctgtaatcccagcattttgggagtccgaggcaggtggatcacttgagctcgggagtttgagactagcctgggcaacatggcaaaactctgcctctacaaaaaacacaaaaattcaccggtcacggtggcacatacctgtagtcccagctactcggcaggctgaggtgggagcatggcttaagcccaggaggtggaggttacagcgagccaagatcatgccactgcactccagcctgggcgacagagccagcctctgtctcaaaaataaaaaaggaacctaagcactgagaccccctgacagtagatctggtaactgagatggccactaagtgactggttggtggtgggggtgtctacagcgtggagatgctggaccccgagagagagggtttatgacccaggcaggatggagcaggacagcacaagatctcctcacactactcagaatgactcacaatttaaaacttatacattgtttatttctggaattttccatataatgtttctggaccatggttgaccacaggtaaatgaaaccttggaaagctaaaaccttggataaggggggactactgtaatataaagtttacagttcctggggtgaaagctcaggcagaccctatctatgcattattacaacgtaccatcaattcaaaaccataaatttgcagaaacatcgttgctttaattcctaaaatattgaatatgaataataaaaataatatatgctttgtcttagaagcacctttttaatatgattgatgtgtattgatctgtttcttcattctaacgtgaacatttctgtaacagtcatttcccctgaaatatctaacctgtgggtacctgagacagcttgtcagttaggaagaacagtggtggcgatagccacgtagggctggtttggtcgtgagtgcaagtgtggttgcagcagctagagcagaggactgtgtggagaacatgggtcaggtcagaaggcagtagccaggagggatgcagagtcgagagagaatttgttgattggaatgactcaggttgactttcaggatgaagagaaggggccaatagagagggaagagaggacagttgatgaggcaggctccaagagaggagggcaaagcgagatcaggggctccagtgaaatgcctgagtgtgatgagaagagcgctgtcttgtgaggctagagagggaaccaaggatgggtgggcctgggaaggctggagaggtagcctgtcagggagctgctaacccacttagaaatactcttattgacataacaaggttttttgttttggttttttgtttgtttgttttgagagagcgttcgctcgttccccaagctgaaatgcaatggtgcagtctcagctcactgaaacctccacctcctgggttcaagcgattctcctgcctcagcctcccgagttgctgggattacaggtgcatgccacgggtgcagtggctcacgcctgtaatcccagcactttgggaggtcggggcgggcggatcatttgaggtcaggagttcaagaccagcctggctaacatggatataacaaaattttctatttcaaaagttcagtcgtgggcacaagttgattttgccttacagtcttgatagtgaaggtgcatactatttttaaagctgtattccttagatactaccatattatctaatgtttctaataatggaattagcaaaaaatgactacatcatccaaatttgactttgtactaacatacttggcgtactccatatccctgaaggttaacaagagataaatttggcctagactggtcttttcctgaattcatcacttaaaaaaggaaaaaaagaatggggaggaaaagccacgttttacttttataatttttattccatcattaaaagtacaacttgctttatgatctgaagaaataccatctaagtctttctattaggaacaaaagtgagcctttcagggaaaaaaaaaaaaggagctgggcttaatctgcattagccctttgatgtattcccagattttaaaaagcttcccactgttctcagccacgttgaaacagacccagccatgtgtccggcgctgtccttttctcctctcagcacacacttagccggagacaccttttggccaatgggccaggattcttccattgcatcttcagcatgtgaccgtttgtgctggctcattgggagttctgctgctcagtactccttccccaggcaaagactcttaagttaataattggttcagaagaataaactataccgccctcttggtcttcttttggacatttctttaagatgaggctcttactggtatatctggggtactttattgagaaatagaaagtgctagctgaaataaggcgtatcagtctagagttaggaagtgagaaatgcaatcggtaaattttgcttttaaataaaaatggaagccccattttaattgttgccatttctagtcattttatcatttttaacagcctggttttctattttagagaagttgctgaccaatatttagagagcacctccctaatctgcacatcctcttgtgtgtgatggtgaagtgatgggttggaatcgtttttaatgctgtttccattgatgggacattattaccagaaggagtgctttgtgccagctggtttcatggatggaggaaaacaatctgggtttcagtttcacaaatagaaaaacaaaacctgagaggaaaaggaagtaattcgttagcagtggccactgtgcagagtaggataacctgccttcaaagatttttgtttcatgcactataatataatgtttaataaatactttacttcaaagaacctcactacaagaaaactggccgctttcctgctattcttgttctccggctcagtatgactataagtagctcatatccggtcctctgtggtctcaggtggtcgtttgtgtttatgatccttaagctgaaactgtaaggactgtgtccctattttaagtctttagcagatccaccgtgttctgcaggaattgacagaggctctcgtgaaacccttgacactttgacccatcttgaggaaaatgcttagatgctaaaagcagtgtgcatagggattacgtcctccaaaaatagaaaactctaaatttactaagcagggagtagagaaactcatcagactgcacctcaagtttttgatgtgttctggtcgcctctgcactcccattctagacttctaaacaacacgttcaggatctctgagataaaagctggactgaagttacagaaagagcattagagatgtttgaatttttcttttttcccccctgtagatatatttggcatatgtagaatttgagagtccactattgataccagtttcttccagatattaacacatatcaaatagacagctagaactcagaagaaactaatggagctctgaaagaaaccattgttttttccactataaatcttaactcaacagcatttagggtctgggtggagccagtcacctgggcagctgcttcacacccattttgaattagctgcccagtgcttctggtgagcacctcggtaggagccactgctgtgaactcttttgcaagttctggtggtgactggtttggtttttattgctccctgtttgatgcactgataggacctagggctgttcttagaaatataggcctgagacgacttaaatttcacactggttttgtcttccgtttccacattcctctcactgactctccctcccttcctgccctctctctctctctcatatgaaatgagtttaaaatcagaggggaaggattgctttaatatttagcagtctaaacagagggggacagggctgaagaggaggaagggagtgaatgggtgtagaagagaaaagctgttcccaccccattgctttaatgacagtggaaagggtgcatggattgggcctgtgtttctctatcagctactttgttctttaaagcactggctagctaagccatctctttctctcccatattttgcctctttgagtgtttgcctagaaccacttagctgtggcagccctgctgatggggcaaggtgctctgcaagtttctaggcaaggtttctggatccatgttgaaattgaacgcagatagcacaaccatattataacagctacttacaaaccagtcagcacatgtgtggtgagcatttctagagttgagttattgcttaggtcaattgtaagaggagtttctctgaaagagttctgctctttgaactggcaaccccaactctagaacttacagaattgtttttgttaatttttctggcaagagattcatccaagtttcctaaacgtactacaagggtatatgtatacagagaccttaaggaatggccagccatgcaaaccctagggaacatcttatctgacagttcttgggatccacagtggcttgggtcataatgataatactgtaactgggagagctgatgtatatggagcactcagtatgtgtgaggcaccatagattctctcttcatttaatcttctcatgagaaatacagacgttaaataattttcccagggtcacataagctggtactaggaatgaggcttaaagcagggctctctaagaacaaaagctgtgatgccttagcatcattgacagcagctcccaggtcttactcatcctagtgcagtcccgttagtctacctgagctccccctaacacaggagttggcctctgcccactggggctttcattcccactaccacccacagtttctgcatatggcaggtcggagcccatcgtagtgtcatgagccattctctaaaccaccgtctgcctgaaaactgcctcattctctgtcattcctgaaggaaggactctggctggcccatctcatctttactcacctaggtgttcaatggatcactgggtaatctgagggttgatgttcttctttagtctatcaaccaatcccagagatgggaggcagggcttacataacactgtaaatactgccacctgggatgacttctgcgggagaagtactgagacccaagtccaccatgggaactaactggataagtttccgaagatttatgtcagtaacattcaccaccgtgtcctttgtattcacaaaataattagaaactacctgactgtccatcaataggagtttagttaaagaagttttgttgttccatatggcagaatattcatatgcagccattaaaatagtgatcaggtaaatgtttacaaacatggaaagatgcaatatgaactatattgtaacatgaaaaaataaagttaaaatggcccgtgtaggatattgctttgttttacaaacacaaagttgaggctgggtgcagtggcttatgcctataatcccagcactttgggaggccaaggcaggatgatcacttgagcccaggagtttgcgactagactgggcaacctagtgagacctcatctctgcaaaaaattcaaaaagtacaataagccaggtgtgatgatacatgcccatgaccccagctactcaagaggccgtggtggcaggatcgcttgagcccaggaagtcaaggctgcagtgagctgtgatcgtaccactgcactccagcttgggtgacagagcagagagactctgtttcaaaaacaaaaagcccccacaaacatgaaaggcttaatccaggactagtaatagttgccgaacttgagcggaattgtcttcatgctcttatgttagcatctgatattttataatgagcatatcccttatagattcagcaatatatttgaaaaatacaccaaggtaaaggagttgtgctaattaaaagtagctgaaatgaaaaatattgattattgaggaagaaaaacaatgaaagtaagacatagaggcctcagcagtattactgataactcaatcattgttacctgtataatagaacaaattaagggcagaggttctgaactgaagcagtgttattactaaggtgcttgaaggggggaacccacatttctttaatagcaacactccaggtttctaacatctggaagtatcacaccatgaattttttttaacccagaaaaactgggaaaaacttcaaatcactgaatgacgtgttaaccaagtttctgactttaagactttaagattattgactctgaatttacatagaattctaagaatttcagttagttgattgtgtgtgtggtgtgatgtttaaaataagtttgggaaatgctgggttaaattaatattttttatttcaggatgtctcaaaatctttactaagtggatgtctgttttgaatctccaagatggaatatagaatgcagcatttctcaaatggaatttgaccactgagtccttgttttctttgggcatgtactaagtagcctttcccagagctcattttgtgggataccataggaaatgctgcgatgggaccttttaattaatttattttttgagacagggtctccctctgtcacccaggctggagtgcagtggcaggatcatagctcactacagcctcaaaactcctgggctcaagcgatcctcctatctcagttcactaagcagctgggactaccgaagcacaccaccacagcctgctaattaaaataaaaaaaaaatgtagaaacaaggtgccactatgttgcctgggctggtgttgaactcctaggctcaagtgatcctcctgcctctgtctcccaaagtgctgggattacaggtatggccactgtgcccagccatatatgtatatatatatattttttaatgaagccacaagcattctgcctctgtgctttttatttatttatttatttatttttgagacggaggttcgctctggttgcccaggcaggagtgcaatggcacaatctcggctcaccgcaacctctgccccccaggttcaagtgattctcatgtctcagcctcccgagtagctgggattacaggcatgcgccaccatgcacggctaattttgcatttttagtagagacagggtttctccatgttggttgggctggtcttgaagtcccgacctcaggtgatccacccgcctcggcttcccaaagtgctaggatttacaggtgtgagccggccgaccctatatattttttaaaagcttttaagaaacacagtaatctttgagttgagattttgaaaaaaattgcaaaaatattgcacattagcattttaaagttagtggaggctgggcatagtggctcacacctgtaatcccaataccttggaggctgaggctggagggtcgcatgagctcaggagtttgagaccagcctgggcaacaacatagtggtatcctgtatctacaagttttgtttttttgttttgttttttttttgttttttttttttaattagctggtgtggtggtgcatacctataatccagctactcaggaggctaaggcaggaggatcacttgagcccaggagtttgagcctgcagtgagctaggatcgcatcactgcactgcaatctgggcagcagagcgagaccctccctcacaaataaagttagtggaaagtgctatagtaaacttttcccagttttcccctaatctgttttaccatgggccactcccttacccccacttttattttttttcacattagctattaacatgccctgaaagtaatgttccttagaattccatcaggcaacactactctagatcagatctgcaaactacaccccaccaactgtttttgaaaataaagttttggctgggtgcggtggctcacgcctgtaatcccagcactttgggaggccgaggcaggcggatcaccaggtcaggagatcgagaccatcctggctaacatggtgaaaccccgtctctactaaaaatacaaaaaaaaattagccaggcgtggtggcgagcacctgtagtcccagctactcgggaggctgaggcaggagaatggcgtgaacccgggaggcggagcttgcagtgagccgagattgcaccactgcactccagcctgggcgacagagcgagactccgtctcaaaaaaaaaaaagttttatcggaacacagccatgctcattcctgtatgtactgtcagtggctgctttcacgtgactgaagcggaactgacagtgtaacatgcaaaacaggtaagaaaagattgaccatctagcccattgtagaagaaagtttgcccacctctgacctagatgattagtcataggtagttgcatttgcaaattgactaattttctttttacactccagcatgaatacatgcaattgaacagctaatataggtgtgtgtatgtgtgtgcacatatgtatactaaaatattgtaaaatgtcaagtgttgcaaataacattgttaactgaaagtgacggaatggccggccaaatttatatttattgtgtcaaaaacaaaatgtaccagacaattaagataattttacccaggccactgcagtaggggtaacgtttattaatgagaaatgtctcagagagaggaagaactagggttttataaatgcaggtgaacaagggaggggtccaagaattacggggttcatgaagaagagtggaagtctatggggaaggttgctttgcctccagccatttcctgggttaagaaagaggaggaagattctgtaactgtttctgtgttctaggagcacggggctcagggaaagttcagcattgtcagttgtcaacaaaatcagtaagtgttattaaataccccatggtgtgtggttctggcactgaaatggggctgtttcctaaggctctgtccatggccacctctgtctatttctgcattctgtcttgcattgcttctgttgcctatatcctggtcagcacagtttatggtgaatcattgcttattgaaatagagacggcaataatgaagccagctattataaattagagcaaatatacacatccaatacgttttaaacgcatgtgatctctggagtagtatcactaggtagcttccatttcagttcgcctttggtatattactgtactccaaagaatatcatttttccctctgtaaaattttcctcatgaaaatggtcaccataggtctgatttactttttggatcagtaacaggtcacagcataaatcccattcctgcatcaaggcggaacaagaccctcacactttggagggagctgagttcctgtttagaagaacatgcacagttagataaatctgttcacacggcttagatgatcagagccaacatctgatgactatgagcaaggcacttttctaaacatttttagtattttctgaacagttttgttgaggtatactttacagataacattcacctcttgagctgcagttcaatgagttctcgtaaactgagttgtgcagccatcaccacgttccagttttagcacatttccatcaccccaaaagttcctttctgcctgtttgcagccaatccctgctccctggccagccacaggcaagcgctgtcaatgtttggacagtgttggattacctaatggactcttcaagacagtcctttggggtgttactgtcattctctgttttacacggtgaagaagtgaggcactgagggcactcagggtggtttcaaatgaccgaggccaggtgctcagggcccagaaccctcttaccccctccaacttcagtgagcttcaaaatcacctgctgagcttgtttgaccacagacttgtgggctccacccttgaattcctgacgccctaggtctgggatggggcttgacaatttgcatttgtaaaaagttcctgaatgctgctgctgctgctggtcagggaaccctgctttaagacctcctggtttatgcaatttcaaacattgtaagaaatagtcactcatgtgattggtttgtgtgcttggtgtagactgtacgaggatttttcaaaagtaagtattgttcattctaaaggaaggaaatgtatgttatgagatagaattatataataaacagaaccattaaatgccatctgaaaagtggtgttttcaatggcaggaagtagcattgctgcgtattttgtgtgtgtgcgcaactcagctttgtgtcattgtgtaactttaatttgaaagaacatcacgtgactgctgttttcatttctgccttttaaaaagcagacagctattcagaacagcaagaagcagacccaaactttgtttgtatgcccctagtcataggcaaaaatggaaagggtaatttaccaaaaaagaagaaaatagataaaaaggaaaagaatggaaagaaagtactgactcactgcaaacagctgcaaaatgttgcccttgggatagaggttaactcggttgtgaaataatggccaaagcggtgcactcttaataacttttttgtagccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtccctttttttctctattttttaaaataaaaatattttagtgaatatgagttaaatgagaatcaagtggcttctgggcctccctgaaagatcaagtggaagcactggatgactctaatgatgccgaattgtaatccataaagcacctgggcagagttcaatcagaggtcccatttcagaagttttttggaatgtagggaaagaattacttagaaaaggttcatctacttggagaggagatggttcaatatgacttttagaagaagccgcagtccctgccccacaggggctgcttagattgcttagatggattgtcatctctctctctttttttttttgggacggagtctcgctttgtcgtccaggctggagtgcagtggcatgatctcggctcactgcaagctccacctcccaggttcacgccattctcctgcccctgcctcccgagtagctgggactacaggtgcccgccaccatgcctggctaattttttgtatttttagtagagacagggtttcactgtgttagccaggatggtttcgatctcctgaccttgtgatccacctgcctcagcctcccaaagtgctaggattacaggcgtgagccgccgagcccggtggactgtcttctctctaagcagtaagagacagtgggaactgcagaagggtgtttgcagcctcatgcagttgactgaatgaattggccccagagtcacccctagcaccatcttgatatggacaggaggcagggaaatactgggtagaagagggtggttccccagcaaaggccccaccctcaagcctggaaatccggagccctaaatgggaacaggcattcccgtttttgtgcccaaatgttgccttttggctcaccacgcccccctctcctgtatccatataaaccccaaaccccaggctccacaagcagaagagtggcagagcagtgcagcagagaaggagaaaagaaaaggtgcttctgaacattgagaggagttcggctggggaaggtagcagagatcagctatgggatgaccaaactccaggggaaagatcatcttcccactctgtcccctttccagctccgcatctctcaccgagagccatctccatcactcagtaaaatcctcacattcaccatccttcaagtctgggtgacctgattcttcctgaatgctggacaaagacttgggtaccaagagggcagggcttacagggctgtcacccttattctccgctgagctgttttaacacgtagccatccgcagatggcagcttctaaaagagcattaattgtaacagacccccagacactaccatggggccagagcccaaaagtgctcaccccagctcctacacctgcccctgcccatctgcgtgctctccctcccataaggggtttgagcacgtgtcggccaagcaaacgagcttcacccctgtcacaagtcctgagaggagtcagggaactctcccatttcattctgacacaggtgggactcagcattctcagaccttcaaaggcctgttgggtggatgtggaggtgtgcgctgccccaccaagctgatgcctgatcaggggaggccactagaatagtctcttgtacagcaacagagcctcttactacagtgagcttctcctggggctttcagagtacgtccgagctccacaccaagaagagagccaacccacgtggatgcagctcggttcttagggctgacttgaaacttgataagactgcctcaagcatgtgccacaaccccagttcttgcaaacccccacagagtcttgagaaatccctcttgtggtccaaattggggaaatatagaattagtcaaaagaaaaggctgaagtcttggtcatctacatgcttgcaaattccagccttcctggcctgtgagtgttgcatgaatatagcaggaagtcagcactctccatctttcacaaaacgtgatgtgtttcagtccgtgcccggtgaacactattctccacctccctccctcccaacttgcttgctttcagcttctctttaaagtacaccttaaaattcaatctatcattcagacatagagagcagtggcatatgagaagcaaacatttggctgggcgcggtggctcacgcctgtaatctcagcactttgggaggccgaggtgggcagattacgaggtcaggagctggtgaccatcctggccaacatggtgaaaccccatctctactaaaaatacaaaaatcagctgggtgtggtggtgcacgcctgtaatcccagctactcaggaggctgaggcgggagaagggcttgaaaccaggaggtggagattacagtgagctgagatcatgccactgtactccagcctggtgacagaggagactctgtctcaaaaaataaataaataaataaataaataaagggcaaacttttaccaagttctcatctcttaagccattgtttgtttaatggagtagtagatgatgtgggttgttatctaacaagaacattgtcccttgtgggactgcacttagcattcaccttcggatgccatggctaggtcaggatgccagcctaagcagtcttgactttagatttgaaattccggccgggtacggtggctcacgcctgtaatcccagcactttgggaggccgaggcaggtggatcacctgaggtcgggagtttgagaccagcctgaccaacatggagaaaccctgcctctactgaaaatacaaaattagccaggcgtggtggtgcacgcctgtaatcccagctactcgggaggctgaggcaggagaatgggtttaacccgggaggcggagtttgcggtgagccgagatcgcgctattgcactctagcctgggcaacaagagcaaaactcaaaaaaaaaaaaaaattttgtaattccttcaacacattataacatgacaagtgcttcttgccttatctactagtgaagactctgcccggcccgctggcttcctaacagtcctgtggcggtctgttctttcctgtgtacactccttaaattgtgacatccctacttctggaaagctcaccatttcctatacccctatttgatttattttatcccaagacttatctcaaatcctccctgctcccaaaatcctcctctcactgccttagttctccctctgaaattccatagcatttcattttctcaacacagactcagagaaatttgctggtaggagggaccttagaggtgcgattctcaaccggggcagtattgcccccgggcatattcggcaatgtctggagacatacttggttgtcacagctgggagggagtgctatggcatctagtgtgtggaagcccgagaccccgctaaccgtcccacccaacacaggacaactccaaaacaaagattaatccaggctttcggctgctgttgggaaacttgtccacattaccaccacatacctggttccacaatttacctctacatgtgcatgttcctgagtaattgcacactttgtaatgtctcgtagcccctatagctagtctagttaatttctggtcatcatggaaaatgccacctctctgaaatggccagcactggagagacgctactgctgctgatggtgaatgtcaggggactactaggtgtcccttctatttttgttaacttgtagttatttgtaggatgattgcctttagtgcagaaaattttttttaagtttataaagcttgtgagaaaaatccttatttgtaaagaagctcagtattattttgaatgttcttgcttctcatttatgactactcaataaagaaaataccttttcctgctctgctgtccagtttgttgggttaatttgggagatagtgtcagcaccctggaattgtgccaacttccaattatcactctgtgtaaccactgacttcaatttcaaagtaattactgcagatttttctcactaccctgaacatagcctacacgcttttaatcctacacttatttttttccccatctaaaaggaaaacttattttgattttgatactttttaattttttaaaacttattttgaaataacttagacttgggaaaagttgcaaaacaataatacaaagaatgtccagataatttcacccagagtccgcaaatgttaacattttatcagggttgatttattgtgtattcctctctttctctctctctctcttcccacctccaccatctatatatgtaaataattggtatcttctgaaccatttcagcaaattgctaacagttcttaagtgtgtatttcatcgacacaggacaacattcccttatggaactgcaatgcagtactgttaccacaattaggaaactgacattgaaacagcaccattgtcttatctacaaacctttcaaattttgccagttttcctactctttaaaatgttttcaaattgttgccagtttactcactacaaaaaatactgtctttaaagcaaaagaaaaagaagtgttattttctggcccaggatccgctcagagtcacaccttgcattgacttttcctgtcctgttggtctcctgaatctcgaatcgttcctccgttgttctttggcttccgtgatcttgacatttttgaagacaggccatttattttgtcaaatggctctcaatttggattcatttggtgtttcctcacagtcaggttgttactcatttttggcaggaacgtaacggtggtgctgctgcgttgtcctcgttgtcccctctcgggaggcgcatgttcacgtttctctttgtcccactgttaatggcatcactttgatcatttggttcaggtggtgtttgtccctttctccactctgaagttactactttcctttttccatttatctggtaaaggaaatagacagttaagctggtaatttcagcataatatggtgagtgttaaacagacagccagggtgccttgggagccagtaagtagatgtcacccaacctggtagctcagggaaggcttctggagttgatgacacctcaactgtgacttaaggtaatgattatgagtcagccaagccaaggaaaatggggaggatactgtagaaggacatgataccatgaacacagccatggagccacgaaacttcatggtgtgttcaggtcgctacagtggctggcagcttgagttctaggatggagttcggaagatgtcacggaatcccagtatggcagtacaagtgcacttgttctcacgggaggctggaagcaaaggctgtgctccttgttcctcaaaagctctagggtctcttttgtctcttaattccatagttctctctcccctaattaacacagagctaaaaatagcagagaaatggggaattggggggaagattatagtcaaagaagtttcatcacaggatgcacagttaatttggttgcactggaaattggtttccttctcttagaaaataaaaatcatctttgcaaaaaattgtcacttctttttctttcacttttttgagggtgaaaattagtgaaaaatgaaaatatgaacaagttgtgcaaataaaactaaaaagtcaccgaatttggctttgaagtatgcatctgagaagcctactattctttggcttgaatgagaagtgtaagttgtggaatggtaaagcagtgtagcctctttgacacccagccaatttaatttttttttttttttttaattttagtggcagtaagtactgacttaccaaggcttggggtagcagatactatcacagctgccaggacttttccaggctcctgtcaagaaactgctgcaattctgcaagagtcttcagattaaattcatgccaagtcatttcctctgttcttctaccagtgaggtcacctttgcagctgaccattagtgatgctgtcagcaagaaaaggattatgaactgaggtctaaatttcagtgatgtctaggcaaaaataaatgttcaaaagaatttagcgaggtttccaagacctggtaaatttctccctaagagaaattgccagatttgtgggctcttgattttagcctgaagaatcacattcttcagcactggaagtttttccttctttttttacttttctttttttttagacacagggtctcactctgtcacccaggctggagtgcagtggcaggatcataacttactgtaaacttcgaactaccgggctcagttgatcctcctgcctcagcctcatgagtagctaggattacagatatgtgccactacacctggctaacctgtttttttgtagagacaaggtcttgctatattgcccaggctggtctcaaacttctggcctcaaagtaatcctctcacctcagcctcccaaagtgctgagattacaggcgtgagccaccacacccagcccaacattggaagttgtcatagttatcgccagttgcctctctttttgtctggagatgtgtaggttagccaaaaaaaaaaaaaaaaattaccgatttttttttattttttcattcacaaatattgaatgtcttctctatgtaccagatactattatgctctctcatggaggttagtactgtctactggagaagacataccaaaaacaagagagagagaaagaggaaagccacaaatcagttggaaacacgcccgtattagtgactgaagagcctgcaaatgaaagctttacaaattcatatggccaaatagatttccttgctccttgagttaaaattcacataacacaattaaccattagctaagttaaaacatacaattcagtgcatttattaacgttcacaacgctgtacaaccatcatctctctccagttccaagacgattcatcaccccaaaaggaaaccccatttccattaagtgatcactccctattcccccacctcccccagcaacccctagcctactgtttgcgtgtgacttcttccactcagtataacacttctgaggttcatccacactggagcatgtgtctggtctttgtaggtttattccactaccaaccatgttctttatgcttaaaataactcctccctattgaactgttttggagtgatatttcctggggtggaggtagtttaatgattcatctctgtcttgttagcatgcttgtttatggtagagagaaattttgtattctgccaccataccttgtcaaaaccttttaacaaggcattgatttggttctctggttctgagaacttggcagtggaagacaagacttccacccgcattgcaagcaaaatcattgatgtcaattcacgttattgtggaaaaccgtgagttgtgacaagtgaaagcttttcaccaagccacaaaactatgggcgtgtgcagtcaacacacggaacacaaggggtttgcttccgtggctcagcatagcactctctcactagttctaaaatattcatagcctttgctgttcccaaaagacgtttgaaaaataagacttctcctttgtcagcatccgcgctcacataactggtgaaactaggagatagttttgtatcccggaagataatcattgttccattcaggtgttgggcagagagaaatggcttatctgcacatctgcaggatgtaagagattagtgaaatatttgtgattctgatgttgatgacttttaatgtttgacagagaaacttttgcaattattttcttctggtccaggcctcactccttctagcccacatggctctagtcaacctcctttaatcagcagagtaataggcaagactgtagtaggatgcctcaagacagacttttatgttgggacaagtagtgtcttattaaggcggttccagcctttcatatcctgcctccttgggataaagagtgtttgtttacagagcttctgggatagactgctgcatgctgcatccgtacctctgttgcagaagcacatctgtcccattatgtctagtgacaaaaataagaccaacgcctcagtgaactttgcatacatctgaatgtaagcaagacaagtatatttgacattttaaaaaggttttttctttcacagttttcaaaataacataggagaagcaaaggaaaaaatatttcttgtgtttctaattcacaggttgcttgagactttttttggaggtgctagcattttattggccacagttttgaaggaaaatacaattaaatcatgcttctgtcgtttggggaaaaggaataacagattcattttttctttttttaaagatgagagagatagtatttggaatctatctttagattattctacctctgaatctaattgaagtaagaaattgggcaagaatggaatcttacttaccacccaggaaaaaagctaaacaattgtggctcagtccattttcccctgagactgtcttcagattgaggcgatcagtgttaaaatggatggaatcaccaggctctccacattctagtaagattgtagtacggttgaaagtcaaatgaaagtccagctcttcagtgtgtcatttcctcttgcagacaccagaccaagggcagtggtggtctggcgcttatattttgttattatttgttgagaccagaactctccttaaggatatatttatatatgttttaatattaaagtttcttttcaaggaatttatactaattagttcatgtaataataacatgtgcattccatttaaagttaccttgctaaattttctaagacttgttagcttccccatagtttttaataaaccaaaagatcaaacgaacagtccccagttgcccaaatattgagcagttaaggctggtttcagctcatctgaaatctgtaaacatttaaagagaacctctctcccagaagatagtgagcacggtggtattctccagtctcagaatattaaggttacttacagactagagaggccttcagtctatattaacgagttcctttcctaatctcacccttctaagaatatatttgatccaatttagggacagcaacattgaggccagagaaaaattaatggggtagtaactgtagacaccaaaacactccccaaatcttgagacatcaaataagcaagactgaatttatgcaaaagatactttaaagatgtttctttagctgggcgcagtggctcacgcctgtaatcccagcactttgggaggccgaggcgggtagatcacaaggtcacgagtttgagaccagcctggccaatatggtgaaaccccgtttctactaaaaatacaaaaattagccgggtgtggtggtgggtgcctgtagtcccagctactcgggaggctgaggcaggacaattgcttgaacctgggaggcggaggttgcagtgagccaagatcgccaagatcatgccactgcattccaacctgagcaacagagtgagactcttaaaaaaaagaaaaaatgtgtcactcagagatttttctacctagaacaagagtcacacatactttttgaaattattttatctatgtaaacttacgaggtacaagtgtaaatttgtgacatgcatagattgaatagagaggaagtcaaggcttttagatattcatcacctgactaatgtacatggtacccattaagtaatttctcatcatccaccctcctcccaccccgtcacccttctgagtctccattgtctactatcagaaaagccttctccagcagcgcattgtcagctgagtctaggagaagaaagccttctcatggacatgagctaaattccctgggaaaggccattccataatggagaaggccttctgttcacccacagtgtggtcctcagaccagcagcttcagcgtctcctgggaactcactagaaatgcagaccccaggcccagtgtggcagctcacgcctgtaatcccagcactttgggaggccgaggcgggtggctcacgaggtcaggagtttgaggccagcctggccaacatagtgaaaccccgtctctactaaaaatacaaaaaaaattagccgggcatggtggcgcatacctgtaatcccagctacttgggaggctgaggcaggaaaatcacttgaacccgggtggcggaggttgggctgagctgagatcgtgccgctgcactccagcctgggcaacagagggacactccttctaaataaataaataaataaataaataaataaataaataaataaaatgcacccaaacctgaattggaaactcaggtggggggcctagcggtctgtggttttactagccctccaggcaagttttgatgctttggtgattgagaactgctgcttatgctgtcttggtggagagcacttcagccagtgcctcttctgctgattctgtatttatcaaagaaccactgactataatttagtgctcacactacagttaggaggtgtgtgagttccctttacaaacctatttctgattgtaaattcctaagatgttttacacatcagtatcttgtgagcttgataaaagtgaatccatctcgttcagagtgatgcattatgagtgtatagtggaagtctagcttctaagcctgtgaaacagaggcccagccccctgatccaggcagatttcactaaggtagaggccagggtagatgtccctgctgaacgggcaccctctcatcccacctcaccctggctgtgtgtactgtatatttttaaccaagaggagagcagagcggcacagaatggctggtactcagtattcctggtttctggattatacagatgcaagggaaatgtctcctagtcttatttcatgagttactgtgtagcattattgaattgcagtggtaagagggttaggtaggcctttctcatttttgattagacagctatcatttacaaattagaccacagggaatcgaccttaacttctgtgactaaagcttttggcagttacttttggcatttctggccctctagacttgaaaatgactgagtggttacaatttacaaagttaagagagctttctgttgattggtgtgaatggtaggatatgagacagactcttaggagtaaaggacagggatttagggaaaatcctagtggagtcactgcagccaggcagagttgtctgttacatgcagataacaagtcacgctgttggggttaattagaaaaagaggaaacaaagttgagaaaagaagagggaggcagagcagacggcagaggacaggaattttcagtgcagcgttgggaaaggttgtggaagctgaggctgacgcagacctagggcgttaaagctgtatttacagctggaccttctgattcctggggaggaggggaggctggatcgtgggtaagagagactggcagggccagtggaggatactctcccactggagttgtccagtgggagttgtctggagttgtcctgggcagaggctgcctgttgacagaggctcagcacagccatgcttaagataagctagctaagcaggtacgaggaaaaataatttacctgaagttctttctggccgggcgcagtggctcacgcctgtaatcccaacactttgggaggccgaggcgggtggatcacctgaggtcgggagttcaagaccagcctgaccaacatggagaaaccctgtctctactaaaaatacaaaattagttgggtgtggtggcgcgtgcctgtaatcccagctactcgggaggctgaggcaggagaatcacttgaacccaggaggtggaggttgtggtgagccgaggttgcgccattgcactccagcctgggcaacaagagcgaaactccatccccccccaaaaaagaaattataataaaataaagttttttctgtattaaacatcttgtgtttaaaagtctacagtgagtcaaggatgttgaatggccaaagatcataaatctctccctctttaaatgagctgtgggctgggcacagtggcttatgcctgtaatcccaacactttgggaggctgaggggcatggatcgcttgagcctagtagttcgagaccagcctgggcaacatggcaaaactctgtctttacaaaaaatttaaaaaaaaattagccgggcatggtggcatgtgcctatggtctcagctacttgggagactgaggtgggaggatcacatgggctgaggaggttgaggctgcagtgagctgtgatcacactactgcactccagcctgagtgacagagtgagatcctcaataataagcagtcttcagtgtttcattttacccaggctaaatgtatttgtagtatacatatatgtttatattttgatagattcatgtgagtaaaagatatacaataaaaattgacattaccgaaggggagtgggattagatgtgagagggtggattagtaaattgttttacacacctctttaccattggacttgttacaataagcctataactatttttaactccataaaatacattgttttataagagctgtcaaatttcacttgctcagtcccctgattctcattttcttataaaatctcaggttcctcaaatatgaattcttctgccatgagaaattagcaacatagtcttaaagtctggggaaagattatagtcagatccacatagataggacaacgttccaagtcgggagaatgttcatatgagaattgaatagaaggccaaatttttaggctaagaatatgatcagaggacacttccagtggagagagtcagcgtgaagagttgaggtgcatggctgttgtgcatctgagagcgtgtacgcgggcgtgagagcgatttagatccctgtgtgttgaattcgagacccacccagacagcctccagtgtcttctcagtgactgtgcccaagatttctgtccatctgtggacatgttttaatgacagcaattagtggtaatgatggctattaaatacttaatgacatttctgtgttctgaggcttcttcatacaagaattcacttactggccgggcaccgtggctcacacctgtaatcccagcactttgggaggctgaggtgggcagatcaagaggtcaagagattgagatcaccctggctaacatggtgaaaccccatctctactaaaaatacaaaatagctgggtgtggtggaacgtgcctgtagtcccaactactcgggaggctgaggcaggagaatcacttgaacctgggaggcggaggctgcagtgagccaagatcatgccactgcactccagcctgggtgacacagagagagactctgtctcaaaaaaaaaagaattcacttactttccacagaagcaggcactgttatgatccacagttcataaagaaggaatctgagacatggaaagtcgacctttcccaagcttgtaagtggaacagtattctgactccagatcctaaatggtaaaccactactctctgctgcctcgcagcctggagattttctgtaagagaggggctaaaataaaaaagcccacctcatattgatcacattcttagtaatccttgaatacgtttatattgtgtcattcatgaatgtcttttccctctggccagattatggtatttaggtcaggagccattttttcttgtttattttgtattcttacattgcccagatatgctcgataaatggtttttgaatgaattaaccaaactgtttctctaattcactatgcttttaactgtctaaggaaaagacaaccgtggggtccctcgctgcatgcctgggaacctctctgaacacggaatcaacttcctttctttgattttagagccagatgtgatgtttgaagaatgtaatctatttgctctcaaacatggagagcatagagctagaactccaacaattagaagttaatctgagatgtcctacaatacatgattttaaaataaaatccaccagtgtcagtctggtgcagtgactcatgcctgtaatcccagcactctgggaacctggggcgggcggatcccttgagcccaggagttcaagaccagcctgggcaatgtggcaaaaccccatctctacaaaacatactcaaacactaagcaggcatggtggcgtctgcctgtagtcccaggtacttgggagtctgacgtgggaggatcacttgtgcccaggaggtcgaggctgcagtgagccatgcctgggtgccagagtggtaccctgtttctctgcccaccctcccccatcccccccaaaaaaatccaccactctttcattctgaacaaccagagatgtttggaaaggacacaggaaataatacctggtgaatagttactctcgagcacttgctaggtgcgctgcagatcttcgtaaatttaatcctcaaaacagttactcaagacctgtattagcttgattttagagttgacatctgtctgagaaggaggtaacttggtcagaaggtgccatctcgttgggatgtcacagtcgggcctgttggcttcagagacttgggctttcatgctctgctgctgccaggacgggggccacatcgccctgtctcccgatttctcccatggctctccaggacttggccaccttcagcatcgtgtgttctgtacacagcacagcatgagggtgccagcagtcctccttggctcagcgtctaggatgtgtcagaactgtaaaccccaagattcttaggcaacccccctaccagcgctcatttctgctacttcagaccagaaaccttcgcgggcgggggtgggggcgggggcggcgggggtttcagttgctttctgcttcagttttcttggccgacggtctacctcacagtatcacagtcatctttactttcgtttactctgcctttctgtattttagtttctgaatttctgtcccataaagccagcatttaggcattttgaattttgagtttcttcagtgaattcataatagtaaaaatatttaagaaaacctgtaaaggcaagattgttgttgaagcccctcacattagaacacttcccaggtgctccaacctgggggggactgaggacttacatgggaagtcagagctccccatcttttttccccaaaggtcattcattctgacagcatgacttcaacttgatatgagcaaagagcatttcagataggaggagaaaaaggaagagggttgggcaccgtcgtgaaatggtacacttcctcaccgcggtgcttatctacataattgtgtttttataacatttcctttacttttctgtaagctgatgctgccctaattatagatttttaagagaacacttcattgtaccccaaattatacagtgctttaaaaaggtactttcttaccggtttaccaaataccttataaattcgtaattacataaaacaattcgagatacagaatagaaacagcctgtactgttaacaggtgttggtattgttatataattgagtacatggctttcaaagatctataatatttttcttgagtaaaaagaaaaaaatgactcattatagtcgtaatgtgtcacagagactcctgatcaaacagaatgcacatgttctattttgtgcattctgtacagttcattgtaaatggacttgcctttgtggaagtgaaagtgccacttattccagcaaattgcctttgtggcatatgcacctacttgttagacagcttgggggcacttgggccaggcagaggctgggccccctttatcatgggcacacctgcacacatggcactatggcgccacactccaggtaggctgctgtcattaacagacttgctccttgggaaacccactgaggacttctcagtgccctcctgcccatcagagaccacctcggaattcttagaagactaggaatggggcagcttcctagacgctagctcttttcccgccacatcagttttaggcctctcttatgatacaagtgattcagattacaaggtaacctcagtgcaacacaagggaagaaataaatcctctctgttattgagtgctgggtctagtgtttaattttctttcttttcttttctttttcttgagacagagtctcgcactgtggcctgggctggagtgcagtggcgcgatctcggctccctgcaacctccacctcccaggttcaagcgattcttctgcctcagcctcccgagcagctaggattacaagcgcccaccaccacgcctggctaattttttggatttttagtagagacggggtttcactatgtaggccaggctgttcttgaactcctgacctcatgatcctccagccttggcctcccaaagtgctgggattataggtgtgagccaccgcacccagcctagtgtttaattttcaatttaatttttggcactatttttttttaagttgctcatcttaggacagtataactggaatgagccttgtgtttccagttacaaaaacaagacagaacaaaggatgaggctagatttttgtattattgacaaccccatattcttccctccagaggagagatcatctttcggaagcaagcccgagatacacacagtcttacccattccttcaatgctgttgatgattagccttaagatggttcttttctctaaggaaaccctccccatttttgcaggatgtttgaaaaatgagttgctgaatgggcttcagatattcttattcttctgttttgttgggattttcttcccactcctatttgtgttaatttttccctcgaaaaatgagattgctgctcactgccgttgagcctccttgtggcacattcattggtccagtaaacgacttaactccaagaaccacctaccagtaacacaacaaaaccttgagtacagattgattcataaatggcagcggacgagtgttgaaagtgacgcattatgtcgctgcaatgtattgacattatcaattgtgtgtcactaaacagccaggctaactggatgatttactttgtgtttaactgcctttttcagttggagcaaatgttgaggaactgggatgcaatgtcagaaaccatatattttcttctgttaacaccagcttcactgaggcgtgttggttttggctgcaggctgtaaggctctagtgtaaaaaggtctaaacaagtgattaatgcccaggaggcagggctttacactgtctccacatcttttctcctttctatttgtgttgccttaatgcttggggtggggggttcaggctatttattgtgctgacgttggtttccatcctgagagtccttgatgtttctttgtggattttgtttgtttttaatattatttagcataataacctaaaccgtaaacgcttgcagttgcgatccaggtgtccttagttcagcagtcagacgtataataagggccactctgtacagtgaaaggtgacagctgtggcccccaaaaaagcagctctggactttcccctcccaagtttcagtcctggtaacttgaactagacttgctagtttcttgaaacattgttttattttcttgcaagttagtgtggtgttcatatttcacaacgctgaaagatacagtgtttctcaaatgtgcacttgccagtagacggatatgttaactgttaccgtgacgctgagaactggagctgctaactgaccctatgcgtttgttctctgcgtaaaatgttgtaacagtgctaattactaagcagctgaatttgtgagaaggtccacagcactaatctgcgcctcagtgttgccttgctagtgagaaaacgtgagcatgtactcaggacacatgtacttgatgatgaacttccaggggcacgtttatctgtggatcacggacggtttgacttgtgggacgtaacatttgatttctatatgtgcgcttttgagacactcgtttttaccctattaagagttgttgagtgcagaacaagacattttaaaagggaagagtaacattcagagattttaaaacggaagcttttaaattactacttgcttctgtttattttttattttttgctagttttagaaaaacaaggaagaatatctcaagttggaatagtcagatttcagtgtttgggtgatggtgttaaaatcgttgttttaatggtagatgaaaatgattctgttctgttggattcacatcctgaataaatgtttctacacaattagagtctataacagactaagccagcatagtggtggtgtgggttttttgttttgtgttttttttgttttgttttgttttgttttgttttgttttgtttttgtctaaaagaacaacttcaagccttgggaaagaatttgtttttgccctgtggatgggtcagaaacatctgcttcaggtatagtttacaagcgttatttattaacccatgagccgaaaacccagatgaggagctctgactattgaaaactacacattccatgtttttataaatgtatattaagatgaattccacatacctattatttggatttctggcagccggaacttctacaaggaatttgtgtttttaaaaaggaatgtaaaattaatttttcttgtatcagagttttgctgtatatgaagaaatcctgctcatgggcagaaagcaaaggtttcaaaggaacctcatctccatatggttttactcgataatcctttatccaccatcttcagctctcattcctttgctttctcgcctgtggctacatttctatctctgcatcaattagcacagtgatttatacaacaagcaagcagtttagaggtaatggtacacaattaacatctcattccaccataaagggtatgctaaataccccagtcattgctttctctgcctggaattgaaataagtgtttgtcctaattcatatgctatctgatgtgaagtgggcctgctttgtaccgcactacaccattaatctaattatagatagctgcaaatgaagtgctgtctgagctgggagattgaagaaaatagccttttgtcatttagcatgactctgtgaagcaagatcacactttacagggcaatactacaaaatggaaatctcaataatattgctgcctgttgcatcttttctaattacaacaatattgtaaacacaactgggcgctgatataaatagagctgtagatatgctgtcatgtgggttgtaggagaaagtcctccgagtgctgttggattaaatgatgcatcctgattgacagctaccttgagactgcactgatggagttgtcacagcattatgctaacaggctgctccagcgactgcagctgtaggaggctgtggttcgccctgcgccttagctgctgcctgtccatgtccgctcctttgcctgggctgcacctccaaaggaaggacggccgtaggcttcaattctgtgtattgtcactgttgtgtcttggagatttgtggtggtggtggtgtagctcagatatcaggcgattgggccctgtgcagaagtagagggaaattattttgtatggctcctaaccttgctctgcttttcctcaagtgataattgtgtaccctacaaagaatttaggagagtagaacgtggttgaatttcaagtctcattccactgaactgttttaactcatatctagtttttctctgcttttcagccacgccagtgtttttaaagatgcatcatttttgcatttcgcgctttccatcactttaaaaacactgacactgtttctccagctctgagttaggacagtagacctttaggggaatatttgagtgttgctctcactgccacgctgcggaaatgaagacagagcttaatgttggagacctttggggccagaaggtgtaaaaccttgactaggaagagagcctaatctttgaagaagtgtctgcctccttacttagtgaggggtgcatggacagtatttggccagtgcttcaagatagctgatgcacagtgatttacagtcaaagatagcacctgcccttgagttggtattgactgagatggccaacagttgaggacatgaaagaacattaacagtcagtcaactgtacgtgtcctaattgttactggaagaatgacttataaatggaaactggaagtgagcccacttgaagaggaacggaggttgacagtggcactggaggctttgaaatcacagctgaaaactgtacagcaaactgcaagcgctcacctcgggagcagccgcagacctcgggatcattgcaacatttagcgcatggggtctgcagaattacattactgctacttctacaggctgtggaaaaaagtgggtggatttaatgctgtaaggaggtgcatgtactgtacaaatacagaagcctccagggtggtattctgtgtatccgtgaaagtggagtgtgtctcaaagtgggtcattctttgctgtctttggggtgctgatttctggggtgcaggcatacatgcccagttgcaggatgcttttcttaatgaggtccagtgataacatccctctctcacccagactgtgactagccgccgcctcctgctgcagcaaccactctcagcccccaggctttcaataggtccacggaagagctgcgtgtcagttttaaaaacaatcccactggtgtttcttgtcattgtcctgctcttgtggccttcctcctgaccctttcatgtcagctgtgattccttttctttctttcttttaatcttttgggagaaattttcttgttagacatgatttcacactgtagaggccataaaattaatttgcttagagacccgggttcgggtcacctttccgtcattcagtccttagataacacctcattccctcccattactgtcgtgtgtgggttgaggagtcccaccaggccaagccagagagcaactgttctgttctcacttacgtggtgagctgtttttcaagaacattttttttcatttggctgtgtggtctggagaacaccttcctaagccagcggagtgaagttccacgcactgaccagccccgagctcactggagcgagtcatcttccggctccatggcagcccagccccacccacaggcagctgcctgtcacccacgctggcatgttccctcatcctacccaggcagcgggaaaacctggctgcttctgggatcctactactctgtcctgtccacaagccttcagagtcttggattcctaccctcaaacatcaactttgtgatttatcttcttgaaaacaaccacaaaaacttaaaatcaaaactctctaagggagtttcgcacaacccttgaggaatagttaaatgcccacggtgaaaccgagcttgtaccccacggtccaggtaggggcacattcctgaagtctcacaaagcattggctctctgtgcccccaaagaatccagagatgctagtaaatagcagttttgatcagaagcttggaaggccctggtgtacattcttaaatgacttcttttctggggcatcaaaaagcttttacggttctcaccaggcagttcattctgatgggcccctacgctgcaccctgcttgggccccatcccggcacgcgccccgtgcagcacagcacaggccagctgagaggctgttttaagaaggcgtgtttgtgtggtacactcacgggctcaggacaacatcaaaggtaatcttaaaaagagaatctctctctgtcttctctttttatattcagaaaggtcatttctaaaccaactatttgcaccaaggcctctctggaggagtttaccccgttgttattttttacttgctattacaataagtcacttatcccccaaacagatttaagaacaataaacaaatacaaaaggaaaaggaacatctcatcagtaacaaagactgcatctaaaggcattgagtttgtgattcttttacatctctttccaagcaaagcaggagtcctacagagaaaggaatctgaaagatgaaaattataaaaatagtaaaaggatccagtgttcgtcagaatcttgtaatttctggggagaaatgaagctaaatacagtcttagcgcttcgttcatatgcaggctgatctgtgatataactaaacttagtttttggagtatatccactgtggggaaatgtggtaaatcatattctcagcgaatgaagatacttttcctgaatttaggcttcatattttgaagtcgaattctgcaaaacaagaaaaaaatagatctgtgtgctacactgaaaactgaacaaggcacgtcgtaagtcagtcacacagaaggcgcagctcagggcgataccaactagaaaagtaacttttttgttgactctgatgcctctagtgatgttggattttttcccccattgcagacagcacagataggaaaactgtgcaatttggtccaattatagtcctctctgtccctccacaccttcccccattgatttaatgaaggacttggaggtacaattcactgataaatagtccctctgcccagaatgtttattagactgacagcagcgtgcactctcctcgctttttccctcaccacttatgactcagatgaattttaataggagcaaaaagcttttatttgcactgtaatttcacttaaggaacatatccttcagaaactggcagacgcttctatgtcttgattgcaaaacacacactcaggagtaaagaaacatgcaaaagatgttattattcaacctgtcacagtgtcgcaaatccacttggaacttaggccatcaaagctctgcccccacccttttcagtaggccctgtgaagaggcacttagagattcccgccgtccccatgcagaattaaagggggaattatattttgtttttgcatccctgccatcatgatgcccacaggaggctttgagttacagcaggttttttgaatgaaatggagctgtctcactgctgcttctttcttacccaagagaaatcagacctggtagggatccagaaccttcgggtggtggttccaatttcaccaagagacacttcctcaaaccattttatcttttttctgtttggatagaccaaattgtggctcatagatttattcacggagaggataggaattctcttttttgaaatgttctgcttcactgaactgccctaaatatgcccgattgtttgagagccacctacagaaggtgccatgaatatacttgtctgtgcgtattttccatcagtgtttataacatcttgatgttattgtctctcagtgcagaaggctttctcattatcttgcatcttttcctaaccatcttgttacatcagaaagactacatagtgcctttaagaaaagccaacgttttcagtcatgaatataacattttctgtcactgaaaaaatggaattttaaatactattttgcccaaaatgaacactgaaccccattgtcttaacttactgatacgtagtgcagccgctcttggagggctgtgggaagctgcaacagccatctgctgccatctactggcgcctgtccacatgtcacctcctccatcccctgggtctgcccagctcatgggattttccttgatagggataagtttgtaggtggtgaagggaatacaagtaaaattctcagttttctttataacgttttgagatgtttttcttaaagatacaggatgatacttatcaatgattaattttaataactggaatagcccttatttcaagaactttctgaaatagctcaatatatgacagaaacaaatatattttgatgtgtgcagcaattgagaaccatttgaatttaaggctcttactgtaatttgaatttaaaagctaaaaattgatttagaatgaatgctacttttgaggaaaatttcatttaaactcatttatggtttggttttgtttttcccttaagtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtaagggctgtgtgtgtctctctgcaggacatgctggtctccaacttccccttccaaagcgacggctaacggcacagcacgattcggctctttgcagttcttacttaaccgaccccccctaaacagcaaaatcgattgcgtgtgttgtcgacctgtttcacgtttgcattacgttggtgccaggaccctcagcgcttcccctcccaaatgatctgggagtggagcagaaagaaggccagatgcattccatcattttgcaaatgcagtgttttgggaagtactttccttaaaagtgctgcttactctctagtatgctgtgctcaaagcatccattgaagtcatgccagggaataatactccgatgaggaactttttgcatgattcctggaacaaatgtctaattgggaagaagagttgaggaaaggttaattctgcaatctgtacagtaccagagcacttccattacttggtaaataaaatgtagcatcacagtttgaagtttttcatcttgatcttgtgacattaaagcacaaatcaaagctatattatttcctcgagataacttacatggatgaattgataggatgcacacattttcttagaacatggatagaaatctctactgatgagcagcaaaagtgaaaagaaaacaatttaggaggcaaccagatttccaggtacacttaaatacttgcatttttattcatgtgcaggaaaatagcatccggacatgactgtctctcatggatgaggtggtgattccgttttgtatctcaggtcactgggacttacattttagtgcctcctgatttctcaatagtacagataaaatatctgcttaacattgaggaaaaaatcaggtagttggcattggcttctagaaaagtatttgcaataaatgtgaatattaagaaaacatgatcagttttagttgtttgaatgaccagccctgaaactaatatgcgaagttagaaaaccgacttaacagctgctttacctggtgatacagaaatagaactgtccactttttcagaaaggcataaaagaggctacgtggctgtgaattgttgtttgctgtgaaagcattgatactcctggaagaaagccctctttaagactgtctaatgcccacgtgttaaggatttgggagaggccataagaaaaattacgtgtgtgtgtgtgtgtgtgtgtgtaatgtgtgtaaaattcaggggaggacatcttccttctccagagttagggtcgtaagaggatagtctcgtggccttgacattaagaatcgttcacttgcacgtgacattatcagagctgtcagtggaatcttctagtgactagatatgtaggttcgtaaacaatataagggttttgttttgtttttttcatttttcttaagttttttttctggaaggcatctatctagtctgtatactgccagcctgagctttccactcctaattgtgtggctttaattataaaatcgtgtgtgtgtgtgtgtgtgtgtgtgtgtgtgtgtgtgtgtgtgtttcaagtaagtgttttccttaaatccttttctaacacctgaatccaaaccggagtggagggagggcgggcagggatgagggagaccactcctgcctcaagcctggagggcaagagggtgagactgcagccctggcccctcacacggccctcaaggaggttgctcagaggcagtaaacggggcgctcccaaggccagatcagcgcagccttctggtttctttaacagctgctggctcctgatctgactttcccacataccgaaagggtttggcctttgtacgttccatttcctggttaataattgaatgtagaaaagcaaggcatttcgtaaatgggaacaatgtgatatcagtccttggttcattgatgtagctcagatattaaaaacacccaccaataattaaatgtgtgtactcattaagaatggtttgagaactgttaaaaatatgttacggcagagcaacggggcctatattttatgcattcctttaaattcagagtacctggggggcacgcgtagtgaacaggctcaggacctcgggatctgtcagctccctcctaagttctgtttgcgggggctgctcaggtggggcgtatacttgcttttatttgtcttttttggtacttgcagaacttcctttcatattctgtgccattgtgttttgatgaaacagccttttctcttgaattactgcttgtgaaaaatgtcccaaaccactaataccgaaacccaatgcagcctgagaagtttcatcgtcggctcttagcgcaacttctatagttaaattctgcttagtgtaattaaaacacaagaagcttccttggaccagaggcacgtcacttacttgaggccattgtgaggaaacactacctgtcacgttgaaattttgcggttttaagtgattttaacaccgcggggcgtgttgtgttttcctccgcactaacaatagccgggcgaggttccccttttatgggtgggaagataatggagtcagtctccttggtgtattttcaaggaaaataaggaccctaaaacaactaagggccttacaagtattctgtttttctttgaaatgttactttttatcgtttaaattccagtaatctatcatgtttctgtttagcttagctgaagtaaaacttgaccaatcgtagaatggtgggcctggcaataagttctaaaaaaagtgtcacataaatcgtaatgaacaaatctgttttgtgaagtaaacaatttgaacacagtttaaaaacctcaggaagaagagatgtggggtggccgttgagaagtagtgaatccgctcggggcgcttggtgtggcagggccttgtgcactgattcatttgaaacactcagcctgccctaaacacagaagctgtgttttatttgaagggcttctgtagggttcacacagcaaaagttcctaataactttttcagtgtctgttatatactatttaacattaaatgtggcaggtcacattttaaatgattgtgtaatagtttttccgaacacgtggagagaggatgttaatacacagtaaaatgcaggtaagcaaacaaatcaataagaaagtacagtggattattaaggtccagaatcagtaatataatttaggaaacaactgatagaataaattttagtgcctttttatatgccttctgaaaatgtttctgcagtaactcatttcagtttgaaaactcgttttcttagactcgtaacactattgtaaactgggagcacttctgtaatcaaagttagcatgactcagctgtttcaaacttctacctttatgatactcttgaacagaaatgttagaaatatatatattttcagaataacggtagaatacatttttccacatgtcaaattagacttatagctgctgaatttattgcataattttcactttgactttgaagtcaaataaagtcatgatgagcacattcgctttgttagccttttgatatcagaaacaaaaccaccccataagatagtcacccaaggaggcattttaatattgcatttagttaagattctttcaagtaatgttcgtattctgcagtcatcacagatttgcatcagaaatactcatttaatacaccaaacaaatgagaaacaaaccataagctgctatatactcatctgcatttctttctttcttaacaattagtgaaaccaggtgaaagaatagtttgaaattaagtacctgttgctgctttttcttgcgaattagcccattcgatattagacttcgggatattttggtggggctaagatgaaaagatccacctcgtgatggaattgaccttcagcaggggacagtgaggtgtctgcggttgttcctcttgtgaacaacgccttaaaggcgagaaacagcctactgtacagtgtgccagggaaagcatcacatcggtgggcgtcggtggcaacaccacttacacttcaccctgattttgtttcctccttgcacgtgctcctttgacagggcaggctcccaagcaggtgtgcagtcagggccacaagacacaggcaccccatcccatctcagagtctgacgtcccctcctcccctttgtctctaagcctcatgtaactgagcttatagccgaccatacagaactggcaaacttggtgagatacctttattttttatttcttaaacaagattttaaaatttcataagctctcacgtatcctaacgagaaggcagggctgggccctcccgacgggtgtttgcctggcatcgcgcttgtgtgcctcatgcagcccaggctcgctcactgcatctttccctggcagaggggctagcctggctgcttcatagactttccagtttctggataccttgatttacaatcacaaaataattgcagtaattaaatttatatgttttatagcaatagttattcaagcagtttatttgacaagatgccagttttcacccaaacctcagattgtatctcacagcatgtacacagagatccatgcatttgttaacattttaagactttaaaattatgaaatactacaaacatgcagaaagttacagagaagaatccaacaagcactcctgtgccctttgttcaccatttccatatgtgtttcaaattttatttaacaatgagacattacatataacatgaacttcccctgtggcaagctcctccatctcattcctgtcctgtcttcttcagaggtaacgactacccctggatttggccttttaatcttttccagataacatttatttttaaatgttaagagttggtttttggccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactccagcctgggcgacagagcgagactccgtctcaaaaaaaaaaaaaaaaaaaaaaaagagttggtttttgttggaggtaacaaatatctattagtagataagaggaggcagaaaaagatgaggaggtaaaaaaatatctattagtactgggaatttttacagttgaatatactcaatgataattataaaataaaaaatatttatgtggatcagtatattaaatattataggagagtcttctccaagcttggcgtttgatttttcaggagtgatctgcttgggagtagaaggtgttttctttgttttcaacatttttataagtgaccattctcagccttaccaagatgtaaactatctttttctcttttaataaaaataaaagtttacaaaaaatcatcctttcacggagcgctttcaggcagcatgctttacgaaggtagagggtccaggctaatttccaaaggtattgtgaatgacatcagtttccactagttctctttgtaactgcaggctttggctctgattttgagctaacttagagggcagcagggagtcatatttttcttcattttaaggaattttaaaagaaactggacttgttttatatcggccacaagtctgtactcttacccttagccccttgggtgctgcccagttctggggagccccacttgagagacaaggggagcaccaggcagacggcacgtgtgcctgaagtcccgagccggcagcggggctggacgggtggcccctgggttcccgcgccctccagagtgaggccgctcgtgcatgggccattaaaggagtcttcagccggagaaagggctgggcggcgtctcctgcccgcctggtctgtctttgtaatttgatgatggttccatccttgctcaaatactgcagtctcccgtggcctcctccccgtctcgctttacatgaagatgttgggatgtgaatacacgtttcttcttcaggaaatatcaggggatatttaccagcctatcttaccggctcagaggaagttgctattaatataatcagatgcgagcaggcagtgccttttcactcaatctgagatgcctttttttgtgactgttaactgaacctttcttcagatctaagggccttaaaatgtgtggcattcaggcacctgtgttccaagcagaccagcctttaacaatgaaatggtgggattttcacttttgtggcgtagacaccagggctgatattgatccgtgtttttccggtggtccggcgttgcagaagtggaaactgcagcgggctggtaagccctccgagccttctgtctaatttggcagaaaaacacagaatgtaggacaacaaaagaagcctcctttttccataaaaattcttcctcccacccacccttcttccccaaaaaggggacttaatttttcagctgcacgcagtgatttggtgctcactcttgcatcgaaacagttgcggtctgaacaggcaggaaacagttttcttttaattgccgaaatcattcggaagtgcttcatgccctgcttctgtacagcagatgctgtgcattaattggcctgcgtagaagtgacccagggttccttgcagcgggcccaattttaggcagagggtttaaatagcttatttattattttgtataatctggcgtacattgtgtgctcctgcacgtgtcgtatttcatggtctgcagtttctaatgtcatgtgggtttcaaaacctgtgtttctctggtaatgtactagcagcaggtaagctcaaaataccatccatcaggagctaattttttatccagatactccaatgactgatgaacctgtcttttgtatgaatgtttagcacagtggaaagccatatgccactggcaccgtttcctctgcattccttacagttgctagagagtgggcttcctggggggcggggcggctcgatgctgtgaacgtcccctggcctctatttcaacgataacacctttaaaacagccctgggtttgggcaacaaaaagaggatgggctgtcttaaaggagacctgactccctcgtcattttctttatcagaaatacgactgcacactcttaatagggaaccttgttttgttactccccgtctgttccaaacagacctcagcccattagaagggcctcccttgtgtgggagaccacagctgttactgtaaatctcatccactcactgtatcacccccattttgtggctctgaaggatgaaattgagaaatggaatactgtgcagtcatcctttacatctccaattttaggcctttgccatcattttcatgcttttattccaaatcaaataacattagtgagctacaccaccttctgatgaatatctggtcttgagcaccgctttcaagcctgtgcttgtgggggcttccttttatgtttggtggtcttttttcccccgttctcttctttttcttcctgcactttctttgagcgttcttcgtggtcatggcagtctgcagtttgaatgatcggcattgccaaatgtgtccctgtcttagcatgttttctgagagggggcatgtgcgggagaaggttctctgtcttttaatctttgtggaaggagtgaagagaacttggtagaaggatattgggggctttaatcagaaataagaagtggtttaaatcattagcacaacaaagcatactataagcttgaagataaaagtctctggggaaagagtcctctgaaaataaatggaacttgatagatttccatatcatttataacttcccttaattacacttggaagacttgccagtaaaactggaaaattggcagcctatatccattagagtcattttgccgaccatggcaagcagctggctttacgggatttgattcccatcactcacaattcatcatcagctggaggtgtctgcagctcttcagcacagagcaatgctgggtgacactcgggcccccacgacatgcgaaaatctgctgagtaaatgggccgaggtttctctcaagccttgtttggggcaaggccgactcttgcttaatgagtgccgctctgataatcggatgcgaacgtgaaccttgacctcgtgtcaaaggagaggacgcaataagctggatgaaagatacaggattcaggccttcaaactttacaccaattagacagggagcggggagatacatcaggcccactaggttcatcaaaaagacttgtgaggcttgtgaccattttgtaagcccaacattggagacatcctgtcacaatcattaagtctttatcagatgattcacaaaagtgttggagaaacgtgcgcacacatcctgcaggaacgggccccgcacatgggggcgtctgatggagacggaatggtggagggccctctctgcgcacccaattaatgcttggcctcccagccaccctgggcaatccggaaggtgttgcttccattgggcccactgcccagctccctggtgtaccctacatgtactctacggtgtgcgacacattctgcaggagtcagcgctgctgggagtaaggctccaaagtcctaaggtgagagcccctgctcccgagggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgtgtgttggggtagaacatgtttctgttgagcaagatgtatctcactattttgtaaggcatgaaggaagtttttaaacaccatctcttagggatgaattagggaaaacggtctacaaaacagatggtgcaaaattaatagagaagtgtgctacttagtttttcatttacagctaaataatctaggctgggcacagtggcacacatctgtaaccccagcactttgggaggccaaggtgggcggatcacttgaggtcaggagtttgagaccagcctggccaatgtggtaataccctatctgtactaaaaatacaaaaattagctgggcgtggtggtgcacacctgtattcccagctactcaggaggctgaggcagaagaatcgcttgaacttgggaggtagaggttgcagtgagctgagattgtgccgctgcactccagcctgggcaacagaccgagattctgtctctaagatagatagatagattagatagattagattagattacataagatagatagatagataaaatagattagataggatagataggatagaccgagattctgtctctgatggagatggatagatagatagatagatagatagatagatagatagatagatagacagacagacaggcagataagatagataggatagagctaaataagtagactagtagacaccacgagaggaactagggaggggaaacaggaatgaaaggcggatggagcagggaggatctaattctatgattcagtgctgtgcttggatggggcagaagatgggatcgcttcagtggggacacgccttctttaaagtcctttgaattgaattgccggactctcacaatcagacagaaggactatttgaatttcaggcctccccacttttcctgattgtctcgggctaaatccgaggtttttttctgatgaacaactggggacccagcacttgcagttacctgtgcgttacctctttgcaaatcacccacattagaagcacagagccagccagaaagatggtcagtggcagccacagcagagccccttaagctcctgtccaccacccacttgctcccaggccctggcggggcccagagtagagctgtagccaggtcaggctggcctttgcccctagcgtgaccttgggaaatccccaggccgcatttcttcatatttgcagttgagttgctaacgcactcacttgaagatcctgtaaaacagaagcaggagctgcctgcctgtctggcccgcagattctgagcaaggggatgggaggggacgtgtggtggaagggcacacctactggcagagagggtaggggctgtgccacccatgtgaagccaatgtacttggcggggggacggggctctggccagtcctgggccctcagatgcctgcagaggaagggctgggtgggtgtttgggaggccggcatgcagtccccaggaagctcctccacctggagagagaacagtgcccagagcgggagagtggattcctcatttttggatggcatttctactatgttctgttgagtctcagatccacttcccagagagtccccggtcctgttgcctgagtgctcagtcctaggtcagagtcagtcgcagtgagtccagcttctaagaggacacggccaggcttccagggtcccctgtgtggagctggctggcaggtgtgctgcagtgaactggacctgctcctggattccctggtctttgcctgcctttgaagagagaaaaaaggctgtaaaatgccaactggagggagtgactgttctgacacccctgatgggggcctctgcattgtctctgcgctgcccctcccatccccctgcaaacagccctcgaggctgattcttcgctctccctggaatgcagatgccacgtgaaaatgaatcaaaaagggcagcgcgggcagcgcttccaggcccagctcctcagcgcggtgtctctcctccgtgccagcgccaaagccttggcatcgtctctcttcctatatttctatgccaggaagaagcagcccaccacctgaacagcagaggaaaagagtacatcggctcaggcgctccagagtgccagcaagacagcttgcgccacacgggggggccagagggggacttggagatcatctggggatttcaggaaagaacattctctaggcgcttctgaggcattggatgaatatggccacagtggtgtgaggggccaggagccccatgccaggacacccacccacaccacatagccattgccctaggaacctggacttgcccgtttcaaagactgggaggccaaagaaaaacctggccggctcaggacgctgacccatcggggcagagcgaagtgagcgcgcagcatggttttcagctgcagctcactcctgcagggaagcctcgcgcttaacgccagtgggcttaacccagctcagcctggctgcccctcaggatgaaaggcaagttctgaacgcagtctgagcaaaggcccgtgggcgctcccagtctcctagcatggaatgcatgtagctctggaagtcattcctgtgtctggagggttttccggaagctgccttgtgccttgttgtgggtactcgctgtgtcttgcagaggatgggacagtggtcctcgtggcgccagggccgagctgttcccagttccccgggactatagacagaaatatgtatatttggtggtggttttttttttttggtaacagctatactgagatgtaattcacatacaatttagccctttaacgtgtacgattcggtggtttcagtcaattcagagttgtgtagttgtcaccacaatcaattttggaacatttttatcactctcaaaagaaaccctgtacccttcagcagtgactccccttccctcttcaaccccaggcaacctcgagtctgtctgtagagatctgcctattctggacatttcaggtaagtggaaaacattccaatttccgaacacctctgttagtggcagagccagactcagagatccccagggtaggccccgccgccagggtccccacttctccagggtcagggattttttttttttccaacgaggactttatgagagagagaatggcttttctctactgttcctaaagatgagcttggaataggaaacattagagattgttgctgctgttcatagacacatattttggggcatttgacaaagaatttcttaatggcttcattcctaagtgttaatgcaaaattagaatgcttttaaaacttctgcccatttttgttttccaggtagcagaaggtcaagaaatttgtgtgattgaagccatgaaaatgcagaatagtatgacagctgggaaaactggcacggtgagtccctaagtccccatcagcccaggccggccctgtgatggaggaacgcccacctttgaatcgtgggtggtttggctggaaagggccacagaggcgccctctccccctcgcttctacagaggaggacgttaggattgggagcttttgccattctgccctgatgcatccctgcctcgtagagagcgtgccttccaaaaagtctgtgctttatgttcaggtagtcaaagaacaattgttcttcaccttaatgtctttctttcaaattaaggggtctttaatttttaatgtttacatctgtcttgaaggcagttagttatctgagacttaggtgacacagcagcaaatggttttacaaattgcaaaaattaatgtaactcttcaagacaatttctctacaaagggaacaattcagttgcagatcaagagaagccaaaaccccatgtacatgtgggacttaattatttagggagaaaaaaatattagtactgaaattcattcatagtgaaacttaagtgtatttttttcttgaagatagaaaagtccttttaagcagtaacttcattattcttcctgtgactaaaaagactgaaaagatgccgttagtaggtaaatgatccttttgtgagggccgttgtggtttggaagtgtctgcatgggagagcatgatgggaagcgcaaggctggccgtgttctgcatgtggccatgccttggggacatcaggtgcaaagagagatccatcagttcataaccaggtttgcatcagagagacacacaacctctgtctcatgctctgtcactgcagaaggcaatgaaatggattctcagagaaggggcagcggggatgtcatgcctggtcccggctgggagaacagaggcccaggtgtatgccaggggctcctgagcccagcccgccggtctggaggggtgtggacagttgcactgtgctggtatggtgtgaagagtagaatgacatgatttgtggcgtttttaaggaattctttctaaattacttctttaaaaagtgaacaagaaaatgttggtttctgttcatgtaaaaattttatctgttctttgggatttaacatttgtgctgccctagtatcacgacatccatccatgatgagaacttggcctaggtgtgggggaccgagaacgtgtgtccgccgcatgccaagggccctgtgcagcaggtctgaggtgctaatgcagaaatgaccttggcctcatcagttccctgaaggggcatggtgccatgtggtagtaggtttcctgtcctcgtggcctgggtctccctcggccctcctagttggagtcttcctgtgcattctgttcacctcaccccatccccaggcctctcagttccaacccagccaagaagagcagaagtggcccgaagcccccgtgcaaagtagcaggccctggttcctacctgcgaggccacttttcctcccagagaaaaaaagttcacaaaggaaacagatcctctactctggtcatcgctgcatcactaacactgcgtcctctagtagggctgctaaatggaggcaggagcattgtggaaagcagccttttcagtccaagcagcatctgcagtggccgatgagttctaatccatttttcattttcaggcccaagcaagagcctccaagaagtcaaatgactgtctcttccccacctcaagcccctccttgctaattttaagtcagaacacaaatttcggaaagcaaaacttgataaagattgactgaaaccggtaggacaaaaaggcacagttccacccacccatggtgctggaaagggcgaccgcacagccccacctgccaaggactccatttcccttcagaaaatggaggtcaggccagggaggtcctcctcttactcagcagctgatctgactgtcgtgtgttttgttcctttttttcttttacactaagtattccattaattctcagagaacatttccacaacctcaaaaccacagagagggaggctaggggttagaactcacctggcagtgaagagcctgcctagacctgagggtgccagagcgcaggccacagcgcaaatgctccggagagtagccctcaggccagccactgtgagggtgccgaggacagaggagacgggaaaggggaggggtgagccacggccacggccaccatggcgcctccctgttcaccagggtcccttcgatgggctccggtggggtggcttgtccctgtgctgctgagcttgcaggactgtgcatttttagaaatggattaggagcctgccgcctcttggttctggttactaattcttactctcccctccccctgcatttttcaaaattcaaggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtctaaatattagtttgccctttctttgaatgaagacaatgtacacataggcgacaggctctgccagtagactaccagcatttctttgtgatccttttaagagattgatataaatgtcagtcagttctctgccttgctttattaaattagcacttgccattttttcatctgattgccttactacttctagaagtgaggccctcactcctggtgctgattttcaaaacttcctaaggaccagagactgcaaatgcagattttggcaatccctttcctgctgtgtctctatgtgggtgtactgttggtggctgactcccctggaggtcaccctgaagcttcctggttggccgggggtgctgtctccactgtttttgtttgttttgaggatgagcgcgctgcctggtcccttccccattgcacaagccagggcagtcacaaggagcttgggctgcctcaccgccctcatcaagcacagggccgccacgagctcatcagctgagacccagcgtagcctttttgtgttttttgtgaagcaagtttccaattaagcaaaagaagctaaaaataatgatcatgtttttgtgccagatgcagttagcgatcacagtctgccattaagttgaagagtaagtgagctctcccaacagagaatgaggttactaaagatcacagcagctgcattttcatttggttctgaaatccttggaatacatttcagactttgctgggaagcagaagcaagagccgtgcaccgagttgaatcgatgctgacaattatcagatggaggtgggtagtaattggtacttcgtgccttgctaaaattattttaagtgctgtttgtatttggaagctaagcttctgtcaggcctgaagaacaaattactaatgcattggctcttctttgaaaggactcacccccaaatgctctcccttcagggggcagggacggggtctggctactgagatctgggctcagataaacttccacttgaagtccgggcgctcagctgtgtctaccagcaagtgggtgttcattattttgctagatcagaatgtaaagaaccttctaccaaataagtataccaaaaaacgtgggggtcaaacacagtaccaacacttttatatctgatttcccaaaacatcgacttcaaatttaaataatctttaatatttgctgtgaagcttgatctgaaaattaggaagaatggtgctatacgcactctgatatacagcatgcttgccctgtggatcttttctacaaattctacccagccgtgtaaaatcggctttctcaggggttacaggccagaatcagtatagtagggctgctaaaatctagcggcaacaccaagtctttacactgatcctaaatatttattattatcttgagctcaaagcagagccaacagcagaaacaacacgaggaggaagaagaattaggcataacacgagttctctaaatgtcatttaggggagttaaaatcctaaatttttcttaccaggtagaaagatgggagggaagcaccttgctattcgtatctcaacattatttgtaaaatcagctgccactgaaagattggttcctttccggcagattcattggaaagggccctgttcggcttccgccttcacccagcatgggctgggcgcatcttggagccccagggctctcaaacctaggcccaccctgcccgtcccccttatctgttctcccgggggttgtagcgcagcccgtgcg

SEQ ID NO: 13841 - DNA, 134008 bp, Human
  misc_feature (1)...(134008): n = A,T,C or G
aaagcccagggcttggtgctgaggccaacagagacgcaggagtctctcccgggcggcccagctggctgctgggtgctgagtcctggacgcccctgctgaagggcacagggcagctgtttgattcaggattgggatagggttggaggtggtggcctgacacttcccaagccctggggttttactggagccacccacctggcctctagattggccggaaactggcttccactggaggcaggactgtaggggtaggggcgtggggcaggaagaggtcaaaggtgaagtgatggccgactcccactctggagttcctggtggtcagacttttggactccaggtcaggcagcaggcgtggatgtcagcttggggcgaccccagggtgatgggtgtgtgacccccctccattccttactttcctaatctgccatgatgctgtgggctgtggcgaagaccagccaggttggttcctgtggggtgcttgggcactgggggcaggtgctgggtggccagttccagcaggaaggggtgggtagctggggcgtctgtcccccaggcccaggtggcccagggtgactgggtgaggcctgtggggcaggtgggccctgggctgctgtgtcagggccgcggctgtggacggatcctgtgttctgtttgcactggagttcttgtctgggacgagaactttgtttcttgaaacttgtctgatgaattcagataaccttgatggggagccagcagtgtcagcgaagagcagagcctgtatctctggttgggacatctcacaccccttcaggcttctttttataggccctgtgctcttgccccgcgctcttgtgggtgtcagaaagccgtagatttttctgaaaattcagtgtgttcacaagggtgtgattcccgctctgagtttcaggaaacaccagctgggccctgtggtggtccctcccctccacgcagggtgagaccagctcttgctcagtgcaggaggtgaggggggacctcgggtccctatcagcagggaagtgccagccttcaaagggtgcctgggagtccgtgagcttccccagcccctggagttcaggtcctgtctggggctgaaaagataaaacacactgactctgtgtgactcggtttaaaaaaaaaaaaaatctgccggggcttctgccgtggctgcagcaacggacccagtgcccactccggggtctaaagagtggcctttcattatggaattatttaatccccgccacttcaccgctggcaccgtcgaggtctgggggcaggtctgactggtttcctttaccttagtgaagccggcggcctgcaccgacccggctcgcgcccatcccggggtcacccacatttgggtgaacttgaacgagtgcccgaccaggtaacgttgccggacctcccacaagagggcactttcttttctcccattttgtcctcattctttccagccaggtaggtcgcgcttttttctctgtgcaaggaagttgatggtggtcatttttttttttttttttttaatacggagtctctctctgtcgcccaggctggactgcagtggcgcgatctcggctcgctgcaagctccgcctcccgggttcacgccattctcttgcctcagcctcccgagtagctgggactacaggcgcccgccaccgcgcctggctaattttttgtatttttagtagagacggggtttcaccgtgttagccaggatggtctcgatctcctgacctcgtgatccacccgcctcggcctcccaaagtgctgggatgacaggtgtcaggcactgtgcttggcaatggtggccattttttaaactatggttatggttaatggttctattttgtgtgtgggggggggagggggtggggctgtcatattgtctttggggaaagtttcatttatctaatcaatgatttggttagttggtaatcattttttaatttgattcaaatatgccccacggtaacagatgcccatgtcccctctgccccagggacatcttcatcaccagcgtggacgccgccacgaccttcgaggagctctgtgaggaagtgagagacatgtgtcgtctgcaccagcagcacccgctcaccctcaagtgggtggacagcgaaggtagcccttgtcccatgttggccagaatcctcagcctcaggggacttcgccagggcagcctctgtgtgcggagtgtgctcagccaattctgtggggagacttaaagctgtggaattaaacttgttggcgccaacttttccccagtggggatggtgggaaagaggttggccacagatgcttatcaaggacctgggcccagatgcccctaggaagggctctggtcttgaactgcctgcagggggtctccctgccccaccctgggcaggtcctcacctcttcctctgacctcctttctcatgtcctggcctttttcggtaggtgcttctgaaaggatgggctcttcatattctagggaccacggggagggcacaagcagccagggcctgccgtgtccacctcctgtctcttagacacatcctgaaaaacaaggggattgggagacgtccagagagacccctttctcccagggactggcgggcagctcttggccaaggacacggccgtgcgggtggagcctgatagcgcccccgttgggttgggtacagccctgcagggcctgggttctgtacacctccatgtccctttccagccatagagggcaaggagctctccctccgcccaggactgacctccggagagtgtcctcagccccgctcactgcttagccctccaagtggtgcccagggctgcaggtgtactgacttcccttccggggtggctctgacgctgcaccgggggccaggtgactccctagtgtggacggccgtccttggacctcccgaccctgccaggaggtggccagtctgagcatcgggactttgccccccaccagacccttgtctggtgtgctgagcgggctcgtcacagccccctttgcctcgggccttcggcgacgtcagcaccgtctcctgccccacccaggtgacccttgcacggtgtcctcccagatggagctggaagaggctttccgcctggcccgtcagtgcagggacgaaggcctcatcattcatggttagtggcggggtctgtggtgggcagctctggggggctgttcctggctgtgggtgtctgccgactagctgggggatttaaaatggtttaaaatcctatgatgccagagaatttagggatgtctaatataatgccatttgggtttttttctttgactttttttttttttttttgagacggagtcttgctctgttgcccaggctggagtgcagtggcacaatctcagctcactgcaagctccgcctcccgggttcatgccattctcctgcctcagcctcccgagtagctgggactacaggcgcccgccaccacgcccggctaattttttgtattttttgtagagacggggtttcaccgtgttagccaggatggtctcagtctcctgacctcgtgatctgcctgcctcagcctcccaaagtgctgggattacagatgtgagccaccgcgcccggccttttctttgacattttattaacccaaatgaaaactgctcttaacaaagaacccgtaaaccactcagaggctccagtggccagcgtagggcccgcggcgcatgtggacagaggggacagccccaccagccacctcacctgcccggtgctccctaggcccggctccaggctcacagctgtcctcagctttaagttcaaagccccatgatgagctgacgcatgggagatgtgattgtgatcatttccactttgtctttaggtgggcgtgggctcctccccggtactgctgggggtctgcagggcgtctggggcctgggaatgtggttccagcgctgtggccagccggtcacgtctttgtctctgtgtccacttctggcgtagcttgggctccttgccaggcgtctggccatggacgattgagtccaagatgggaccaaagctcgaaaccacccatggatttctgacagatccatcattctcctggacaccgggctacctggttacaacacttaattttcttcgccctttatatcaatgaggctctaaatttaaagactaggccgggtgcggtggctcacaactgtaatcccagcactttgggaggtcaaggtgggaggatcgcttcagcctaggagttcaagaccaacctgggcaacatagtgagacccccccctctccaaaacttgttttatttttttgagacagagtctggctctgtccccaggctggagtgcagtggcactatctctgttcactgcaacctccacctcccagatataagcgattgtcctgcctcagcctcccgagtagctgggactacaggcatgtgccaccacacttggctaatttttttttttttttagttggagtctcgctctgtcgcccaggctggagtgcagtgacgcgatctcagctcaatgcaacctccgcctcccgggttcaagcaattcttctgcctcaccctcccaagtagctgggactacaggcatgtgtcatcacgcctggctaatgttttgtatttttagtagagacggagtttcaccatgttagccaagatggtctcgatctcctgacctcgtgatccacccgcctcagcctcccaaagtgctgggattacaggcgtgagccacggtgcccggcctaatttttgtatttttagtagagatggggtctcgccatgttggccaggctgttctcaaactcctgaccttaggtgatctgcctgcctcagcttcctgaagtgttgggattacaggcgtgagccacggtgcccggccccaatttttttttttttttttttttttgatattcagacgtggtggtgcacctgtagtcccagttactcgggaggctgaggtgggaggattccttgagcacaggaggtagaggctacagtgaactgtgattattccactgcactctagcctgagtgatggggcgaaaccctgtgtcagataaataaattcatagatgtgcctaatctagtcctttttattgtggttgtgatagtaagcacattttgcctctctatgtggaaagatacagtggcttaaaaattcacattgttttctagataaaagaaaaatagggctgggttcagtggcacacacttgtaatcccagcactttgggaggccgaggcaggtggatcacttgaggtcaggagttcaagaccagcctgaccaacatggtgaaaccccatctctactataaatacaaaaattagccgggcgtggtggtgtacacttgtaatcccagctacttgggaggctgaggcaggagaactgctggaacccgagaggtggaggttgcagtgagctgagattgtgccactgagctccagcctgggcacagagtgagactccatctgaaaaaaaccaacaaaaaacaaaaaatgtttgtttttttaaagtttcaatacttttatgtgtatacacacacacataaaaaagtagagatggggtttcgtcatgttggccaggctggtcttgaactcctggcctgaagccatcctctcatctcggcctcccaaagtgctgggattgcaggcgtgagccatcatgtccagccaagttttaatactttctaagcacctattttaataatttattgtggaagcccaggatatatgttaaaataattttgaactctgtcttgagtatgaagaagtggaatctaaagtgcttttaaaagtcagtgttcaaagtaattgcatttctttcccatttttatatagtttaaaaatacaaatcagtagcttcctctgatggctttgctgtccaggtccctctgattgccttttactctaagtttttccgtgggttttaaagtcggagcctggcctacgtagacgcacggggttttgcgtctcccaggagcgggctctcattggcagtgccacgtgcgccttgcgtgaagtccacgtgctcagcctgactgaggcgggacttcctccgtgagactgttgagtggcagccgcagggtcttgacgctgtctctttctctctcttgtccagttttcccgagcacccctgagcagcctggcctgccatgtccgggagaagacagtgagtactggggtttcctacgccggtctcgcatgttacggggttgaactgttgatccgttgtgccacggaggtggcagtggtgccgttttcggaggttcaccctcgtggagcgtcagggcaggagcagccatggtgaccgcgggtggggttttcactgcagctgctgcctgtgcgtgttctggctgacagcaccacatggcgggggactcgcttggctggttggtagcatgagaagtccaggggtgccctgccgtctccctaggagggaggggccaggtgggaggctggacactgctcctttgtggctgcctcagctcacgaccacccctaggccagtcgtctgctcctcctggtccctgctggcccctgagctggtgtgggggctccgttcatcccacactggctccattgttgggagaggaaggagagtgagtcccgggggctgtggcttcagagggaagcttctgacctcacttcctactgcatcccggagactgttgggccctgagcaggtggctacgctgctctcgggccgcgcatcccatggctgtgcttggtggggttccacccccactctccagaccccacacggcctccagcatccgtgccatgccttgttcgttgtgtgggcaggagctcctggaccgaggccgctgcctgtccagcgcagggcacgtggctcagtgcccttcaggcagggcttcccccacccctgctgccagggcacacacctcgctggcctcaggctggatgctgggtgttggcagtgccctgtgttgggcgggaactgggggtgggagcagattcaggccaagagggtgagtgggcagttggggcgagagtcttggcttccagtgagaagtggggctgaatagaggtttggcagtgcttagcatagggggcgagagtctcggcttccagcgagaagtggggctgaatagaggtttggcagcgcttagcgtaggggaggccccaggagccatgggatttccatgatctgcccggggagagggcggcgtggcatcccggttccaggccctcagccaaccggggtccctgcaccgtggccggcaaggccgaggagccatccggaggtgggccctggcaggaatggagcgggtggtctggggctggacctgccggcaggaggagatggggtatgtccgtggcaggcggacaccaccaggtggttttggcagcgcagggcgagtgtgaggaggcagggggcggggaggctttggaggcaggtggccagacggtgggcgtcagggccctgatcacctacgcagctgccctggtggtgacctttcccgggaccctccctctgggtgcccacgcctcacggaccctggagcacgcaccctgggagggcacggttcactgcgtttttatagatacataaacacataaataggacagatactccctgtgggtgagacgatggttgtcccctccacagcgccctgcagcctcatgctgctgctttataggaggggacccacgggccgtgtttatttgccacctgggtgattttttgacttggtgacaggactgtgctcctctgtcccatgtgtgctgagactgtgcactcccggaggtatccacatgcggccagtgtagcccctgggcgcgggggaagcccaccgtatttctccgacatgtctgcctcttgtctcaaccctgcctgggggcctggggtctgctctttctgtctacgacctcggcattgcctctctgcccgtgtggacaacctgccggccttgcgtagggaagggaggcccgcatttgctcggccactgcagtggaggaaggggaggttggggggtcacaggatgtccagaggcctgagctctgaaggggagtgtgtcatgggggtggcagccgagtcaccgtggggaatgcggagaatgtggccaagccccgaggaaggacctcctgggacacgtgagtaggtccttgagatgtttaccaggggtggctccacggcttcggggaccactcagcctggttggggacattccgccagagcctctggggcagcctttgccgaggaggtcagaggcgggtgctgggggtggggagccctgccctgccctgtgtgctgatgtccacccggacgtgggttgggtttcatggcgctagtgtcaggagtgtgtgagaacacactgaccactcggggtcccaggccaccagggcttagggggctggcgctctccctgatgtcctgtgctttctttcactctgactgtggtgctcatctcagacaggacaccctgctctggttgccagtggccgccgcctggggctctgtggttttagcgcctgtgggggtgttcacaggtgtttttgacctcaggcagcactgcccaggctgagggtcagtgagaagggtcggactgggaggtgtgtacagtggatggagcacgccagaggcagacgagggcaggactgcggctgtaccgtgggcctggttcagacggctggacgtgcctgtctcaccgtcagcagaggaccttctggcacattctatgtgtgtctatatgagtgaattggttttatagatttttaaaaaaattctaaagtatacttacaactatcatctctatgtagttacaaacccaaaatatattcaaaaagggaaccccgtgcccgtcatcggtcactccctgttctgccccagccccacctctgctcagcctctgtctctgtggccctgcggattctggacgtttggtgtccgtggaatcctgcatgtttgtccttttgcctctagtggctttcacccgcctgacctttccaaggttcatccatgatggggcattcttggcgctgcagatcttttttctattctggtaaaatgcacataacatctatttttgccatcttaacttttttttttttttttttggcagaggggggacggagttttgttctgtcacccaggctggagtgcatggtacaatcttggcttactactactctgcctctcaggctcaagcggtcctcatgcctcagcctcccgagtagctgggattacaggtgtgtgtcaccacacttggccgagtttttctttttgtagagttggggttttaccatgttgcccaggctagtctcgaactcctgggctcaagtgacctacccatcttggcctcccaaagtgctgggattatagatgtgagccaccgagcctgtccccatcttagccattaaaatttaaaggttcaattcactggtattcgatattcgcattgctgtccagtcatcatcaccgcccatctccagaactctcttcatcttcccagactcagcctctgtctccatgaaacactcactccccattctgcctcccccagcccccatcacccacccgccgctttctgtttctgtgactttggtgactctaggggcctcctgtgagtggaatcgcacaggatctgtccttttgtgacagcttatttcactcagcaccatgtcctcaaggcgcagccatgcgtagcctgtgtcacagtctccttccttctcaagactgaaccgcaggctgctgtatggatgtattttgtttacccatttctgtcagtggacacacgggtgacttccacagtttagctgtcgtgaatgatgctgctgtgagcacgggtgcacagtgacctctggagaccctgccttcagttctgggtgtagacccggaagtgagattgctggatcattgatcattctatttttattcatttatttttgagatagcgtctcgctctgtcgcttaggctggagttcagtggcacgatctcggctcactgcagcctccatctcctgggctcaagcgattctcctgtctcagcctcccaagtagctgggactaaaggcatgtgccaccacgcccagctaatttttgtactttttgtagagacagggtttcatcatgttgcccagactggtcttgaactcctgggctcaagcagtctgcccacctcggtctcccaaagtgttgggattacaggcgtgagccactgcacctggccgataattctgtttaaagagccgccgtgccatttcccatggtgcctgcagcattttccaccccctgcaatagtgcacgagcgccactgtctccgcatcctttccagctcttgtcgttttctgttttttgacagtatcttatgggcgtgaggtggcatatcattgtggttttggttctcatttccctggtgataagtgatgttgagcattttttcatgtgcctgttggccatttcttttttttttttttttttgagttggagtcttggtctgttgcccaggttggagtgcagtggcacgatcatggctcactgcaatctccgcctcccagattcaaatgattctcctgtctcagcctcctgagtagctgggattacaggcacccgccaccatgtccagctagtttttgtatttttagtagagttgggggtttcaccatcttggccaggttagtcttgaactcccgacctcaagtgatccacccacctcggcctcccaaaatgctgggattataggcgtgagctgccgtgcccggctttgttggccatttctgtgtcttctttggtgaaatgtcttttcgcgtcctgtgtccatttttgaatgggttgtttggtttttttgttggtgagtgttactagttctctgtcctggatgttaatcccgtagcagatatatgattagcaaatatcttctcctgctttgtgggttgtttttttactttgttgatagtgccttttgatggacaaagttttaaaattttcctgaaatcctgcttaatgtttttttcttttgttgcctgtgtatttggtgtcacatccaagaaatcactgccaaatcgaatgttgtgaagcttttccccttctctttcatctaaggattttataattttaggttttatgtttaggtcatggattatcctgagttaatttttgtatgtggtgtaaggtaagcatctaacttcattcctttgcatgtggaggtccagttttcttagcaccattggtgaaaagactccccattggactgcattggcacccttgttgaaaatcgtttcaccatatatgggagggttcatttgtggagtctcttctagtccattggtctctgtgtctctctttgagccagtgccacactgttttgatcactgtagctttgtaggaagttttgaaatcaggaagtgtgagccctccagctttgttcttccttttcaagattgttttggggtcccctgagattccagatgaattttaggacaggcttttctatttctgcaaaaaacattattgtgatttttgcagggattgcattggctctgtagatcactttgggtagtgctgacatcttaacagtatgaagacttccaatccatgaactgaagtgtgtttctgtttgtttatgttttctttgatttctttcagcagtgttttacagttttccttgtacaagtctttcacccccttggttaattcctaaacgttttattctttttgatgctgttgcaagtggaattgtttccttgatttcccttttgggttgtttattgtaagtgtataaaagtgcagttgatttttgtgtgttgacttttttgcctgctgttttgctgaatttatcagttctaacaactttctgtggaaactttagggctttcttacatgtaagatcatatcatctgtatacagagataattttactttttccttcctaatttggatgccttgtatttctttttcttgcctaattgttctggctagaattccactactctgttgaataaaagtggtgtgatcggccgggcgcggtggctcacgcctgtaatcccagcactttgggaggcccaggcgggtggatcacgaggtcaggagatcgagatcgtcctggttaacacagtgaaaccccgttctctactaaaaatacaaaaaattatccgggcgtggttgcaggcgcctgtagtcccagctactcgggaggctgagccaggagaatagcctgaacccgggaggcagagcttgcagtgagcggagatcgtgccactgcactcctgcctgggcaacagagccagactctgtctcaaaaaaaaaaaaaaaaaaaaaaaagtggtgtggtcaatcatccctgcctttgtcctgattgtcaaagaaaagctttcaggttttcatcactgagtgtgatgtctgctgtgggtttttcatacatggtttttattatgtcgagatagtttccttctattccaagtttgtcaattgtttttatcaggaaagggctttgaattttgtcacatgcttcttctgcatcagttgagacgatcatgtgttttttttaccttcattttgttaatgtggtatattactttaattttcattcattgaaccatccttgcatcccatgaaaaaatccttcttgctcttggtgtgtaattttcttgatatgctgccgaattcattttactagtattttcttgaggatttttacatccgtgtttataaaggacaattacatctgtgttaataaaggataattatgtccatgttcttaagactcaatggtcagaggctttcttgtcgtgactttgttgggctttggtgtcagagtagtgctggcctcacaggatgagtgaggaagtgttccttcctctttaatttttttggaaaagtttgagaaaaactggtgttagttcttcaagtgtttggtagaatttgcctgtgaagacatcagtccctgggctttgctttgttgggaggttctctttctttctctctctctctgtctgtctctctgatggagagagtgcagtggctcgatctcagctcatgtcaacctctgcctcctgggttcaagtgattctcctgcctcagcctcctgagtagctggcattacaggcacatgccatcacacccagctgatttttgtaattttagtagagatgtggtttcacatgttggccaggctggtcccgaactcctgacctcagatgatccacccaccttggcttcccaacgtgtagggatttcgggcatgagctgctgcgcccggccctgctctcatctttattattcccatccttctgccagcttttggtttgttctttttctggttccttgaagtgtaaaattcggttgttaatttgagatctttcttgtttttttatttcaaatatttatcaccatagccaggcgccatggctcatgcttgtaatctcagtgttttgggaggctgaagagggaggatcacttgaggccaggagttggagaccagccttgggccacatggcaaaactgtgtttcacacacacaaaaagttcatcactataaattttctccttagcattgctttccctgcatccctgaaatgttgatatgttgtgtttctgttttcattcatctctcagcatttttctgattttctttgtggtttcatcttctatccattggttgagtgtgtagtgttatttccatatatttgcgaattcttctgttttctttctgttaactgatttctaagttcatcttgatgtggttggagaatatactttggataatgtctgttttttgaaatctaccgcggctgagtctgtggctcacttgtgttctgttctggaaaacgtcccgtgtgcgttgagggtgtgcagccgctgtgggtacagcgctctgctgtgtctgtcagagctatgcgggttactgtgttgttcaagttctctgtttctttacgtgttctccctagttgctttttcattcctttttatggctggatgaattctgtgatgcgattcaccctgtctgtccgttcctctgctgatggacactggtgggggctgggtcgttcggggctgagcgtgtgatgagatcaggagcgcctggttttttgggggaggtgagggctggtcacgccccggtcgagtggggatcccctgtgtgcatctgtggcggcctcagtggtgttggggtggagtaatcgggcggtggagctggggtctgtgggctccacctgctgccacgtgtgccgggctgcccagggcccatgagggtggtggcacgggggtccgcatgaggggccgcaggtgcctcgggcccctctcccgcttgtttctccatcttcactgtccgttcactgcagtgccgggtgaggccagtgtgtggccggtagattcccgggtacctcttctttgcccctccttgctgtatctggtcacacagaaatggtatgtgtgatttttgtttcaatactcaaatctgttaatattttcccttctggcttcccctagtgatacaaatatattttcttccattttggtctttgagctgctttgcctgtctgtgtctggggtggcatccgctggcacctgggctgacctgggacggggcccttctcttggacttgagcagatgagactcacagcccgaaatgcagcagatccctcaggccacgggactctggacgtgtggcggccctgtcggcctgagccacatctgctgtgagaggcagcagtacgttccttggggcagcagcgagagcaaggctggatccaaagacctccgagcagctcctccggggcagaccccagctgcaagccacagcccggccctggtaacgggagagcatcgctagggaggggtggggcggcccggcttcgatgcggccatgtgggagggccactctcagagaccccccgccttccttgccacccccaccccagaggggaagctggagctgggaggctgcagacccaggccaaggtgtggccagggctggctttcttgggaggctttgagcatcctgcttcctggccacccagctctggggctgctgtcaactcttgatttgtagacatcactccagcctctggcctgtcaccctgaacctcccccatgtctgtgtcttttctcactggaacaccggtggtcggctttggggcccaccagggcagtccaggacattcaccttgagacctggccttaatcacacgtgcaggaacccttttccaaaggagggtcacgctcacagcttctggagtaggacatggacttgtctttttggaggcccatcctcaacgcaccacagttgactacatcaaggtctgcctctgatctggtgggagtgctgggtggtctgtctccaccagcactttgtgggtgggctctgtccccaggaaatgctctctgcccaggcccccgccccgtgagaggttcgtgctgccagtggcgctggtcattgggaccatgtgctgggccggcgcctggcaggacagacagcaggtggctcttctgtaggttcttctggctgggacaggcccagccggtgctcagcggaactgagactgacgcccctttcggacccctctaagaagggaggcctgggtgggcagcctcccctcagagttggggaaacgtggcccagttcccgccagtcaccaccctgccggctgccacggggacacgtggcctggttcctgctggtcaccaccccgccagccacatcttgaacggcgtccgttctgcagtcgcttgtccttagtgttccagcaacaccccaaccaatgcgacccccggaacctccgtcagccccgcccgggagagccctcccctgcatccgtgctgtgcttgttgaaactgagatcctctagcctttggcctctccggacccagccccagctgcaggccccagccatggtggtccctttgggaggcgtggtccaggaggtgatgggcagctggagaacccccgtgagtggaggctgctgtacctggcagggagggtcctgggcaagggggcatggagtggaaagggagtgggtgtccagaaagttcctggggctccaccaaccagaacgttgccattaccttgagcaaacgacctgtttagtggtgccttttctttacctgtaaaacggggtgattgtaaataaaatcgtgtgtaaaagtgcttaggaccagacccccattggagcgagtgttgatacctgtctcaaaggacagtaggtggacgtggcagggagggagatgtcaagacgacagccagggccctttctgccacttcccctggtgggtggtgggcggtcccctgaaccctggcagtaagcgagggacctcccgacaccctggctcctccgtgttggctccaggggcttcctgtttctagatggccgggcccatcatgtggagggaggggtggatgctataggcagcagccccagtcttcctttgggtggggttatttctgctgctgctgcagtccagaggctctggggctcctcagtgggtagcctcaggcctgggcagcgtccatgggacagggtggtccccagtcaggccccattggcctccctgtggtgtgtggtaaagactcagggtgcccgccctgtggaggaggtgccgggggtagcctggctttgcacccagaccctgctgagggcagcgctggatggtcagctggaccaggcctccgaggtccttagagtccatggaggaaatacaaagtccgctgggctgggcagccgcagaccccacttagcagctggtggtgtccccggggtcatcagagccagtgctggctgccctgtgcatttcatgttgttggttcctgcctgtccacagcacagatggcatacccgggcagcgggaccctgctccagcctgcaccctggggaaaggtgtcctacattccacattctgcccgtagcaggcagccccaccccactgtagcccatcttgtcacttagggtggtcccggtagtggcttctggagcctggaacgcttgggtcaggccccaggcagctgggaccctcccgagcctcaccccttgggtctggtggggcccctggggtttggccgggaggacaccgtgactactgcctttgcctctgggtatattccctgctcagcccctgaacccagctccaaggccatttctacttggcaagcgggaggttttcatggccagggatgttaatagcaggtctctggatgcaagggtggcaaagtcgccttggcctgtgtaggggaagtggaggaacctgggctctcccgggccggtggtcctggggcagatagcaggggaaggggctgcagccatgtgggtggagccatgggggccgtggaggggcccttcctgaccccacagtgggggccagggtggggctggcgggggacagtcctcagctgcaggggctggggtggggctggcgggggacagtcctcggctgcgggggccggggtgggccaggaaggggaaggggctcttgaggctccggggccttctggctgtagtgtctcacttggagcaatggcgggatccccagatccatcccctggcccgtctgcctcccgccctcatagccctgtagcctagggcagagaggggtccttggccgggacaccatccccacagggacgtggagggtgctgggcccggggctaccatggagtcgcctgctgggagcagccagtacacctgggcgtgtgacctgggcgtgtgacctgggcgtgcgacctgggcaatgcgggggccgattgctcaggggggcgcctgcactgccaggttcaaaccccaccggcagggagcctgcgctgtgacttcaggcatgtgggtggggctccccgtgccccgtgcctcagtttcctcctctgtaaaagggggctttgtgaggctcgacagggtttagaggagctcctggaacatagtaagtgcttagcaaggccgtcttgccgtctctcccacccagggagggtcaagtgggaagagagcggccccaccgagtgtgttccaggccccggcggcgtctgagaggaggcggccaaacctagtggggctgcgcgaccgcctgtggaacagtggggacgctgctggtgtcctccaggcctgggtgggcgggttaccacggaagcctatcaacggatgcctgtgattccctggtatttataggtatgtctattgttttattaaaaaatccagtttcattcagctttgtctcaaattatttgcaacaaactggaaaagctagttttccccctaaaataggcttctaataaaattggcaatttgcctgctgagcctgaatatcctagagttctgcaaagctggatattttgggatggattagaagagaggagttggctgaaggacagtggtcgtgctgctgagccggccgtctgtgtgaagtttacactggaccaggataaatgcgtatttcctgtgggagctcagcgtggccatggtattcggtggtcttatgattttataggcctagccaggggtctgcgagctgcttctgtccagggccaggtagttgaagcctggggttctgagcaggcgtgggcagcacccaaggaggtgcatggccgtgtcctagtgaaactttatgcacgctgaaatctgaattttatagactcttccggtgtttcaaaatattatccttttcattttattcagccaattaaaagcgtagaaatcctagcttgctgatttggagcactaggcagtgtaggttgccagccctcgttccccatagatttgggaagtcgagtgaaacgcatgtgttaggtttatatgtttcacattttacggaatgcccctcatgcagctggtcagccgcctgacgagggaagcttggccctttggagaagtggccgtgcctcgtggtgagctgctgacagagctggaatttgaacccggggctctggcccggagtccactccgtgaatgcagataaacacaggtttatgagcttgatgatttaaatggaggttttattactgttcaggcaggtgtgggaggccagccatcaggagatgatgccgttgagaaggtcgtttattactcagcttctgagaggagacctcctcttgcctcgcggggccatgcgggcaagcgccgggtgggttggaggcagggggatgtgtgggtggggcctttactgtggtttccatgggaaaggtgtggggagcaggcattgggtcggccaggtggagtaacttcagcaggctctggggtgcaggggctgtccctgtgacctggggaggcccctggggcgactgggggcccgtgtaggaggtgggcccaggtgagagttctgggttggtgggtttgcatttgaaaggttcgctgtgggacaagtcctttgctgtctctaggaatcggttggcctctcggggccgtccctccagggtcagcagggccataggtgctggagcatcgagggcacagcacgtatgaatgcagggagcgtgtggtgtgactggtcagagccagaggtctgcaggacactcccctctgtccctctgcacccccagtgcgaagcggcccatgtaggctcagcacgagtgccgagtgcgtttggggaagtgggcagaattcccagctgagcaccccgcgaccccccatgttttttatgattggaggaaaatgccaggtctcacttgccagtgatgaccaggtcccagggtttgtcagggtaccagggtaggggttggagggtcaggccacccagcggcggtggcggctctgggtctccctaggagcccgggctggccacagccaggcacagcacagcccgtgaggtctggtcttgggaatgcgggtgtctcctgccttaggctgagggtgtgcgtttccaggccagccgggacagttttcagcctggggaagcttggcctttcctgttcctgccccccagtgcccaccgtccccacacacactggtggggtttgtggggtggacacaaccacatcgcaaggcccctatgcctcctctcctcccgctccgttcctgggctgcgggacagtgctcggggcccttggccattggtgtcgagcccattcacagcctctggacgcaggtcagaggtcactcgccacggccacagctgcgctgtcccccactcccagcctggcaggccaacctgcaggaccccgggcttagctgggttctgttccgatgtcgcattttcaaggtccgctgagtccgagccctgcctgggtctggctgctgcccgcccgctctctggactgtgctgatgcagagatgcttgttttcctgtgacgtcagcgtcagctcctgcacatccatgccgtgttttagtttgtgcctcagctgctggctacagcttcccgggggagccgggtaccacccgggcctggagacatgaggaggcagggatgtgaggggcgggggacaggacagccggccttccgttaaatatctgctcctcgcgctcgagcctccctgcctattgtcggggccggaggcgagccgacgcagcatcagctcgtcaacgggaaggaagatgcctccctgcacgcccgccgcgcacagagcataaagaatctgcgctgaggaggcaggagaagaaagccggtgagtcgggggcatctcccccgtggattttccgcgcccccggggccgggccagccgtgctgcaggccctgtgcgtgcggaggacggtgcccgagtcagcattttgggtctgagtcccggcgttgccgctgcctgtgcgctgcacagatgctccgggcagcaacacggctggtgccacggcccggggaaggcgtgcggctgcagcagctcccagcaatgtcaggggaaacgcagtgagaggctgttgttttgcgggtgacagatttttagaaaaataaggctgtggagggaccttctgagcgaggcaggggctgctggagggacatgctcaccccgaggacggatggtgtgtggcccaggcctggtggatgcgtggcggtggctgtggagggctgggggccggggggcttggggaaatcgtcttgggctcgtctgcctgcctggccccagggagttgctggctgttgggagtttcactgtggccgatgctttttggttgtgggtctgtgggtctgtcggggccaggacggatggccgcttcgtctccattctgcattgctgcaggtgggcagattgatgagaccacgggtgaagtctggagaccccaggtgccagggctggtagtggtaacagccagcacctgttccaggcctgcggtctttccgtctcgagcctgccctcccgcctgtctgagcccccgttttgcattgacagtgttgggttggagtctgggtggcacggccagggttaatgtgcacggctcactccatcggggtcctcggatggtggcgaggagcggggctgcggcgtcctgttttctattctgaaatggttggaggtagactcggaggggtctgggggctgcatggtgtttggcagggatgtgggaatgtgggtgcttttctgacgaccattttgcaaggtgttttttttaaaaaaaaaaacaacaaaaaaccaaaacaacaaccagcctccccagtcaggcttgtggggagccgtgggcctggggagactgggctgctgaaggtggggactgggctgctgggggaggcggctttccctctcggggggtgctggctgctggggaggctggcagcgcgcccctcccccaggtgcgaagggacctcagcagacgcagggctgctccgcacagccagcttgggccgcaggggtccttgagtgatgaagattctgtgttgatggggtgagtgggagagagacggagctggggtggttttcacacgtgcgcctgcctgcgaggagaaacgtgctgtgtcatagtttcctcggtgcctgggacggcttggcctctgctttcgtgtgagcccacgctggccatgcacagctggcacgatccctcgcggtgtgaatacactgctggggtgggagcgccgtggccagggtcaggattcgagcggttactggcttttggtctgatggccctcggtgggtgagtcagagctgggatggggacagattggaggggccaccggctgccccccagaagctgtttcgtgttgatgctgccggggccggctgtggtacctgtgtctgtgtctcggccagatcggcacacatcttccgcgttcctgtcccagctgcatcagccatcagtgggggcccttctccgaccgtcttcctagacttcagagccactggtggttatgtaaggagttgtgtgttcctctgcccaactccgagcttggtcccacctcccagactcacctctgggctccgggctctgctgcgatgtttccgaggctcccagttaatcagatctgtcagcccagtgtccacagggtgcctgagagcccagcccatccacactgggtgccccagaccttccacggggtctggtggggacctgccagggctgtcaatggccccagtggagaggcccactgagcatcctgagaagttcccgtgcttgtgacctgctctcgtgtgtgtagcagcgggggctgcgtctcatctgccacacgtttctgatcgccgaggactcagccgggcacatggaggttgaactgttggggggcgggaggaccatccatggggtcaggcaccaacctctgctgaggatcccaaaatgtggggtagccatcctttcttgtgctggcgtggagcttttcccaggagctgggcagggagctgtcacagggccaggcccctgaatgggctgtttggggccggggctgagggggtgcccagtgccatcgaggggaagcctgtgggaaagtgtgatgacatctgaaaaaccaggagcaggtcccttgctgtgctggtcgtggtgctcgagtgtgggctcggcaggtctggtctcctggcgcccactcactccctggccatctccccacctccctcacatggcagggggaagtggaacgtgcggccactgctcccaccgtccctcacagcacaggctggacaggcaccctgaggcatccccatctcccagcccctggggttggcatgatgctgggcctccagaaatgtttgtcattttatgcaaagggcagaaaaagctttgttcaggccaggcacagtggctcacgcctgtattaccagcactttgggaggccgaggtgggggatcacctgaggtcaggagttcaagaccagcctggccaacatggagaaaccccggctctactaaaaatacaaaaattagctgggcgtggtggtgagcgcctgtaatcccagccattcagggggctgaggcaggagaatcgcttgaatccgggaggcagaggtcacagtgagtcaagattgcgccaccgcactccagcctgggcaacagagcgagactccatcttgaaaaaaaaaaaaaaaggaaaagctttattcaaaagaagccacctgaaccagtcggtcgtccagtgttcagcttgtttttggtcataaagtggtggcacttgtcactcatacaggagacgctgtggcagagcccctccacgcatcggggcccggcagctcatttctaggattctcctgaacacgcgaaggagggcacccaccacgctcgggactggctgcttctctgtgaggcctccaggcagaaccagtgattccaccgtcgtggggcagccttggtgggcccacaggtctgttgttccccctgagagaggatcagagtcaggagaggcgagacaccaagttgacacgaacagatccctgctgccggttgttctggcggtgctgtgagcacgtctgacgggtgtgagggtgctggggcttcgtttcgtccacgctcacgtatcgggcacacaggagagtttacacgcgctctggtgggtggaaggggccctgacttgatgttattttgaaatagggggtttgagtgtgtctggtctttctgaagttttcttttttaacgtctcttctgtgggaagtttgaaaagattcaaccgactgcaagacggagccgccctgtgtctgttggggctgtggggacccaggtgcactggcagctcagccgcatcgtgggcccagatggcttcttctgtttgttcctcagcgaaccttgattgttgaaagaatcccgtgaggctgtgtcaagtgtagacaggccaggcctggtgtcttgtcctggtcaggaaattgtgttgttgcccttgttaaatggttgtgtataaagtttgcattgtacattatatttaaaattttattttgagttttccatattttctattgtaaggtgttgatagttctgtgggactcacaaagagagaacaggtgtccctggtcctccctgctgccccagctccactccctggaggggatcacagcagtttctttttgacatttatttccagatttctaaatgacacatttctgctgctatttctagtcgtttccatttaggatgttacttccctactttctctgggacacatcagctcatctcttccttccttgttccatcctcctgatggagttatgtcactgtttattgtttttaatcattgagtgtttacctaattgcgggtgacgtgaatatgcatgagctaccatgattgcattcccttgttggcacaacttttgggtttccttggagttaatacattgtgattgtttaaatcagtttcctagatgtcttgtctcaaatttactccagtttcctcttcccagaagaggggcagctcccaccgatgcctgcctcacctccctcctggtgcacctggccccccacacaacatgccgtggggcttccctgtgccccgagctgggaacagtcccctcctctctcctctgcctacagtcttgatctctggctccctctcttcctctttcttggcttaatgtccggttaagaccctccagcagctgtctgagaaagatggcgtgggaggccagtttgggggatctagttggaaaatgcttttcctccagccacacacttaaggatagtttagctaggtatgaaattctgtattggaaagaattttccctctgcatttcgaagggatcgctctactgtcttctggcttcttgtgtgaccgagaagtcaggtgccattttgattttgtgtgtttttctcctgaaagtcttgtagaatcttttgtcttcagggttctcaagtttcatgataatgttccttgtcgtggaaacttctttgtctcttgtgctgggaactcgtgctgtggaaccttgcgacatttggatgtgaggagctttacacccagttatttatcacatggccgactccccgtctctgactctcttttagagttaacgctgattatttgttggccctcccaggctggtcctttaattttcttctctattttccatttctttgtttatgttatatgctaggagacatcttcaggtttctctgtccaaaccatctgttaagtttgttagtttgttgccttgttcccgttcttgtctttcgatcttttttctctgaaggtggcttttttttttttttttgagatggagtcttgctctgtcgcccaggctggagtgcagtggcgtgatttcggctcactgcaacctccacctcctgggttcaggccattctcctgcctcagcctcctgagtagctgggactacaggcgcccgccaccacgcccagctaattttttgtagttttagtagagacggggtttcaccgtgttagccaggatggtctcgatcttctgaccttgtgatccgcccgcctcggcctcccaaagtgccgggattacaggcgtgagccactgcgcccggcctgaaggtgcctttttaaggcagagtgccctgcccttgtgtcaaaggcatatcgcactttttctctggggttattcgtcccggctgagaagcaccgcggtatcatgtggtgattgagcagcacccagcacattcatggctgcgaggcttcccgcgtgtgaactcatttaatcttctcagttccttgtgggcaccattgttttctttgttctgggtaaagattagcactgaggcacagacaggtcaagaaatttcccagaatcgcacagtttgagctgggactcaaaccccaagggctgggcttaagcccacgctatttgccgcgtgccccagggcctgaagctgcgtggtcaggccccagctctgctgcccaccagccacgtgacctcggccacaacgctgtccaccgtgtcccggaccctcataagtgagcgtgatggtaaaaggcttggctcccaaggctatcatgggattagccagtaactaagccacaacgctggccccgcggctgctgctgatggcggcacatggtgggagcatgtgtgctggcagcggttggtgataacgtctccttttggtgttttctttggcctcgtactcagctgttttcaccgagagtccctttttgtgtttgtcctggcctttgcggcttcctgggcccctggtgacccgcatttgtctgcccacattgactcgtggggcaccacagagctggtggtggcggaagtccccaggggagtgtcctgcctgggagggccgggcgtctcacccctagtaaggagtctgctgccccagcaagccctctcgttccctggctgctttgggtgaggaagggggtctgggggtcgactcctcactgactgggaccctgcacagcaggtgccccactttcctgctacctggagcctctgacttggggcccttctttggggttcggcccagtacagtctcctggtggccacggggccctctgccttccaggtcccagggcatccactacccggcctgtcctcctctttgctgttacgggttttttggagtttttcttcctttggtcttgggagggagagtcagtcagtgatgtgtttgagctgctgtgtccacctggaaaccatcgtgatgacgctttctgaaggctaaagtatgcaggaaaaccagagttggagaaggtctttaggtaggggcagtgcgcgtggacgtggcggtgcgcgtggacgtggcaggtgtggaccagcacgtcccactgctctgcatcctgaggggccggagggtgtggtgcagggttttaaggagggcaaaggcccctctgtttgtttttccttgatgctgccccccgtgcgacctgggggcagttttcaaatgcttgacccaggtagtttggttctgtcaccccctcgttcagtggggtggtgggaagaccagtttttggaacagttttggatttacagaaaaatcaggacaggagtagagcacaagcattccctccctgctccctcctggtcagcgtaatgcgtgagttacacttcaccagccagtctcggcacctttccagctaaggctttattccgcttgcctcagtctcccctcctgccccctttctgtcccaggatcccgtccagggccccacgtggcacttggccgtcacgtctccttaggtccctctcactgtggcaggtctctcagacttgcctcattttcaacgaccttcgtagttttaaggagggctggtcaggtgttttgtgggacagcccttcgctggggtttgcctcatgtttttctcataaggactggggccttgtgttttgggaggaggtgaagcctccttatatcgctgggtccgggtccacaccctccacgcagcctgtccgtgctggccttgcgtgtcacctggccgcggtgtgtttgtcggctcacacctgcccgtgcctcttcccccgtgctgtcctgtctgcggagtgaggcgtgcgtggcccacacctaagaggtgaggagctacatacgtgatgtcaagttttgcacgggacttgtacgtctgttctcccattggttatttaattattcctttctgttcatgtggactcgcaggtgtcaatttcatacttgggttagaatcggataccgtgtcgcttacttattgctcagattgttccagctttgggcactggggtccctgcaggctggctgttggggcagcgatgaggccagacactgggtgggttgggggtgggtgctgacgggtctctggcaggagggggcaggctgcagggagcagggggaagcaggtcccaggcccagaggtgggtctcgggcgagtctgggctgtgggcatggacccccagaaggggcctgtgtggccaggacgtcccatggctgcagaccccggtgtggggtgtgggccctgggaggtgattggtactgcagccggagctccagcatcatgccaaggtggtgctgggtcgaggcggggaggggagaagtcaccacactgtgcccggacttggtggcgtggtgatgtcggggctgcggttgggggactgaccccgcatactcttctcccagctgagttggcagtgctgtagggtcagcagcccaggctctgcatggggctcgtgtgggactcggcaggtccctgcatcacctggcaccaagctcaggcacgccccccacaccccaccactgccgccccgccccccagcatccccttcctgctgccctctgtgctgcactgacttcctcagttggtttgatgagaggtgacaaaggcagaaatgggcagagagcggcaccatcgctggcccctcttgcccatttgtcccctgctgggtgggcagtcctcttttttcggaaatgtgttcagttctcttgcattgcataatttgttcatattaaagcaggcttgatccgggctgccgtggttccgatcgactccgaataggacaccacacagtcgtgccaagaaggcgcctaagtgtctttccacacggccatccgagggcggacgtggtcaggggtgctggacgcgtcagacgggttctttgcagcccttggcagcgtcgcccgctctgtcccgcctgttgtgtgcgccttttccctgctccagggctgtgtatttggcaagagggaggctccgtggcacgatcacacgtgcaggagctgggggctgccagagcggctgttcaagatggacttggcaaatcacctctttcaagttgccggctacccggctgccgtagacagagtgaagtctggtagtttgtgtttatttatttatcttggccagcagagagaattgagtttgcatggagactgtaatttcattctgtgagtgtaagatcacgtccgcgttcctagcgaccggttttgtgatgtgggcagtgccgtgctggtaaatgctctgtgaggaaggaacgatggtgggatttgtcactcagtcgatttccctggtgtaaatgctcccaccacggccgatttcaggctgccgaagtggaggggttcagtgaaggtggagttgggcaagggcgtacacggtcggcttctgagagttggtccccccgcccaaccctcccctggagatgggatgtcaggagacctggttccatttgtttttttgcctgagcgtccgggggtggctttgaggacacctgtcctccttcacaggggcactccggatgtagtagcagggagagggtggaggggcggccaagggcgtgagggagagggtggaggggtggtgtgagggtgcaagggagagggtggagagggtggcagtgagggcgcgagagggtggaggggcggcatgagggagcaagccacctcgggcacaggtgaaggacaggtgtccacaccttgggtgcccccgtcctccctctcctcatgtcctaataggtctgaacaggaagttacatttagggcggctgtacagtgagttttaaataccttggtccaaattttcaaacacgtatcgttagcgtttcccctgttgctggccccagagtgttcggttcactgggtggagcatgctctgagcccctggaggtacagggattttacgggaggaggggtcgcttcgaggggaggtggctgcgtccatgtctggacggaattactcactgcctgtccctccctgcagcctctgttccctcctcaccagtctctgattccagctccgggctcagccagtggtctcaggacccccaccacattcatgaaaattactgtggtcctcaaagagcttttgggtacgtgggctgtagctgccagtgtgaactgtactgaaaatttagaacgaggaatatttattcctcattaactctaattaatgtatgattaattagattaattctaaaataacccatcggctgttaacattttaatgaaaagtgactattttcccaaacaaaatattcggcaagagagtggcaacatttttgcatctggttgagcagaacacggttgagccatcacacctgcctctgcgttcaggctgctgcagtgttgggttaagattgtgaggaaatccagtgtgtgaggaggcttggggtgaattccagtgtgtcaggaggcttggggtgaattccagtgtgtcaggaggcttggggcgttttaacagcttttcctctggtaaacgtgggtattcttctttgatatttctctgaaactcggcacgtggtcatttcttacatgtcagttgaaacatggaatctgaaactgtattggtgtcactttcctgcagttaccttaaaaatccgctggtctcttttgcgctcgaataggtttcttacgcgtgcgtgtgttttaaaaatcgtatgttggccgggcgcggtggctcacgcctgtagtcccagcactttgggagaccgaagtgggcagatcacttgaggtcaggagttcgagaccagcctggccaatgtgatgaaaccccatctctactaaaaatacaaaaattagccgggcatgcatggtggcggatgcctgtaattaatcctagctactcgggaggctgaggcacgagaatcacttggacctgggaggcggaggttgcggtgagccaagattgcaccactgcactccagcctgggcgagagagcgaaactctgtctcaaacagcaacaacaaaaaacatcgcatattggctgttaggaaatattgctccactgggttctgcaggtcttcctaagcgcagtggaaaattccccccacgctcatgagggcgagtgtgaagaaggcaggtgctgtccgcttcggattatggtcatagcttgcactcgcggctcccctgcctggtctctgggacccccaggcatccccagacctccctggcctcagccagttcccgccgcttcaccatatggcagaacacatgcgcggccggccggctcacagatgggcgtccctgcgtccggcccacccgcctgcggtcctgtgtgctcaccctgccctggtctctgcctggactgtggatgggggtgagtggggcatggaggcgttctgcacccaccagctgtcagtgccagccacctgcctgcccagcatcgggtctgtgtggcagcaccttgtcagcaagtggaggtcagatgtggggtcagctgggcgcagtggctcacgcctgtcatcccagcacttcgggaggcctagccgggtggatcgcctgagctcaggagttttcaagaccagcctgggcaacatggcaaaaccccatctctacaaaaaaatgtaaaaattagcctggtgtagtggtgcacacctgtcgttccagctcctcgggaaggctgaggtgggaggatcgcctgagcccaggagttcgaggctgcagtgagctgagattgtgccacttcactccagcctgggtgacagagtgagaccctcttaaaaaaagaaaaaaaaaaagatgcaggtcaggcacagaagcccgacaggctgctcccaccccaacatgaccgacaaggtgctgtgtccctgccctccctgtggctctgcgggtagggggcgattcctctgtcagctgggtgaggagtagagaggcagctgagtgggtatttatttaaagggaagacaaggacgtagactgtacggctctctgaaacttcagcaacttttccgagacacgttgtaccatccgccctacctggcgtgggcgtgaagctggtagcacacagaaggtcccggagcaggagctggccccgagccagcagctttgtgccctgtgttaccggatcttcagaatgcgcctccagcctgttgaccatcttactgctcacctgggtccgcagcccgccagataccaggcttgactttactcctggcggggctagggccagaacccagactggttgctgcgcacggtgctttttgccaaacctcacatttgttggttgcgtttttcacaactcttgtcctctgaagatgcctgctcagagcccatgcagcgccacgctggaggggctgaggatatggggggccctgttctcagagcccgtgaggcaccgtgctggaggggctgaggacgtcggggggccctgttctcagagcccgtgaggcaccgtgctggaggggctgaggacgtcggggggccctgttctcagagcccgtgaggcaccgtgctggaggggctgaggacgtcggggggccctgttctcagagcccgtgaggtaccgtgctggaggggctgaggacgtcggggggccctgttctcagagcccttgaggcaccgtgctggaggggctgaggacgtcggggggccctgttctcagagcccgtgaggcaccgtgctggaggggctgaggatatggggggcccgggcccggctcccctctcacaggcaggtctgcacccatgggtgggtttgggaggccccggtcttactgtgttgatgcagagaggcacttctctctttctctcgctcccttctcctgtctgggttggcatcatcccaggagtaagagctgtgtcttctcccctccctgttgaaaggaatcttgatcctaatgtgaactcaaggattttctaaaaactgggtttattatcatccttttttttttttttttttaaattgagacggagtcttgctctgtcgcccaggctggaatgcagtggtgcaatcttggctcactgcaacctctgcctcccaggtttaagtgattctcccacctcagcctcccaagtagctgggactacaggctcctgccaccacgcccagctaatttttgtgttttgatagagacagggtttctccattttgcccaggctgatcttgaactcctggcctcaagcgatcctcttgcctcagcctccctaagtgctgggattacaggtgtgagcctccaggcctcagcctccctaagtgctggaattacagatgtgagcctccgcacctggcctggaatcatcgatttctgtcattgttcgtcttgaggctctggtcctcccaggtttggctggcaggggccttggcgagcggctccccccatgctacccgcttttccatcaggttttgtgtgttgctcgcatccgggcagcaggctctggcatcccctcggccctttctgctccaggctggacctggccgtttctccacggaacttggcttccttcggaggagggtggacttcagaaactaacctgcctgctgctcctgggggccgtgaggctgtgcccggtgggcggtgggccaggggctgcatggggattcgatgtgcagttcccgcggcagctcccagtgccgcaggctcttctcttctccacttctgagtggggtctccatctgcacagcgtgagcctgttcgctcgtgtgctctgccttcgaatgcggatgacacagcttcagagccgcggcatcgtcaccagggcagcagacccagccaggccagggcttctcagcattcttttgtcctcagaatgcctcctgccatgcccatgcccttggagagcagtttccagaagttaacttggattcgtttattcatttgttgtctttcgtggggttatgctgtcagtatgatggtcagttggctttatttgtttctgtttgcatttgattttagtgtatttccccattcttttatttattttttttgagacagaatcttgctctgtcacccaggctggagtgcagtggcgcgatctcagctcactgtaaccactgcctcccgggttcaattgattctcgcacctcagcctcctgagtaactgggattacaggcacccaccaccacacccagctaatttttgtgtttttagtagagacggggtgtcaccatgttggccaggctggtctcgaactcctgacctcaagggatccacccacctcggcctcccaaagtgctgagattataggtgtgagctgttgcgcccggcccccattcttgtttattttacttacctttgggtggtgaggcgccacggctcaccgtggcaacagctggcagtgcagccccaccacgcagagagctgcaccagcacctgtggatggcatcccgaggtgccaggcgaaccctggggcttctgtgtctctcctacaaccttcgctcccaagggtttttaatgatgctcttatttttgcattaattgggttgtatcccatcacctggatgtgattaccgagagaagtatagcaggatacccgagtaatatgtgtgcgatgccagcagaaagacgtgaagagagtaaatgaataacaggtggttttgctctgaagtgaccttttggtgggggtggcgggggaggttaaaaccttcctgctcccctaaccgggtacccactaacagaaaatgcccgactctggaaaggagtccccggaggcccctgaggaggaccagcgtctggcctgtccgggcaccgggggcagcatccaggccctcgggagccaggcaggtcactgcctgcacccggggaggcctggcttcgaggctgggaacactgggacggcgtgagggacaggctgctggtgcctggcgcgtgctggccgcctggacactcagtgaagacggtctttgttttgatggcggcagagcccatcctgaatagcggctttctctgctgtgtgggtgggggcctcgggctcggatgctgcctgagttggggttttggttttacagtttcccactcgtgtaactttaaggaggccactcagcagtgtcctcacctacctggcccagactccgcctccctcatctggataacgcccagcacacctgagaagaggcacagctctgcccccgtctgtccctcgtcctcctcactcctccctcccccttgcctggatggtgcgccccatggggtctgcacgcccctccctccgcctccctgttcctcccctgcagtctcagctcggaggctgcccctttccatcgtgggcttcctgggaaccaaatccctcagctttggccctggttgcatccttagggctgaaaatggtgcctgggacccagcagggctccctggacatttgctgaacgtcctcgagtccttgagtgaagacggctgtggcgagtgattgccgcgtgactcagcctctccatcccacgcccagagcggcttccggaggtcccagagcccgggctccaggatgagcccagcagagtcttcccgtagacaccatcatcctgtgtggaatgtcacctctcctttctaggtcaggctgtgggagcttcggagcctgaccaaacccaggtcatgtgtgcacagctcagctgcctggaggcccctcccaggcggcggcgtctcttcactcacagactccagctggggctcagcgcaacatagcaagaccccatctgaaaaaaacacaaatcagtgtttctggttgtgaaagcaacacatgttcactacagaaaatttgacccatagggcaggatgtcagaaaagctcaaattgctctcgcttgtactccctggtgagcctgtcacttttgttttattttgttttgttttccgagagcatatcgtttttaatttcattctggtcttctatactattagtttttatagaaaatactagtgatacgaggttagaatccctccctgttatcagctaataatagcaataacaatggtgccaattctgttccgggctcatcgtttctttttaaaatggtggagcttactgcagtagagtgttttccttagccggggtcagctctggttttagaactcatttccctgttcgcgaggtccctgggcagagttcggccgggcgatggcagacgccgatgaggaaggacccagaggtctctgtttctggggcctgcatgggtagaaacgtgggggtgacggtgtgagcatgaggatactcagagctgggaagacttgagggtcggggttggggacagagacttccaggaggcagggccgtctctggtccgtcggggtctgcgttcatttgcttcagcctctgtgaggaggcaccacgaggggtggcctgtaaacaaggaccctgattgctcgagatgctgaaggcggggaagtccaggcaaggtaccagcagatttggtgcctggtaaggactggttcacagccagagccttctcagagtcttcttcacgtgataaaggggacgaacaaacactctggggtccctttgaaaagcactattaatcccattccggaaggccacaaccttaccacctctcaaaggcctcctgacaccgtcgcttgtgggtgaggatttcagcgtgtgaattcggtgggacgtaaacactcaggtcacagtgctggggccgctgtagcaacgtaccacagatggcggctcacacggcagaactcaattctctctcagcttgtgtggtgatcccagctactccggaggctgcggtgggaggaccacttgagtgcaggagtttgaatgtagccagggcaacatagcgagatcccattaaaaaaaatccaaacaaaaagctttattctctgtctggagaccagcgtccgagagctgggtttcggcagggctggttcccggaggccgtgaggagcccgggccaggcctgtccccttggctggtggagccgtctcttcttcacccgggcccttcctccccgtgcggccgtgtccacgttaccctctgttatgagaacagcagttgttttggatctaagtctgctgtaatgacctcactcacttaactgattacatctgcagtgtcctatgtgtaaataagggcatgttctgagctcctgggggtcaggacggcagcttggattccgaggggattcagttgcactcatgcagaggccctgggggctgcaccttggcaaggggttcccatggcctggccggtctgcagtccttgtagtcagctgcacccagccctcctgcagaaggggcccgtgcacccatggttttgtagccgtcagggagcacctgttcagagggccctgctgaccgaggggcgtgggctcagcactgccagggcccgtgccctgtgtccccacaggatggtgctggccgtctcaccactgaggggatgcccccccagccccctcaccctcagctgctccttccaggagcttaaggcccctaaagtctgccccggtccctggggtcagagcccaccctgggctggttttgaagaaacaccagtgcttctccaaggaggccccgtgcacatgtaggaatgaagccctcgtcctcccacagccgcgtgcccctcctgcgctgcgtgtgtggttttgctcatggcacctggcgtgggcgccctgggagcggcagccaggggcgtctcggagagagccagtgcaggggggaccccacaatctgggaggccatggatcctggttgtgggtttttggttttaacatttggtttacttattttcagacttttttccaaacaaatggtttatccatattaatttagctctccctgtggaatttgtaggacctcagttttcttgacattatgatctaagcagattattgaacacacgtcttaaatatcatcttttcaaactgccacatgtaccatcatatagatgtgctttaataaagaggtcagagagctgtggcccactgtagttcttgtttgtttttttgagctggagtctcactcttgttgcccaggctggactgcagtggtgcaatctcggttcactgcgacctccgcctcctggattcaagcagtgctcctgcctcagcttcccaagtagctgggattacaggcgcttgccaccatgcccggctaatttttgtatttttagtagagacgggttggggttttaccacgttggccaggctgctctcgaactcctgacctcaggtgatctgcccgtcttggcctcccaaagtgctgggattatagaagtgagccaccgcgcctggcctgtttgttttttaattgtggtaaaatacctataacataaaattcaccattttaaccatttctaagtgtgtagttcagtaaagtaaattcatgctgcacagccaatctccagaatttcatcttgcacaacagaacctccgcagtcccacctgcagcacacaggagttacgatgtctcgccgtcctcgctgacactcccgactttctgttcctggccgtcctcttggggcgaggcagtgcccagtgtgggtctagtttgcctctcccggtggttggtgatgttgagcctctcacgcctgtggccgcttgtgtgtcggctttggagaaacgtctgcacaggtcctttgcccgttttgtaattgagttcctcgtttctgtggttgcgttgtcctgtggggtggttgacctgcacgcaccgtgtgaactgatcccacttgttccatgcggacccaccgattaccaggtgggagcagcagggggcgtccgagggccctgaccccaggcgggaggacagatgcgcgtcctgtgttggggccacggagttgtgggcaattgtttctttttcttttactttctttggtatcttccaaatctttataaaatctttataaaaattatttaaggagaagactcatgtagaatggaaagcgtcgtgccagacagtgcttggtacttgcaagaatggccgtgtccccaggagccggtggacgaatctgtccttgctgccacccgtgcggccgcagagtgagacaggagggaccggcaggcatcgcgcttctcccctagatactccggccatgccagccgcccccttggctccggccccgtccatccagccccttcccagggctttgtcccctcacccccgccgccctccccctgttttcctacgggaggcgaatccttgatgagaggaggaggccgggaaccctgccccctctgtgtgaagaggagggcagcccctgctgctttgtagggaaaccctgcccaagagaagccccagctcagcaggacggagcccggcgttcccgcctcagggtgcccagagagggcggggacaccctggctgggacaaagtgcacagctctacccctgctctgaaatgcccgggactcggccgcgccctccccctttttcagagcaacctgtgggccctggcaaggataggcctcaggcaaaggaaaaccaccctcgttttcttagcttttagattttaaaaggagcagtggggccaggtggacttgaagctccgtgggtttgtttaaggtataaattcattgagcttgaagacgttgtacgtggaagtgaacagaacacacataatttattcatggattttagctggcctgtttttgtacaaagggagcttttaaatttaattatttttaagcattagaggatggtgtatccgaggcagctggaggccctggtcttcactgtgagcagggagggcccttgggacagggctcgggaggaggggccgggtggacccctgcagggctggaggacactgagggcctcagatcaccacacagtgggcccagctagggggtgaccctgaattccagtcccagcggacacatctcttgccttcagcatagagggccccaggcctcgggccctgcctcagttgcctccacgatgtcagcttccaggtgtggggaccgggtgccacctcaccccccagttacacccacacgaggccgcggtgcccagtagcacagagatgccaacgtgatgggtggttttcaacaggaactcaagagaaaagttcatgcttgtgaggacagagctgcagctttagccctgagagacctggcgggagaggaggcagatggcgagggccccaccggcagagctgctgccctgaaaagcacctcctcctggtggacaccaggtgcatggtgtggtcaggtgtggagtgtgggcccgctggcctcgctgcttcctgcgccctgtttaccacccctcaccccctggccccagccttgctcttggcgggcggctagtgtcctctggccgccctggggcaggtcagaccgccggggtgtggagtggggtgcttgcctttttctgcctgaccctgcttcgtgcggggactctgggacgctgtgacttggctctggcctggtccagcccccagtgtccacttctctggaaggcgaaaggcagggtgggggtctccttgatgtgggactggaagctgctcagccagtctccctggaaaaggtcctggtgacagtcactgctcgctgcagtggctggtgccttcctcaaaggtgagggtgtccgggtggctgttggtgcggggccgctgggacctgtaccctctaagttgggacttcagccccgcctctgcccccaaacgtggtgggctgagatgggggaggcccttggaagggcccagaggaaccccagggcctcacagaggacgtgctgtgtacggtgcctcctccctgcggcctgccccgcctgtgcttggagctgcatcgggcacagcctgccttggcgggcacgggacgagccgaggatccccgcgtcgacgtggaggtccgcggctgtcagcgttgcagccctcggccgggcactaagggctgagtgtggggccagggcagagggagccaggccagcagctccaggcccgggtggaggaagtgctgcctgacacgtgtgtctgctccctgcggcacgtccacagcacctgccagcccactttgggtgaccctcctgtttgtcctgtcctagcgcagccacatcccttgggaacctgcttgtctctagaaccttctgcctgatgcacaacctcagagccctccgtcgccatccctcccccgtcccgggagcagcccccccacttccacctgtcttggacgggagctggaagggacgtggttccagtcctgctgtgccaagcctggtgacccgagggtaccctcggcctcccggcctgaactcttctcctaccatgatggtgcctgggatgctgtgtggtgcccgtgggcagtggcggaggcagtggccccggctcgttgaaccttgggcactgcccattctgaggcgcccgctgtgcccggctcgttgaaccttgggcgctgcccgttctgaggcacccgctgtgcccggctcgttgaaccttgggcgctgcccgttctgaggcgccctctgtgcccggctcgttgaaccttgggcgctgcccgttctgaggcgccctctgtgcccggctcgatgaaccttgggcgctgcccgttctgaggcgcccgctgtgcccggctcgttgaaccttgggcgctgcccgttctgaggcgcccgctgtgcccggctcgttgaaccttgggcgctgcccgttctgaggcgcccgctgtgcccggctcgttgaaccttgggcgctgcccgttctgaggcgcccgctgtgcccggctcgttgaaccttgggcgctgcccgttctgaggcgtctgctgtggcccttaccgtctggcttctctgctggctcttttggccttggattcatttctggagctgcagagtcacttctcttagagcctggttttggccctctctctcctgcctataaaaagccctgccctggattccctgctccatgccagttctctccctgcccccgccggcacgacacggacactggtgcccgagtgatgcctgtgggtgatgcagacactgactgtcaccccagccccccatgtgctgctccgccacaccccaggccccgtagcagggtggtggtttgggcagctgggtttgctggtcccctgggagtccaagcaacatcaccactgggtcccagatatgccgtctccctggggcacctgtgcttctggtacccagggtggagtctggttgtctcctttccagacccttctaggtctgcgttggcctggctggtttccctgaggttccctctgtaggggagggcctgccctcctggcaggggcccttgtgtgcgtcctgagctcaccgtggttttggaggtggctgggcagtggcgggcagagccccatgctgtcctctgcctttgaggtgggcacggcacacgtgagagctgagcattggtggaggaggccacaaccggtgcccagtggttgagtcgctggtgcccaccgagggcccagggagtgagggaccccctgaagaggtagctgggagccagaccctcctcccgtggatgccttttcaagtccctgtcagttgttcagagaagagggggaggattcgcgctttgcgtcagatgcgtgcgtcctgcatgggtggtgccggccggctgtgcccaaagtcatgccctgcccctgtctcccgcagcctggcatgggctcacgtccgtgtgcttgtccagcctccactcgccacagctcccctcccctcccctccttttccctcctctcctttccgctcccctcctctcccctcctttccgctcccctcctcttccctcctctgccctctgctcccctctcctcccttcccctcctgtcccttcccctcccttctcctcttttcccctcccttcccctcccttcttttcctttcccctcccctcctttcccctcccctcctctcccctcctctcccctcccttcccctctcctcctttcccctcccctcacctgtttgactctgctgtgccaggggccagggcagggctggcccctcactctgcggagtaaatgggtgtgggggccgggcctgtctgggatcagggcagccaggcagggtctcctgcaggagcaggcatagtcccagggagcaggcagctgcctaggaaggcagtcaagcagatggggacctcggctgccccaagactggcccggggctggtcctccctgcgtctggcctctgggtgggtggtggtggcttccttgtgacttcatccctccgatcgggcaggtggttttgtgcagtgtgtgcctgggaggcgcacggcagcatgatcggtccctgagtgtcacggcagcatcagaggccagtttggcatctggagtagctgccaccgagagaggcccagccgccaggcagctgggagcacaggtgtcggcatcccactgggagcacgggtgaggtgcctcccttctctgggcagagtttccccagttggtggtgtagacgccaggaacgcggttgtacggacttcgtgaggatctaacacagcagtgtgtaaaaacagcgccaagcgtgtcctcggtgggcgctcagaggcggttgtgagcagtgcagatgctgttggcctagttctgacagggtggcccaggggtctccccgtggcgtggcatggacggtggcagctcctgtggtcatcactgccatggtccggagcggccctgggctctgcagcaaggcggttaatgtggagctgagcggtccgaatcagggtctgggttgctcgttcaactcaggaacttccccagattcctgagttttcctctagccgaggtcaggggcagccaagggaagggtcagccagctcatccagacctcgctctgcaacaaatctccagcctgggttgccatgaggcaccctggggaggactcaggacgaggccccttgaggctgaacctgagacctaggaaactccaggtgggtcctaacagggcttgtcactgagcgtaggcctggacacggccctgtggtgtctcacccacgggcaccagtccctgttgagcaaggtccacgcagccctttgttctggacggagctgacgctcaggccacagactccgactccattcttcagaggcttcatcgcctgcacaggaagagaggcctggagataccaggttgtcttggggccacagctggcccttggcatggctggggagcagcaaagcagttcattaggaccagggctgaccacaccagtgtccatgcccagaggttctgggttctgccctcttgctgtcgtccggtgcaggccacatggccacctgggaaggcctgggtcgtcgtcatattccgagtgtgaccaagagttcaggggcccaggtacctttctgggcccctctcagggtctttggaaaagtccagaatgagctgggctggtggagaattcaggaggtgtggccagtgcccccctgtgctctcagaagcaggggtcactggcgagagggctgggtggcccggcgatcaacctgaaggcattccttacctgcccttggacccggtgagccagtgactggcgtaggctttcaaacctttcaaaccacttctcctggagccccgtgttgtgtgcgtccctcagcccatgcaccccggaaggcacgcctcgcacccagctgtagagccccatgttgtgtgcacccccagcccatgcaccccggaaggcacgcctcgcaccgtgctcctggtggggcccgtgccaggggggcccaggctcctggggacagtggcccaggacttgggatgttagaaataaattttgggtgccgcaaaagaaatagcactcgaacataaatttaattttctcagcaaggcaattttacttctatagaagggtgcgtcttgcagatggagcaatggcgagagcacacctgaacgagggaggtggaggtctcatcctaacgcagccagtccctgctgctgtgtggttcccctgttggctagggttggaccgcacagtctaagctaattccgattggctattttaaagagagtagcagtacgagccggagtggcggggtgaatagtttgacgggaaggatggttacagaacaggtgactcaggatgactaagaacagagcaggtgacaaggatgactaaggtcagagcaggtgaccaggagtgactaaggtgaccaggggtgactaaggacagagcaggtgatagaggctaggcaggggttgtttactgaaactaggggcaaggatatgtaaagtacaaggaagttaaactttagaatgaagaacaaagaatggggatgtaaccatacggatacattgcttctttggagaggagctcagaattcattatacttaacaatttacaggctaaaacctttgaagaggaatttattatgttctacaggagcggtgccgctggcctgtggcttctgcagggacaagtagtggctgtggccgggaggcgttcggcagctgtgcttcagccccggccccagcttcagctcttcgagttgctggcttctctaaggcctgtcctgaagtggcctggagactgctgagttacttctggaatctgcaccgtgaaagtgaaacctggaccatgatgtgaggctggtgagagggtgccctctgccgtcacccccggccttgtagaaaactcattccaatggccctctggttctcactcaggaccaaatagtgatggttttttgtttgttttcgttttgttttgttttgttttgttttgttttgtttttttagacagagtctcgctctgtcgcccaggctggagtgcagtggcgtgatctcggctcactgcgagctccacctctcgggttcacaccattctcctgcctcagcctcccaagtagctgggactacaggcgcccaccaccacagttggctaattttttgtatatttagtggagatggggtttcaccatgttagccaggatggtcttgatttcctgacctcgtgatccacccacctcagcctcccaaagtgctgggatgacaggcgtgagccaccgcgccgggcccaatagtgatgtttttactgctctgggcctgatcgcatgcaccgttgtctgtgctgtgacttccgtcgttgtctgtgctgtgacttccgttgttgtctgtgctgtgacttccgttgttgtctgtgttgcgacttctgtgggatattcgttggagaaggagccacacagctgtgtgggacccggcactccttcatcaccatcatccagggccacggacaccccctctcacaagtcgctgggatatgaaattagggaataaatgggaattttcagtgcgatgcagctggcgctaggatcctcctcagtgtgacgtctgagaccttttcccagctggagccctgtcattcattcattcattcatcccatgccaggctgggcggctgccagaggcacaatccggaaccgccccttgctaatgggcggaccagtgaaagcaaagcgggctcactgtgcagaccaatgattgacagttccagggtgtgatggacacaggcggctgccaggaaggagccccttcagaagcagtgggcggggcggggtggggaaggccgtggggaggagtgacttccagatgaggctcacaggactgtacccggagggagggggcagcaaggaccctgtgggcagccgggggcacggcacaggctgtggctgtaggtgtgggtggtgcccaggcattgacagaggggagctcactggacggggcagcgtggaggtgagggtcgggtgagggcccctcgggagcccctggccatgttagttgcacatttcatgactctttaaggagttagtgaggcctgggtgtgacctatttcccgttccaattaaacaggtcattagtccgtgtcgtgctaaagcagatcactcgcaaggaatggaaaacccttgaaatacgttttttaaatcggtgaaagtgagaaaccgatgcctctgtgggaaaagaccagactccagggtctgcaccctcagagtgatgagctgcgtctgttaggggtgacctgaggtccctgctttgaaccagcttgttgaaaccggaagccatttctcatcttctgtaagagcctgcagcccctgtcagatgccagccattccccaggtcttgctgacactgtcattaggattcctatgagggccagtggggagacagctcagtctcggccctgcttccgaccccaccaccacccccaaatgcatactgctggcctttcctgggtttaattttattttgcagtggtagaggttgttttgctaaaattatttcaaaatctgccttgtggaaaaacgcccacgtcagggtgaccatctgtggtaaccgagaattccttggaggcagcgtcttcaccgcctggctaagcggatggcacaagctgccagccagacctctgtctgtccctgcccagaggccccagctgccccttcctccaggcacctccctgatctctggagtccaggttttgttcccaaggtcctacctttgtatctaaatgctgtgtcctctccccggacgatctcctccaggcactggctctcaggggccagctccccatgggcgatgatgtctctgatacaggaacttatgggtaccttgcaagtttgcacagaaagtggagcccgtctgttccttctggggtgtgcgagcggggcctcggggagcaggtgcaggacagggcacaggaggaacaggcacggctggtggtgtgcagtgaacagcagtggtcacaccaggtggtggctcccgtgggacttttgaggccggcccagccctgagcaggtggggtctgcagaggcctcgtgggttggaggagacttattcagagggagttttggtcttgctagaaattgcatgagatgaaagatgacattttaattctatcattgaggcatagtctttccaacacaccccctgaggtgtgagggaggctgtccctatatgatgtggtccccgctccttcaggctggggctcctggccagttcatctttcgtcctgtgtctgactttctctatcatttctaaaatgactaagacaatttattttgttaaaaaaaaaaaaaaaaaaggcgttaagatgattctactttgtagagggatcccaagggagcgtctcctctgggactggccctgtcccccatcttgttttccctctaaacgacatgtgagttcccaactcttgattttagttctgacaactggagactttattcccatacctttttaaaactttttaaaaggtttaacttcaaggagataccattccttttgtgtatttggttactaaagctgtcttgcatctcaaatgtgatttaagaaatcaagcaaaatgcactggccacgtcctctcagtagggggaggccagcgggcatctcccctcctcgccccttctctggtggtctcactgatgtcccccggcccccagccctccttcctttctttcccttgactttgtcctcagactccagggacaacccctggtgcgagacatcctgttgctgatttacttgttctctcatttgtttctgtgtttgttccatttctttcgttcattcattcattcattcatactcagctgcggagaccatcagccagtctgcgttcggcctgtgtctgccactggctgcagggcccggggcaaaggtcttcaagtgccctgggcttcagttccccttcctggagaatgagggtgggagagcacctcccctgggggtttgcgaagatgacatgagcccgtgcatcctgggtctggaccgcatctgatacttagcaggtacttagcagcaggtactgagtagacacagtgctccacagcaaagatgtgtggcagaggcgtagtggatgcgtgatcgagacgcacagtagacacgcaaggatacacggcagagatacgtggtgggtatataatggatacagcgggcgtggtggatttataacagatatgtagcagatatgtgataggaaccaggcatggtaatgacaagtcaggaatgtcacagaggactgtgtcttctgggggtcctggggccttttcacgaggaaggattgcaggtggggctttggaaaaattgtccaatttccatcccctgtctcctttccccggtcaccgctcctacccagtagcaggtggagaaggtgacttccatactgggggccaggatcaggagcagccacatgccagagcgggtaggcagcccctggtgcctgcctggccctgccccgacctccacaccagttcagccctgtgtcctgcccaggatggatgggtgggtaatttattgattcattcatttccagggtctcgtgtgggctttgtgaagcctagtacacgttttttattgcgttttttttgtttgtttgttttgttttgttttgtttttgagatgaagtctcactgtgctgcccaggctggagtgcagtggtgcaatcttggctcactgcaagccccgtctcccaagttcacaccattctcctgcctcagcctcccgagtagctgggagtacaggcgcccaccaccacgtcccgctaattttttgtatttttagtagagatggggtttcactgtgttagccgggatggtctcgatctcctgacctcgtgatccgcccgccttggcctcccaaagtgctaggattacaggtgtgagccaccgtgcccggccctcgtttttgtttgttttactttgttatgagtaatgatagatttctagaaacttcgtgtatttttttctccactttatttcaactttgtagaaagagatctaaaaatgcaagtctcctcccccaacccccaactctcctgcgtcacggattggttcagaaccaggagacacagggcccagaaacctaggggctggaggggccttaccctttggactcttgactgtttttatattctggcccctccccccgtctgtctctctctcaagagacagggtcttgctctgtcgcccaggctggagtacagtggtacaatcacggctcactgcagctgggctcaagcaagcctcccacctcagcctcccaactagctgggacttcaggcgcgcaccaccacgcttggctaattttttatttttagtagagttgggggtcttgatttgttacccaggctggtctggaatgccccaagtgattctcccacttcgcccgcccaaagtactgggagccaccacgccgggctagactgtggggtttttggggggcaagaattgtactcatatctctgtttccacagtgggtcttacactgtggacaaacagcagctgatgttctcacccggccttgttctaagaggactccaaaaagcaagtcgtagccccagtgactgggaaaggcttccccgggagagcggccgacacagctgccgcagtagtaagggtttatttatcaagactgatttatttatcagttcaagacacagttacacagagtgtgggggatggttcatcagcagctggcacgtccagtggcgcgtgtgcctcgggaaggcctgggagggggacacaggtgctccgcagggaaagctgcccccaccccagcccaaagaagccctccaagctccatcagtcatgcagtcatgtacttttcctcatcagcacaaaccccgcttccttgaagagaagcgtgaggctgggcacggtggcgcgtgtctgtaggcctagctacgagggaggatcgcttgagcccaggaggtcgaggctgcagggctatgattgcaacactgcactctggcctgggcaacagagaaagagagagaggactgtctagaagggaaaacagggatagcaaagtagatgggaaggaagggcctctggggcggcgggtgagtgctggccgctcccctctccacaagctgctgtggtctctgggggctgcacctgaggcggcagtgggaggagaggggtgaagggcaacgcgcccccgtttaaacacctcctggcctggacgccagctgttcacttgtaatcactggtcaccctgaagagatgggatggacccctgcccaacatttggctcaggtgtccacacagatgacagcaccgcacgcagacgggagggagcttctcaccacataatgaggttttctggggagagcaggggaggggggtcttccaggatggtccagaaaggtcttgagcgcgcctgtaaggagactgtctcggtttccgtggcggctctggggcaaggcggggtgagcaggggctgaggcttgcagggtttgaactttccccagggccctcatcacctcactgggatgtgggcgggaggggagcgggtcgtctcaaacacctccagcagtcgaacatcaaaaagggggtccaactcttggttgcgatttctttggctgaagcctggactcctagccccacgggctgagggaaggttacggctggtggttggatagacgccagtgcttgccccagagctgcaggggaagaaggtggcctgaacctcagggcctctgtgtccagttcaggggccagtacagcagcatcggtctgcgaggggtatgtgttctagaggagtgaggggacagacaggggagccccagaggcatccagtggctcgaatggtgggaagggccctaagaggggaggctgggaggggacaatcccaggtggcaggggatggccgcgatgaggccctggggtggagcccaggcagggagcatccaggggaagccagtgtgggtggggactgggaggagagagggaggctgggcctgccctggcgaggggtggtcagaacatcgctcggtgccagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcagggtgagtagcctttattcttcacacctcattacacagcacccaggccttttattcaggagggcgcggccggcctcaccccgacagccaccctggcttgttgaccttgatctgtgacagctcccctgtgagttcagacttctcaaggacgcttgcatagccaacattgttgagaacgagtaaccccttatcacagcacacgtctgtcgtgccatgaagcaatttcccatccctgtggctttgaaggcataagtcactgcgtcactgccatgctgttccttccaaacctgctcgtcaggagacagctcttgcgctgtgtaccggcactgccgcccagcaggtgaccccagcagctggtttgtccctgcctgggggtgagggcctgcagggtgtttgtagacgcaactcttgaaaggccctgaggttggggcttggtcatgagggtgcccggggcccatccgggagtagaagtaagtgcactaggcatttggccaagggtcacgttaggccttatttatttattttttgagacagtctcactcttttgcccaggctggagtgcagtggcgtgatctcagctcactgcaaccttcgcctcccgggttcaagcgattctcttgcctcggcctcccgagtagctgggattacaggcacctgccaccatgcgcagctaatttttgtatttttagtagagacggggtttcaccatgttggccaggccggtctcaaactcctgacctcaagtggtccacccacctcagcctcccaaagtgctgggattacaggcgtgagctgccactcctggccaggtcttttttcaaataaatgtctaagcaaaatgaatttggggtgaagtagtcacagagctgtcaggaggagcagggtggctgcgtgcccctgggagctgctgtgggtgatgaccaggtgatgccgggaaggtcactttcagacacatagttgtcatcgtcggatgagaattattctcaggtctcaggtgggaggggctgcccaccaggcctggatgaggccccacccccccacacacacatgctgggaccacgagtggcaccccctgaggatgagggggctcctgcgtttgtgccctgtgtgggaggtgccacctcatttgcatgtggcccttccacgtctcctggccatgccagacaggtcctcaggattgttgggagatgagggcctcgcccaggacttcgatggggtgtccccccagccccctgtggctgatggagcagcctgacattttgtggacacaaagccccctagagccagggaaggacagggccggacccagagccagggaagggaggtggagctccagccaaggcatccaaacatcaaaaggcagaactgagcggcttggtacttgaaaagtttttattaggaaaaatgccaaactgacagaagtagagagaattacatagtgaggcctcgtgcacaccctgcctggctcctggcaacctgcactccagccgatacctgtgactctcagcaagcccctctagtgggcgaggacctccacacgtgtcgccaggccaggcgactctcagcaagcccctccagtgggcgaggacctccacacgtgtcaccaggccaggtaactctcagcaagcccctccagtgggcgaggacctccacacgtgtcaccaggccaggtgactctcagcaggcccctccggtgggcgaggacctccatgcgtgtcgccaggccaggtaactctcagcaagcccctctggtgggcgaggacctccacgtgtgtcaccaggccaggtaactctcagcaagcccctctggtgggcgaggacctccacacgtgtcaccaggccaggcgactcttcagcaagcccctccacacgtgtcaccaggccaggtgactcttcagcaggcccctctggtgggcgaggacctccacacgtgtcaccaggccaggcgactcttcagcaagcccctccacacgtgtcaccaggccaggtgactctcagcaagcccctccggtgggcgaggacctctgcacgtgtctccagaggccaaagcagaagaaaacgttagcacaggagtcacttgacttcaccaaacgcagccaggattgcggtttctccggctcggctgtctcagttgtttaagagagttcatgcttttgagatcaaagttaaaagaaggcctgtgcctcgcagggcctgctctgcctcccccgtgtttcctcggggttctgcgtctgtgaccggggtgcggagcactggtgtgcagttctctgtctcgtgattcgtgtaacagtgagtgctgcctgcaccaacagccggctgccttccgtggctgtgtgggctcctgtgcggaggccgcccctctccctggccaagcaacactgaggcgggattgcgtcctccctctcctgaggcaggtcctgctccagacctgcttttttcccgcacgtcacgtgtcctgagacccctcagtggatgcgtcctctctccttccacggccgcacacactcccgtgcccgttgggctgggctgactgatgcatgtgggggctccgtcccatctttttcaactacagatggagctgcggtgggaaaacgtgtgcagatacctcccattttacttttgtgctggggcttttttgggatcagttcctagaagtaggggactgggtgaaaggctgatcaccctcagacaccgaacccctggaggaaacacagggagggaggatgagccctgcgaggtgcaggccttcttttaacactgaccttgggttctcaggactgccgaaatcccctctacccgggctgtgcctctccggcctgtgcctctccggcccttcggcagtgtcgagggagcccccaacacccagcagcatccagggatttcccccatggcagtgtcgggagcccccaacaccccaacagcgtccagggattccccccagggcagtgtcgagggagcccccaacaccccggcagtgtccagggattccccccagggcagtgtcgggagccccccaaccccggcagtgtcaagggagcccctggcagtgtcaagggagcccccagacagtgtcaagggagccccccaaccccggcagtgtcaagggagcctgcctccgtggggtgctgccagccttaggcctgggccagtcggggtggttggatgcctgttctgggggtagagaagtcaggtagcccagggcccgcactctcaatagaccttcagagaaaaggcatcgaggtaaatgccgcactcgagtacccgtgtgatctctgggtggggccatgatccttctgggcgctggtccaagcgcgtggtgaggccgtcctctcctgcagaaccccggcctcttcgcccctgcccgctcacctgttctgtcctgctcacctcctccaggaagcctgcctggccttctccatgctgatgggcgtggccccttgtccctgcagccatgcattgacctccgtggctcctggaggccaggccacgtcctcatcccctctgggtgagtgagaggcacagcctgggtgcgtggggccgtggcggctccgaggcgccaccgctgtgtcctctcatgagtgggtgccgtccaggtctgtcctgggctggctgcgaggaggaggttggcctcgcgcggccatgtgcgtgacagtggagacatcgccagcctcctgcttgcacagctgacggcagcccctctctctccagccatgtccccaggactcttgagtagttggcctggtggccgtgggagaagcaggccccgagtccccagggctgtgagcgaggctgtctgatgtgctccctggtcaccaccccctgcctgtccgtcttgcctgggcagatggaggtggatgaacttcctgcggccgctgtaacagtggccgccactggggggcttaaagcaacacgcatttgttagctcagcggtctggagggtgcgagtgcagatggagctcactgggccaaatttagtcaaggcaccagctgggtgggttctttctgggggctccagggagaccccgtttcccgccttctccagcgtctgaagccgcctgccccttggtgcagccctgagtcaccccagcctctgcctccgtctcacgtcaccgcctctgatacagccgcccccccatccctcttgtgaggaccccgcaatgacgtgggcccacccagatcatccaggaacatctccccatccccacgtccttcacttcatcgtctgcaaagtcccgtatgccacggaaggtgacacagtcttgggtcccgggacttgcatgtggggctgtctgggttttgcacagctgaccatgggtgcttccggatgcttggcattggaggtttctgtcctctgctggaaggattcctggagtgagggcagcagagggcacccagatggaggcactgccggacgcacaggggcgatggttggggggcgcctgggagccaccttcccttgtctctggggggtgacccttgaccttggtggcctcagttttctcatctgtaaagtggtgcacacgatacctgctccgtcctcctcactgaattgtcctgagatcaggtgtggtcgtgaatattaaacatgcggattgcaaccctagacagagctcccttggacggttgagcagatgcagccaggtgtgggtccggctgtgggcggagggggtcacacggggccgagtggcttcagcgagagtccataggacatggagagtcccggccgtggtgaggacacggggttgcggcagctcacgcccactgcagtgtccggaaggcggtgctaggtccacctcatttacggggtcgggctctcattctccccattgtacagcccagcctgtagaggcaggtgaggtccaggccatgggcctgtgggccgtgccacgtcgctcagattttgtggtgtcggtggtgggagccgccggggaaagccgtcatcctggagccgggcgagagagggccagggcagtggggtggactccagaaatgtccagtagcagaattgccagacctggccattggctggggtgttgagggagacgtctccagggatgtccagtgtctcccagtctgggcaagcggaggagccggccagcatgggccatttcatcggggccctccctgggggcagccaaggacctaaaaccaatgggtcccaaccaagaggatcccagaggtgagacacagaacggccagggctgaatccggggccctccctgggggcagccaaggacctaaaaccaatgggtcccaaccaagaggatcccagaggtgagacacagaacggccagggctgaatccggggccctccctgggggcagccaaggacctaaaaccaatgggtcccaaccaagaggatcccagaggtgagaaacagaacggccagggctgaatctgcctccagcgggggccccgggcgtgatcagagcaggcaggacctttcttccctctctgcagctccggcactggcttcctccgttcaggcttcatccccggtcagggggctcctggtcccgtggcagccccgtggctcctgggtcgcagcttcatgggggaaacagagactcctctggtaccagggtcccctgaatctccggagtcccccaagtccattgagtccactgggcccgaagagggaaacagagactcctctggtacgaaggtcccccaagtccctggagtcccctgagtccactgggccctcgacacccttgggtcacttgtccaccctcacaccatcgctggcccagggaatgggggtttggatcggccttggtgactgtgggcctctgcctgaaaccctgtgagtgtgggtggggtgggctgggtcctgagagagctgggagcagcggagtgaagggggctggggtggggctggtgacagtggagtccctgtggggggcagggctggtggacagtagagtccctgtaggggctggtgacagtggactctgtggggccagggtggggctggtggacggtgtagttcctgagagaccgagccggaaggtgagggactggaagcttgcacacgtccctgcggccttcccctcgggtgcgaggcctgccatcctgagctcccccaccctaccccgtgcccgccctgagggcgggacccaggccagttcacacagcatggcgaggtaagggctcaggatggaaggcaggaggaaagttgggcctgctgcacccatgggtattgcggcagggaaggcgaggaggagccgaggtgggtgctgggagctgtggggctggctgtgcgtgttgggcctaactcgggctgagctgaggttactgagccctcaggagggtgctgtgggaaaagaaagaggcagagaaggtgtctttggaccacttaggggacggggagggaaccccacggcaactgtgaaggtctggggcacagccagggagggtcccaggttgacagggacaggcggggtgggggtgcaacatggaggcctggggctgagcctccgagaagtgatgggcaggatgagggggccagaggggatcacgcaacaaggggtgcaccttggtggtctgggtgtctccagagaagctggttgtcaggactcaagaggcggacagggaggggctggggttagggaagagtgtgtggcagggggaggaagggagcctggttgccgggtcacctggcattgggagctgtcccctgcctgctgcgccccgcctgccattgttggagttctccagtctgggctggtctggatgaggaactggcggggctgctgccggcctggactcaggaccctcaccctccagcccgcaccctcgactccccaccagccagaccctctgtcctggtgtggacagcacccacatcctggctccacccttgtttcttgccctttgacctacagcctcaggacgtgcaggagggaggtacgtaggcacttgtgggtccggcctcctgaccgaccgtccatccaccaccaggcttctggatgttcacccatgtgggagagacgggtgtcggggaagggaccacagcttcctttcagaagacccgggaagggcagtgccgtgtgccagcctcccagttggcaccttcctttcaccttagtcgtcttcgaggcgatgtttcctcgggacaagtcattttcatgaatctgctgtaaaacgtctcccaaactccaagtgtttcccaaactgagtgaaaatcgctgcagaatgtggtttccagcagagcttttcccctctccttccttcacctctgcctgggttacagggtgcgggttccaggagtctgcctagaaggcaaaaaacaggctttgcttagaatcccctaaattgctcataaaacacagtgtttgacgtttatgtgtagacatgatccttatgtgggttaagctgaggcccctgccccagtgacacagaggcctcaaacggcacagtgcaccttctgtccgaagcagccggcgaggcggcccgcgaacctctgacgtgctccattgcaatgaggatgaacgagcctcaggcggagggtcagcctggaacccctgccccgtgaacaccagccagcttcatgctgaggacccctcagtccaacccagaggcccatgctgaggtcccggcatgggggactgtggggtgcagccgccgcttggagtggaggtgaatgggaccccacacgtttcctcctccttctctggatgcctgtaaccatcacagtactcaaacaaggaagaagaaaaaggtccttgaaacttgctggagttgcagttccgtttttttgtttgtttggttggttggttggttttttttttttttggagacagagtcttgctcttgtcgcccaggctggagtgcagtggcgtgatctcggctcactgtaacctccacctcctgggttcaagggattttcctgcctcagcctcccaaatagctgggactacaggagctcgccaccatgtctggctattttttttctatatttggtagaggcggggtttcaccgtgttggccaggctggtctcgaactcctgacctcaggcgatccgcctgccttggcctcccaaagtgctgggattacaggcttgagccactgcgcccggccccattttctttacatttgtgacttacagtcatcagctgaaggaaagacagtggcttggctagggcctgcccactgctggccgaggctggccgggtcacccaggtgcctgcccctcctgctctggagccgggcactgcctgagggcctgcagcaccagtcagggccccgggggatccctccagggtctcagttctgactagcgagtacctcgattcatgagtatgttttttaatgtaaggttttaacgtaaggtttaaaaaggcagccgccccgtttcctccccactggtctcgccttcagcagtgatttgtggtgactgtgacgttctcttcggtgggctgcctgtggatcgccaagtatgtgctcctgctgcttctacctgatgtctccccatcttgggctttgaggggggctcatccggggcattcatattttctgcccgagttcgctcctgacccagggcaggtggaagccagcaggtgaggaccagggtgtcagccagaaactcggaagtggcacagaggcagcatccgatagcccctttgtcagaggcgaccagggccttgagtgagctgggatggacttctcttatcctgacatcctggaagggggtgcagcctgcctgtctgtgtcccagttgagttggcaacattttttgtctttcctcatgatgcacgaagtagtggtatctctgagagccaatggcagcctagctgccgtggagaatgctggggagtgggtgagagttggggcacagaggactcatggggcagaggctgtggtccagtccttgtgggggtgactccagggatggcaggtgggtggtgtggccaaggaggagggaggtcaaggcactggtgttggggcagggagaagggaccgcagtgcccatgtgtttgagggaggggagatgatggtgtgggagtgtagagagggcggggccccggccaacagcatccatgccctggggattgggtgccaccggtcaagggctccacggggctggctctgggggagggagagcgggcgccatgttgtgtgtgtggtgcgtgtggcgcgtgggtgagggtatggccggctgcgtaagtttgtggaagcgttcggaatgctcaggagataaaaacagcagagggctgcacccccccaccctcccaccccagcttttctccaggaggacgctccgtcgtggcctgggaggacgtggaaggagggaccccggatgcagggcaggttcgtcttgtgtgttgagaacgtgctctccagggatctgtgttaatacaggtagcccaagcacagtgtccaatgagggaaggaacatttgaaacagaagagatgacttattttgttggacaaaaaaggaatatggtggacattaattcttagaagaggttttatttgaaacaagtcacaaaaataatcaaacagcaggttgactttggagttcagctcacgaaagttaagcttacagagcaaataaaataagctgaagaaaaagataagatgactgggcgcagtggctcacgcctgtaatcccagcactttgggaggccgaggcgggtagatcacgaggtcaggagtttgagaccatcctggctaacacggtgaaatccagtctctactaaaaatacaaaaattagccgagtgtggtggtggacacctgtagtcccagctgctcgggaggctgaggcaggagaatcgcttgaacccgggaggtggaggtggcagtgggccgagatcgtgccactgcactccagcctggtgacagagcgagactccgtctcaaaaaaaaaagaaaaagaaaaagaaaaagctaagatgcagcaggtggagccgcctgccgttgggtttcagcttttcttatggaaagaatgttacggcctgggtgcctccattctctgatttctttttctttcttgactttttaaaattgaaacaaaactccctaaaacatgaaatctgaagcgttcaactccacgagtttttacaaagcaaactgcaccgcgtcacatagctgatccgtgtgtagcttgtcctctggacgcggggccacccccacaccccgaggtgaccccaggcgtaacctacccgtccccggccttggtgcctgcagatagttttgcttgtttcgagcttttgtcttgggatccggggccatccaccctgggtgtggccgctcagtcgggcccctgtgtggggctttcccgtggtgtggggtgcggttctgccgtgtccgtccccactgcggggctgctctgctggctgaattctccacgtcttatgtatccaccctcatcttgcgaggcaccggggtcccggcttttggccacagacatccgagcgccttctgttgcccgtagcgcatctttcatgtgggcacacccaggagtggagtttccgggaaacagacgtttccctcgcgtggccgcaccaggtcgcactctgcactgtgtttctgcctccagttatgtggggttttctgcacccacagccactctggcgccagctggttgtcctgtgtttccattcagctctgacatcaattacctgacgttagcgcagaccctgcagatgaagggctcattcccacaagcctgcccctacttgagagccagctgcaagtgccaggtgacaacctggattctgaccaactggctgtgaatcgggggtgtccgtgaccccttcctgaggctcgggtgggctagaatagctcccggaactcaggaaaacactttgcttagtgtacccgtttattagaaaggacagccacacggaggagctgcacgggaggctgaggtatggggggtgcagagcttccgtgccctctccaggcacgccaccctccagcaccttggtatattcaccaactcggacactctccagaccatgtcattgagggctttttgtggaggcttcgtgacaggcacggttgattcaacagccagccactgctgattacctcagtctctcctgtctcctctctggaccgtgggctgtgggacggaaagttccaacccgctaggcattccttggtcctgctgaagaccagccgcatcctggagctgtccgggctcccggctccccgtcatctcattagcatgcaaaaagacactcttaccacactccaggattcctagggtcagaggggctgcgcgccgggaaactgagacaaaggctgaatctgtgttgatggcacagtcactctgggtcgtgtgggaattcccgatgcacctccttccagcacatggactgtcagagccctgcgttgtcgccagcacagcagatctgaaaggcactaggctgtggcctcgcgacggctgaggtgagctgcttctccgaggctcccgggttattggggaccctccttttaaaggtgcctgttccagtcttttgccccatttcaaaattgggctgtcaaagaacaatgtcattggggggtccgtcttttttgttggttcctgggggctgtgtgtgttttagagacaagtgctttgattttttgtgttgcaaacagcttctgtcactccgcggctcgccttccactccatggatggtgtcttctgatgaacagaaagtaaaagcttactttataattagggcttttgcgtcctggctgtgtgtggggcctctttctggactgatctgtcccctttgttttttgcccccatgtcgtactgttctgatttcttctgctttataatcaccattggtaacttgtgttatgagtctccaatttggggtttttagttttcaaggttatcttggttattggctttttacatttccatacacatgggcttgttaataagccatttacagttggcttatttgctttcaaaatctccataagacatttggattgcatttggatttcttgatcagtatgggagattagcatctttacaatactgaggtttccaatccgtgaacatatctttaggcctttgattggggtttttttggcaggggagttgcggggggcagacaggacctcactcttgcccaggctggagtgcagtggcatgatcatggctcactgcagccttgacctcctgggctcaagcaatcctcccacctcagcctcccaagtagctgggactacaggtgtgcaccaccatgcccagctattttggcatttttttgtagagacagggtctccctatgttgcccaggctggtcttgaactcctgggctcaagtggtccttctgcctcagcctcctaaggtgctgggattacagatgcaagccactgcacccggccttaaattctttcaataatattttgtagtcttgtgtgtagcggtcatccacattttttgttcaaatgattccctggtatttcagtgcttatgctgttttaagccgtattacttttacagtttttttttttttatctttttgtttatagcaatgtgtaaagaagtgtgattaactcatttgtcttggcctctcctggtccccgtagtttgtctgtggttgctccggaacctctctgtgcgctgccattttgtcagtgaccggctgtttgtttctgcctttccttcagatgttgccttgttaccctggcactgttgatccttccaaaacagtatgggacagaagtggtgacagccacatcctctcgtgcctgatttcagggaaaagctttaagaattccaccattaagggtgctgtttgcggaaatactgtttttccttcgtaaatccccaccaacaaattaaagaggttctattttattcctagttgaaagttgttaatatgaatggtgctgaattttttcagatgctttttttccttcatctattgatgtgacagaacttttctcctttattctgttcatacgatgaattctatggattggctcttaatggtagaccgatggcattcctgtagtgtgcctcgtttggttgtgatgagttcgcctttttatattttgcttgattcagtttgctattattttgtttgttgtttttgcaactgtatttatgagagagattagcctattatttccttttttttttttttttttttttttggagtctcactctgtcacccaggctggagtggagttcagtggcccgatctgggcgcactgcaacctccgcctccctggttcaagcgattctcctgcctgagcctcctgagtagttgggattacaggtgtgtgccaccacgcctggttaatttttgtatttttagtagagacagggtttcaccatgttggccaagctggtcttgaacccctgaccttaggtgatccgcccgccttggcctcccaaagtgctgggattacaggtgtgagccaccatgcctggccatatcttccttttgattgatgcttttatcatcatgaaatgtttttgttttttttttttttgagacagagtgtcgctctgtcccccaggctggagtgcagtggcaccatctccactcactgcaagctctgcctcctgggttcacgccattctcctgcctcagcctcctgagtagctgggactacaggtgcctgccaccgcgcctagctaattttttatatttttagtagagacgaggtttcaccgtgttagccaggatggtctcgatctcctgacctcctgatccgcctgcttcggcctcccaaagtgctgggattacaggcgtgagccactgtgcccggccaaatgttgctctttagatgaaaatattattgtcattaacatctgatctgtatgatgttagtgtgaccacaccagctctgtgtgtgtgtgtgtgtgtgtgtgtgtgtgtgtgtgtgtgtgtgatgaggggagggagggaaggggacttagtgtttatatgctctattttttcatcctttcactttcttttctgtatattttggaaatgactcttaaaagcagaagttagttatttttaatccagtctgaaaatggctgtgttttaaatgaaagatttagtccgtttacatttaatgtcattctgatgtgttacattgtagctttgtcatcttgctatgggtccttatttgtccggtctgttctttgttttgtccctctttcttgccttcttttggtttaatcagatgtttttattccactttcctccctttattattatagctttgttaagtaatacttctcttaatgttattttaatggctaccttagaaattatgagtcacatccttggaacgtagcataaactacttttaccattttcttcaaaaccttataacagtttaattcttattttttccttttttttttttttttttgagatggagtgtcactcttgttgcccaggctagagtgcaagggcgcgattttggctcactgcaacctccacctcctgggttcaagtgattctgctgcctcagcctcctgagtagctgggattacaggtgcccaccaccatgcccaactattttttgtatttttagtagaggcagggtttcaccatattgaccaggctggtatcgaattcctggcctcaagtgatctgtctgccttggcctcccaaagtgctgggattacaggcatgagccactgtgcctggcctaattattcttctttccttattgttagtttgtgctattattttatcagtctttgtgctgttattatcatgcctgtaaattctacgtgtatttcagacccacaaaccaagtgttgtcttagacagtggtccttcagatttacccccaggttacccttctagtcttcctgcaggacggcgcttacatggagaccagcttccttctgcctgaagtagtccctttagtattcctttcagcacagacttgtaattaattctttttatttcttttcttttcttttttttttttttgagatggatttttgctcttgttgcccaggctggagtgcagtggtgtgattttggctcactgcagcctccacctcccaggttcaagcgattctcctggctcagcctcctgaggagctaggattgcaggtgtgcgccaccacgcccagttgttttttgtttgtgtgggaaatgtctttggcattctttctggagggtgttctccactctgtgtggagttctaggcaggtagggggtttcccccaacaggtttttgtgttggcttggagtgttggtcatttctgtggtgagggcgccttccagcctcactgccacccctggaaggcaacatctcttttctctgactcctgttaaaagtgttttcatcacaacagcagccttgtgaaggacagaggaatcgagaatttctcctaattgagattggtagagcttcttgaatcagggacatgatagcttttgtctcttttggaaaatatcagcccttgacttttcgtttttttttttttttttttttttttttggagtctcgctcttgttgcccaggctggagtgcaatggcgcgatctcgactcactgcaatctccacctccccggttcaagtgattctcctgcctcagcgtcccgagtagctgggattacaggcacttgccaccatgaccggctaattttttttgcatttataggagagacagggtttcaccatgttgaccaggctggtctggaactcctgatcatacatccaccttggcctcccaaagtgctgggattacaggtgtgagccaccgtgcccggccagcccttggcttttcaaatagcatcctgttctctctcccctgggacccccacacttcacacctgtgtgtctaatgtgctcttttttctgggtttcttctgcgttggttttttcccgctttgtgcttcaatgtggatttttttctactgttatctcttatttcacccaatctactcttaaatctaccctttaaattattaatttcagtcacttcattttttacttttagaatttccatttgattcttttttttttttttttgcccaggatggcaatggcacgctctcggctcactgcaacctccgcctcccaggttcaagcaatattcctgccccagcctcccaagcagctgggattacagggtcacactaccacgccccactaatttttatgtttttattagagacggggttttgccatgttggccaggctggtctcgaactcctgaccttgggtgatccgtttgcctcagcctcccaaagtgttgggattacaggcgtgagccactgcgcctggcatcgtagttctctcttctggggtgggaatgtctattctgtgtccttctcacgtgcaaaatactgtcattacatcccaatggccccagaacccttaactcctcccagtgtggcgggggcagtcttgtctgaacaaggcatgggggagcctggaggcccattcctcctgaggccaagttcctccctggctgtgggccagcataagcgaacaaggcgtgtacttccggaatgctatggactgagtgtgtgtctccccagaatccatatgttgaagccctaaccctccagtgtgatggtgtttggagacgaagcctttgacaggtagttagagtcatggcggtagttagttagagtcatggcggtagttagttagggtcacggtggtagttagggtcatggtggtacttaaggtcatggtggtagttagggttatggtagttagggtcatggctgtagttagggtgatatcagtagttagggtcacagcagtaattagggtcatggtggtggttagggtcacagtggtagttagggtcatggtggtggttagggtcgtggtggtagttagggtcacggctgtagttagggtcatggtggtagttagggtcacggtggtagttagggtcatggtggtagttaggatcatggctgtagttagggtcatggtggtagttagggtcacggctgtagttagggtcatggtggtagttagggtcacggctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatagttggggtcatggtggtagttagggtcatggctgtagttagggtcatggtggtagttagggtcacggctgtagttagggtcatggtggtagttagggtcgtggtggttagggtcatggtggtagttaggatcacggctgtagttagggtcaaggtggtagttagggtcacggctgtagttagggtcatggtggtagttaggatcatggctgtagttagggtcatggtggtagttagggtcacggctgtagttagggtcatggtggtagttaggatcatggctgtagttagggtcatggtggtagttagggtcacggctgtagttagggtcatggtggtggttagggtcatggtggttaggttcatggtggtagttagggtcatggtggtagttagggtcatggtggtagttggggtcacggctatagttggggtcatggtggtagttagggtcacggctgtagttagcgtcatggtggtagttagggtcatggtggtagttagggtcatggtggtagttagggtcacggtggtggttagggtcacggtggtggttagagtcacagggtagaacccttgtggtgggatttgtgccctttataggatgagaggatgagacacaagagaggttgtgctgcgcctgtgctctctgctccacatgagaacatggtgagcatgaggccgccagcaagcaaggagataccccgccctgcaggttccgtcatcctgactccagcctcggaaacatgagaaagtcaatgcctgtcacttaagccgcccagtctgtggtattttgctgtggtggctgagccgacggagacagttccataggtcttgattgtcctggtggccctgaaccccagtttttgtctccagtgagatgcctggcccggctttctgtgtgacctccgaagggtcagcagacgccgtgcatgtgcagggcttgggtggcgcatctctctggcaacaccttctcttctgacgcacttgtctggtctcggatgcctccaacgcggtttttacttattttccagctttcgtcgattgttcgtgggaggagggttagactcctcgcgtggcgtccctggccacatcctcagcgctgtgtcccctcgcagctcagttcctggttctgagttattgtgactcagccgcacgtcctcccaggggccttgccagcctggctctgtgccgggcgctgggcaatctctgcctccagcctgggcctttgggtctgtttgagggtgggggacacggagctcagcagtgaggaactcggagcagcttcttgttgttggtgttgatgtgttttgtttgttttagtgaatccagaaaaaaaatttcttacatagaaaggagcggtatttggtatgaatttatttgcaactgactgcttggaagttggcgtacatctttccacggaaactatgaaaatactggtcagcctctcagtcatttcataaaatcttgattttgtattacaacaaattaggatattttcagtagaactgattgtaaggccagactgttggaatgtaattccttcccaaacatctctcaggggcactttcctgaacggctgctgacagcagcatttgaggacggtggggcggaggacatcctggggggcctggcttcttgggaactggaggctttggcccttgtcccacccctgctcccctgaggagggaggcgtggggccctgggctggctgcaagacgtggagtgactgtgggtccccgtggcccctgacatgctcccagggaacccaagaaaagactgagaccctgtggtgcctcccgctttccatccgcattccatggcaggtgagtctgattattcgaaggaggctggagtgtgggcggagggcagcgccaggtttcccaatcagatttgctcagggtccctccagcagtccatgccgcagaggctgtcccttgggggcccacgcatcctagccacggcctcctcacgtccatgcggggatttgcgccctggaaggagccgcccggctgcctctcgccaacatgcagcacttcccttcctttccatggagcacggttcctgtcccgggggtccatattggccactgtgggagagagtcgggcagctgaattcccgcaggtgggaatgccagggcccgaggatgttgcccctgtcctgaaggctgtcgcccgatcgctctatccaaggctgccctggggcagcgtcacctgggggtcctgcgggggcttctcagcacagcatccagcactgccacctagtgtgttcccgtcacgtctcctccccccgcctgcaccaggcaccagagacccggatgccaaggcctgtcagcttcctcaatgggaaacttttcttcagtgaacaaagctctgttttatagactttttaaattttcagctcaaaaaccaaagtctgccagtgttggtggccttggagggctggtctgctgccctgggctgcaggggctgcccggctggggtcgtggtcggggcaggtgccgcccacaggttgtttggctgcaggtgatgggcaggtcccccatcacgtgtccagaggtgggtgctgctggtgggtaatccagctcattacctgtctccccccagccgccttgggctggggaccctgccccgccgaccctgccatgcccacccccctccagcctgattgcgtgtctcagtcacatgaccgccctgggcccgtgatgtcactgggaaatgccctcgtttgattggcttagaccccagatgaacaagcccaaggtcttggggcatcagagccacccatgagggcagctggatgcagcggccacagcctgtggttggggaatggcattgcgcagctccaccacgaggggacctgaggcttggactgtgagactggcccaggctcgccacttgcccctcacccggggttgccttcccgagggccgcggacacctgagcagtccccatgccactgcattgtggcagggacacggccgcccatccctcctgggtcccttatccacctgcctgtcccttcgtatcactgacaccctgatacccattgtgctgcgccgtgtggcccggtgcccacagggccgggttctgcctgttcctgggggtccgtgtgtcccacgtgcctagacgtgagaggacggaagtcggcagagcttggctccctgttcgcccgactggcgcctcggctgtgcctcttctgtctctcgagctcttctgtgccgtgtggttgcactaagcagctgtggggaagggggaggttgttgcctcagtgggagcctgggctgtggctgccagtccccaaaacagaccctgcgccccgggcaaccatctgcttcccgccacagtggtgcccaaaaccttttccaagtcgtcttctgtgactttagtgttattcttcagtcacctttaaaagcatagcatgttttcaatcacatgttcagctgggaaatagatctgtggttagaaacgggaagtttgagttgcaggcttgcgatccgggcaggtccctcagatggaggggctgcacctccactgccccccccaccgccgcccctgccccacggccaccccagatcctcagacgcccctccctgtgccttctcaccctctggtcctggctgggcccgtcccgccccacgtcccgcctcccactgccctcagcctctggaacggtgcctgcatggctggcactatccagcgcagaaggaatgaaggacttctgttcagacagctctgctgggagcgttctggcctgaaatgcagtgggagctctggtgcaggtgtagccgaggctcaggggctccacaccaggcaaataggcgaacggcgtctcccgcggctcccggtggctttttaggactctgcgttcgtgttctccattgtccctggcagcccctggccagggtggcccagtgcccactatagagggtgcaggtcagtttgtggaccaatggccaaccaggctgagtcaggtgaggtggggagtcccaccccaaaccccaaactccagtgtctgggccacgggcagccctgggacaccttagctctggacacgaatttgcggtcattgctgttcttgtgtctctatttgcctaggacatgctggcagctaactgggtgctggggaagcctggagaggaagccaggtggccccaggctcctggagctcagaatctagtggaaatcgctgcccagggaagaagctccggagtctagaggtggcagcacccattttacctgcaccctcagtgacagctgcaccctggcttctggggacctctgggcccaagggcacctcactgtctccttgtcctcctggtcactgacctgggccaccatagaaggcacctggctatctgcatgtggcttgaccactgccttgcacccatccgggccccgcagggccgtcctgtggcactgctttgggctgtgctggtcaccctgtgtagcggggccatgtccagtgaacaggagaggcctcaagtgccccctgacctgctgccagggactcggcccctccctcaccgccaccgcacccaagggctgtcgcctgtcccagcctgctgctccgagtttagtgttttaaaacgtgttttctacgtcttgtcagagtgctcaaggcgcgagattgccatggaaactgagctccttagaattcctgtggccgtcctaattatagaatctcaaagacacgcacagagctccttgaggttgtcggagttaaggctgaaagaggaggagcggcccctgtgatccccacaattttgttccctgcttgcttcagcagagcctggcacccagggaggtggcaggatgggtccccaatgggcacgtgacatcgagccagctctgactccaaagcctgacccgtgtggctgcaccgtccactgtgcgctgtccactgcaggagaccccaggctgtgtccacacgtacccccggaaggacctcctgctaacctgggcttgactttgagaccctgttccacagaggtagccgggggactcgcggtgccaggcccacagcctcctcgccggtagtatctgggggccaggggccgtttccagagcacactccccagaagggctcccttctccttttcacagcgctgtctgtcgcttaggtcagaaataggcccatcgctttccaagcagaaacccaaacactgaaaattcgactgtgacttttgaggggtggggaccgccaggtccccccaacatccctgcccgcgggcccagaaaggcagagtggctgccggcccgcgtgtccaggccccttacactgagggaaccttctagtcaattgcctgaagttcgaaggtttggggggtttttgtggttgcttccgtttgttttggcagttgcagaatcccccgaaaaggtgggaatgtggatttttcaaggcaggtgctcctttgattcagaagctaaggaggccctaagtgcagtctcaccttgagaaaaatatcaggccagtcctaacggaggggcgtcctgcagacacccagcctgcactcagaactgtcacggtcagaaagcacggtcagaaagtctgagaaagtcacggtgcagcagggcccgagaggcaagacggtgacacgtgggctcctggaagaggcaggatggtgacacgtgggctccaggacaggaccctggggcggacgcagacagtgggtgaaaaccaaggaaaggtctgaatatcgcttaaggtagccatggatcctgtctcattaattgtaacagtgtagcaggcgggtggaagatgagagctgtggggagccaggcagggggggtctctgggaactctccaatttaaagctgttcttaaaaatagtctattaaaaaagacagttgagggcggccctgcctacagctggagttgaggttctagcaccaggcttcctctcagcctccataggcgagtagggaccaggcagggccttggccacagggaggcttctggttaccaggttctccacagcctttgcagtttccctgtgaatctgaaattacccccaaataaaaaggatgggtttttttgtttgtttgttttgttttgtttttgagacagggtctggctctgttgcccaggctggaatacagtggtgtgatctctgctcagtgcagcctccacctgccaggctcaggtgatcctcccacctcagcctcccgagtagctgggactataggtgcacgccaccacactcggctcattttttatattttttttatagagacggggtctcaccatattgcctaggctggattcaaattcctgggctcaagtgatccacctgcctcgacctaccgaggtagtggggttacaagcatgagccgccacgcctggccaaaaggtgtatttgttaagtacaggctgccctgctgtccgttatcccttataactcacctggtccctgctttccagctggggactggcatggaccccatggggcttcccccatttcactgaggcaagacccagatgctgggggtattgggtgtcctgcccaaccagggtccccagggccaggggctcctggcgtgccttcccgtgggactccgcatggggggctgggagggcgaggaaaatgggaaacatgatgcctgcccaaaactcccacctcggagaccctgtgccagggttttccagagagaccaaaccaatagggtgtgcgtatagaaagatctattgtaaggaactggcttgttcatagagacttatgaagcccaaaatctacagggggcccagcaggctggagacctaggaggagccacagccgcagcactgctgcttagggagctcagcctttgctctgtggaggcctttttctgcttgggtgaggcccacctgcattgtggtgggcagtctgcttcccccaaagtcagctgatttaaatgtttatctcatccatactcaccctcatggaaacatccaggataacatttgaccagccgtctgggcaccatggcccagccgcgtggacacatacagtgaaccattgcaggcccttccttggcacttggcatccacgcatatccccttaagccacactcagtctccacacagcagtactcccgcctgacacactcggtctccacacacagcagtactcccgcctgacacagttcgaccctcccgcaagcagtgccagcacacttggccttcccagaagagggccaccatcatgggctcggaccttccagctggactgcagtggggtggggcgtggcctcgcctctgtggtctttgggtcacttgaatccccgcctctcactcattttcctttggtatttgcaaatttgtccccgtggcgcctggagctgactgccgggtgccacatgtgtcctgcctcaagccaagctccaggcggcacccgtgagcaggcagggatgccagtggtttctcacctgggagtttctttgcaggctcagagctctttgttcctttttaaaaatctgatttgaaggccgggcacagtggctcacacctgtaatctcagcactttgggaggccgaagtgggcatatcgcctgaggtcaggcgttggagaccagcctgggcaacacaggttggggcaactcccttccctaataaaagttcaaaaccaacccttaaagtttaaaaagtgagatgggatatttgaaggaggcaggtctgagggaaatgcttgaaattatcctctctgtccctgtgctgccaggtcatttagttccattgttattcaacataccatttgacacatgctaggagcgcaggactcggcaatataaagcgtggtaatcgatggacactgcccccggcagccagccaggggcaggacttaagccccacccaactgcaggctgtcccccgccgctgctagcctgaaattggattggttactgctgcggcctgaaattggattggttatttgcttactggaacatttttgtcacatgactgtgtattctaaaacaagatgttgtttttgtttttgagagagtctcgctctgtcgcccaggctggagtgcagtggcgcgatcgcggctcactgcaagctccacctcccgggttcacgccattctcctgcctcagcctcccaagtagttgggactacaggcgcccaccaccacacccgactaattttttgtatttttagtagagacggggtttcaccgtgttagccaggatggtctcgatctcctgaccttgtgatctgcccgcctcggcctcccaaagtgctgggattacaggcgggagccaccgtgcctagtattgggtttgtttgtttgttttttgacttacttgtttggttctatagcaatggcaccatgtttctgtcaccctagggtttgatttttggtgtttctaagacacctctgggccactgcacatggctgaggtgggcttcgcactggctctgtcttccgttggacgcccacacatcggtttatttatgcattctcttgtccacagaccttgaggtcatcagacatcttgaatgctcccgagcccaggagcgagcgtttctgagctttgacggagcagcagtggggctgccgggccctagggggagcaaatggtcctcgtttctgagctgcgaggctctcccagagaataagccatttctccggggcactcctgggcctcgaaggtgtttggggctgcgggggattgatttgtgccgaccccgcagtgtaggagacgcctgggcggccttgcgggttgcttcgatggttctcggggctgagatgcttgtgtctctctcgggcgagacgcctgctctgggcttctgttcctattttgactgctttttcctcatggatttttcagtccagcatccctagccacgggccctttgtctctcatgtgtgcaggtgactcacggtgactaaaatcttctgtaattccttctaaaatgttttgccgctttgctgtccacgtttccacccttagtctctgaggggcctagtgtgtgtatggtgggaagcggggtcagcccccgcctggaccgctgtgacagaaccccacagacagggtgacttacacacgacagaaacgtcttttctcaagttctggaggcgtggggaccccatctccaaatacagccacattgggggttagggctccccacgtgaatttaggggacacttcagttcgtcccggcggggactggggacgccgggctgtgtgctgtgtcctgtgggagagtttgttcaccctgctggaggctccctgatgagccctggcgtctgctaggacgtcattctctttactgattgaactcgaaggatgtccagttggcgcattttcagggtttcccaggcgcactgggggtgggtcctgtgtgtccccgctccagccagcttcgacccccagctgtgcgtcagtccctcagctccgccccccagctgcgcggccgtccctcggctccgccccacagctgtgtgaccgccctgcggctccgcccgcagctgcacgttcgtccctcggctccgcccccagttgctcgtcggttccctcggctccgccccctcggctgtgcgtctggccctcagctccacccccagctgcgcgtccgttcctcagctcagtccccaagctgtgcgtccttccctcagctctacccccagctgtgcgcccgccccttggttccacccccctccccagctgtgcgcccgccccttggttccaccccccccagctgtgcatccgtcccttggctccgccccgcactgtgcgtccatttttgactccgcccccggctgtgcgctcatccctcggctccgcccccggctgtgcgtccgtccctcggttccgcccccggctgcgcgtctgtccctcgactcggcccctcagctgtgcgccactttctctgtggcccacagtacctccgtctccgccgcttcacacccttctctttctttctctcttcagagagggttgttgggcaggcagagcatcccccgaggggacaagtcaggcctacggactcctggagccaggacctgccgtaggctggttagggcaggatgcgccctgtcttcgtgggtagagccacatgggggctcacccgaccccctcagggctgaggggcacaggggccgaaagtgtggccgcccctgggggtctgcgcctcttgtggagcccaggcctggcgcccaggtgggtggagtgtggagggggcacaggctgcacgaccccagcctggcctcgggcttgctgggagtcgcgtctgtggccggaggggcctttggtgtcaccaggcctctgtcaaaccccaagccgcatcctgggagggctgggtgggctgagccgcccgctgccgtgaggcctctttgacctgcgctcctggaggacccctgacttcttggtttcgctctgaatcttccatttaaaggaagaggagcaggttttaccatccgtgtggcctgatttcagcagtttccagtcagggctagtcatttgcttgttttaaaaacattccgttacaatttccacttcagtatatttgtggcactttcatttggttcatgaaagtcgcttttatgatggaattttataaaagcacaaagcttcccattgtacgttccgtttctgaagattctgtttacacacacatccgtttcaaagagttttggaggagcaaagtgggacacggtgttgaggaaggacaagaccagccgtctggttacaggcttggtgccgcctttctcataagaggcacagtccgcatgggctggactgtcaaatgcatgttataaagatgatgtttttggtaacttgcgaatggaaacgggtgcacggtcggtttggctctcctgccctgagatttattaggttaaaggaaactcgactggagagcccggggcctcgcgccgcttgcgtctggcgagttgttgaagtgaagtcagtggcgctctgcaccttagcctggcccaggctccactgtggcgtccactcttcctcctctgacagtcatgtgtaaatattgaggcccgtttgaactatccctgtgcggaaaaaaaggcctgtttttcacagggctgcctggggaggaggggggtggaaaggaaaacaggcaggggacagacggacccggcctgcgttggcctggggtgacttcacggctccactgtcagcaagcggccgtcccgtggtggatcctgtccgccctgcgaggacacctggctccatccacacctgggcctctgtctccagccgccgaggccgtgacaccatgaggatcatgtgaggaggggcagagagaggcctccgggaggccgtcattccagccctgccttccctgcctgggaggacgctgcggccgccaccacctggacgggagtggcctgtcgcagctgcaccctgcgtgggctcgtggctgccacgctgtttctttacacctttctcatatcctttccagaatctatctaccgccggggagccagaagatggaggaagctgtaccgtgccaacggccacctcttccaagccaagcgctttaacagggtgagtggcccccttgggactagtccctcaaggggccttttgttacttttaaaagcaaagagagaggaggggaggcacgtcccgctgagcccaggctgggctctttttggcgcccgagggcaaggttacagaaatgctttctctggtgcaggatgaggctttgactagggctgtctgaggcgggaagtgccctccgggcctttccctgcgtggtggctgcccagtgaatgctgtctgtgtctgcctggctgtgtgactcttatcagggctcagggctcactggcctgaggccccagcctgcctgcatccagagtggggcggccgcattccatccgcatgtagcgccagggtgtgtgttttcagccgcacacagtgttgcctagtagctaagagtctccgtgaaccctggaagctccttcagccccatccctgcttgggcctctgtcttcccagcggccacccacgggggccctttccagaggacacttagcttattttccttgtttctctttatgatgcttttctagttcctatgaaatgggtgattcagatgcttttgtaattgttctgtttcacagtggaaggggaggtgtctgggtgtgccttggtggccctggagttggtcccacacagggagtgtcttgggggtgcgtggaagtatacagggcctgtccccactgcgggactccacacagagcccctgacagcccctcacaggagcggtggccctggggctacctttgcattccacactcacctgccacgtggcctcacgtgtcaacctccgctgggtgtacggcacctctgtctcctggagcggcctcaagtcacctgcccctccttctactcccatggtctgccctctagaccatcaggaagttctgttcatgtgagccactcctcctgcccctgcgtgtgctcggtccctgtcatgtggcaagagtgggtctggactcccattcctcttggggctaacacaggtgaggatgcaggacaagctcctgagtgactgaagaggggtgtggtgggaactaggctccaggagatgagcaggtcagcactaggaagacctggacattgcctggagagcccagaggacttcctggaggaggaggcatctgatcatactgcctgggaggtcagtgcagaggagatgccaggagcaccgaggatgtggcaggcacgggagagtccagccagtgtctgggaggccctgaggacgaggttggggacaccaggaaatggggagcctaggcggctgtgtgcttagggcaggtgggtgtgggtgaacaggcagtttggctcaggctgggactcaggagagtgtggctggaggtggccacattgggaatatctgtggagtatggtgccagggagtgttgcagcacagagatcccgtccgcaccccagcccaccctggccgccttttctgaggacacacgttgtgagtcttctggggctgcagaacacagcaccactaactggcagcttaaacaatggaaacttgctctccggcagtctggggctggaagtccaaaacgaaggtgtctttatgagtcagggttctccagagggatggtaccaatgggatgcatgtacatgaaagggagttgattagggagaactggccctcgggcgcacaagacgaagtcttacgataggccagctgcaggctggggaagaaagaagccagtagtggctcactccgagtccaaaagcctcagaagcagggaagccgacagtgcagccttcagcctctgccagaggctccagagcccccggcaaaccactaataagtcccggagtctaaaggcccaagaacctggaatctgatgtcccagggtaggacgagtggcaggaagcatccagcatgggagaaagatgaaagccagaagacccaggaaaactgcttctcccacctgcttccgcctgctttgccccagccgcactggcagctgattggacgccaccgcccacccacattgagggtgggtcttgccctcccagtccactgactcaaataccagtctcagggcagcgccctcatagacacacccagatgcaatacttcaccagttctctaggcatccttcaacccagtcaagtcggcgcctggtgttacccattacagtgccgcagggctgcgccctccttcccccgcagccactggtagctgcgggcagccttgttcctgtgctggcagaggaaccactcacctctgtttccgtctccacatggcctcctctgtatctgtctcttctgtcattctgcatgacggattagcccagagtgaaccctacccacccagtgacatgggccagggctccgggcagcacagggtgtggcctctcactgtgcagctttgaggagaaaagtccattctgccgatggcaggtgcagaccataagtgaccctccccctccccaccaccaccagtgagcaaaagcttttcctttccttcctgcagacactggaggaaagggtggcaggtggacccaccacagccccgctctgctgtggaggtacagcccttctgggcgtgtgaacgagccagtttcacaaacacagaggccaaggcgagagtggcccgaaagcctgcaacctgactgctcagggagggcggctgccctgcagttcagcctgtccgattcccgcctaattgtgcccgggctctgatctcgccacctgctcgtaacgttctctgtccggacctcagagccgctccatgtagtgctcacttcatgttaattgcaggaccactcagatcacctctgctgtcacttaaaaggggcatttcaggaggaaagcacttggttttgtgtgaatcagtaagacttaaaggggaacaagcacccaggagaagagagacttttccgtcctctttgttggtgaagcgaggatgaaagagtgggcatccgtcgctggggactgggctccccgcccagctctttctgtgcacttgaaagcactgcccttggactttgagaaggaagcgttcagtgggggagccaaagggagagagccagcgaggttctgaagaaggaggtgaggaggggctgcctcctccatgaaggatggtgccgggggtggcagggaagcccactcagtggaacagaactgctgggtcagagctggcccagggctgagcacttcttgcagaggagggaagggatcctccagtaaatcctgaggaggtgattggttaattatcagcccaggaatggggggtgaggtgggtaggaatccaggctgctggctcccatcacagtaaacggcaggtggattgaggttaaaaaaaaatcacagggcccggcgcagtggctcacgcctgtaatcccagcactttgggaggccgagatgggtgatcgcttgaggccaggagttcaagatccatctggccaacatggtgaaacccatctgtactaaaaatacaaaaattagccaggcgtggtggcacgtgcctgtaatcccagctactcaggagtctgaggcaggagaatcacttgaacccaggaggcgggggttgcggtgagccgagattgtgccactgggcgacagagtgagactccgtctcaaataaataaaaagaagaaacctagaagctgtgcagatctctggagaaaaaccgggcagtgaggaccagagggtctttagactcagccacacagaattttcagattttttcagtttccaaattaaatgcaaaaaacatacaggaaaggggtttgtagcacgtaaaacccagaagagatccagacatctcacacttagaattgaagagctcctacacaaaggcttttggtaaatgctgggaccgagaagctgagaaccggtgtgaatggttaatgaagtaagactgtaattgtttagagatgaggacagcatgacctccacaggtgatcagggaaacacaagacattttctctgtcaacatcaaagatgttaaaagtaattaaagccggccgggcgtggtggctcacgcctgtaattccagcactttgggaggccgaggtgggtggatcacgaggtcagcagttcaagaccagcctggccaagttggtgaaaccccgtgtctactaaaaatacaaaaaaagtagccaggcgtggtggtgggttcctctaatcccagctactcgggaggctgaggcagagaattgcttgaacccgggaggcagaggttgtagtgagccgagatggcaccactgcactccagcctgggcgacagagcaggactctgtctcaaaacaacacaaaacaaaaacaaaacaacaaaaaagtaattaaagcccagggttgctgtcatggggtctgccaaccctggggatgtgggacaggcatggaccctactctctggaaatcacgcagaaatgtgcagcgatgttcccatcctgcctctcttcaaaagaaatcacccgtcattcggaggtttgtgtatggggaagatcagctcagcattatttttacaagcaagagtgggaatcgtgtctggagttagctactccctttgctgtgaacaacccactccaccacgtggggtataaaccatggtagggccacgtctctgagctgtggctgctggagagccctctgctggtggcacatagggcacaagtgccgcagggacagctgggtggatggcccaagactttggcctttatcatgagtggacagaggagtgaccacttgggtccctggagaagaggctatagagagtgagggtggggaagggagatcagaagatgccatccatgagcagcagtgcctgtcaggtttggtccaagcagtgccctcaggtggctggcagaggccaatgcaattccttttcaagccagcatcaaagaattcctgatgataaataaatcaggcatctgagctcgcaatggaaaaccacaaaacacagtgggaagcaggatatcctgagtccaagctggtaaaagcccagacagaggctccaaccatcagaataggtaagggtgtgacaggtctaaaacatgaaaatgggcgattgaaaatatgagcaggaggccgggcgcggtggctcacgcatgtaatcccagcactttgggaggccgaggcaggcggagtgcctgaggtcaggagttcgagaccagcctggtcaacatagtgaaacactgtctctactaaaaatacaacaaaaatttagccaggcgtggtggtgggtgcctgtaatcccaggtactcggtaggctgaggcaggggaatggcttgaaccagggagctggaggtttcagtgagctgagaacatgccactgtactccagcttgggtgacagagtgagactccgtctcaaaaaaaaagaaagaaaatgtgagcagggaggccaggtgcagtagctcacacctgtaatcccagcactttgggaggctggagcgggcagatcacctgaggtcaggggttcgagacgagcctggccaacatggcgaaactttgtctctactaaaaataaaaaatcagccggacgtggtggcaggtgcctataatcccagctactcaggaggctgagacaggagaatcgcttgaacccaggaggcggaggctgcagtgagccaagatcgtaccactgcactccagcctggggaacagagcgaggcgcgaggctgtcggagggagggaatatgagcaaggaacaagttggcagcatgtaagacgtacttaaaacgtttttacccattaatctatgaattcctctgagtttctgagaatggaaacttggggtttaggttttatttttttaatgtcacatttcctgaaatgttactattcaaatatagatttgaaacaagagcttttgacagagcttgggcagcctcacttacaaagcacacacgtgaggtctctgtggtgggtgccaacccttggcagattcacactgcccttgtcagcagatgtcctggcctgaccccaggtaagggtggctccccacggaaaggaaccttggtcaatttgttttttgtttgtttgtttgtttttctttttcttttttttttttttttgagacacagtctcactctgttgcccaggctggagtgcagtggcgtgatcttgactcactgcaacctctgcctcctgggttcaagtgattctcctgcttcagcctcccgagtagctgggattacagatgtgcgccaccacgcccagctaatttttgtacttttagtggagatggggtttctccatgttggtcaggctggtctcgaactcctgaccgcaagtgatccgcccgccttggcctcccaaagtgctgggattacaggcatgagccactgcgcctggccaatcttggttaatttgtaaagatacctggtggctgtgaatttggtcttaactaggaccgtagtgttgcagagtaagatgttaaatggtgacctagagaaagccaaacacattaggcacattataccaaaagaacttgacttttaaataatggttttagaaatggaagctggtgttcttctgcgctgtggacgcggaggagaatggagcaggtctgcacagccaaagtgcctcctttcactccagggtccaggcatccagcagccgaagcgcctcctttcactccagggtccacacatccagcagccgaagcgcctcctttcactccagggtccacacatccagcagccgaagcgcctcctttcactccagggtccacacatccagcagccgaagcgcctcctttcaatccagggtccacacatccagcagccgaagcgcctcctttcactctagggtccaggcatccagcagccgaagcgcctcctttcaatccagggtccacacatccagcagccgaagcgcctcctttcaatccagggtccacacatccagcaggtgccgactggggcaaaactcccaatgccggcattaagctagattggcccggaatcagaggtcttgggtgggatgccccctctcacccatccctccttcgaatagagcccacggtcctggtgtggctctgtcatggctgggctgatgtaggtagcatgtgcagaggatgtggagtcggctcctttttcctgtgacgaagttgaaagcgatgatgcatgtgtgttttcttacccgatgcccactgtgtgctgggcactgtcctaggtgctggtcatccggccccacccaaacaagtgggctgtgtgggcggggggagggtccccgggccctgacgtcccgagcaggctcttctgatgagcaggagagtcccgtagagggtctggaccccctttgctcagccgcacctgatgcccacatgtgctgagggtcccggttcctcacgtgaactcagtgctgtattttctcttcagtcccgtttcctcacgtgaattcagtgcaggcggttcacagtacactgtatttcctcttctttttttttttttttttttttgagatggagtctcactctgtcgcccaggctggagtgcagtgacgcaatctcggctcactgcaagctccgcctccggggttcacgccattctcctgcctcagcctcccgagtacctgggactacaggtgcccgccaccacacctggctaattttttgtattttgtagtagagacggggtttcaccgtgttagccaggatggtctcaatctcctgacctcctgatccacccgcctcggcctccccaagtgctgggattacaggcgtgagccaccacgcccggcctatatttcctcgtcttaactcaggtgtgaggtgagctctgtaataggaaggaaatttgtgaaaaatggtaaaagagggaaaagcatatgaaagggctgtgtctggaaagaatctgaattggaggctctgggcacatggtgacagtgcagatgcacccctttactcccaggaacactttgggcacttaggcaaggcagaaaatgtccaagcaggtcccgacaacattcattctcatgccttttgtaacatttaaacgttcatgaaaacatcgccaaacaagctgataattaccatcattttggaattgttcagaaccatgaagaataaagaaggatcatttaaaatcttgaaaaatactgaacaaagaatactaagataattgcaggctgccatgtagcagttcaagatgttcatgagtccgagttccccttctctgaggctgtcaggaggaggttctgtttgaatgaaggtcaggcagggggtgcccccacacactctgcttagccctagacgggaccccaggctgctctacgcagagcgcagcaggagctgcagccccccagcccctgcaagccacggggccttgcctgaagcagcacctcgtcacccctgcccgatggcacctcccctgtgtcccctcatgcagagcagggttccaggcctctccttggggccactggttcccccaaccttgggatagacccaagaggaggctctcaagcttgggcaagcctggcgcccggaagggacaaggtgccggggccacctgttgcccggctcagtgtcctcttttgagaaggtataggtgtggaaggccctgcctgtcctctccgctggcccctcagtgtggcctgggcctgacgctctgttcccacctgcagagagcgtactgcggtcagtgcagcgagaggatatggggcctcgcgaggcaaggctacaggtgcatcaactgcaaactgctggtccataagcgctgccacggcctcgtcccgctgacctgcaggaagcatatggtgagtggcagggctggggaggcccggggggcacgggcggggtcggggcgtggcagccagcccattgtccaagcagaccttggtgaccctgggttcttcaagaggggccgtggtgccgtcctagctctgggctgcagcgtgagactcaggcggcagtcttggataggacccatcttcctgagcccccacaagcccccggcacactctgctcattggggcatgaggctcaggcagcaggctcaggtaggacgtggtacgctctgctcagtgggtcggaggtaaggttcattcataccccagtcttgaaccagctcttaaggactgtggaggtgaaagccaggtctgacctagtagcattgggcacgctgaggctccgaacatctggagcctctccctggcatcccccctgggaagccatgcccagcctgtgatgagggcggcaccttccctccgccatccccgagtgcttggacttgaagcatccaggcctttgggggccttattgacttttgcttattgaaggctgcctctggcatttccgtgtggccccctgcatcccactgaaccacgggggtgaggcctggactgaacattcaactccctgggccctgctgcagcgtgcagtgggtgtgtctggggagggtggcttgtctgcatcttgctgtggcatgggaggaaaggcgcctgtggcagtgacgtgccctctcctctgttacgggataaagacagagtctggatcagggtgtcaccccaggatcaccagccacagggatgggggaccacgcaggctggtgcatgcgttggcacagtccttccagaggtccttcagctgcatctgccaaaaagcctgtaatgccctttgacctcataggtccactttagcgtaagcaaatgagaccggccccagaaatgtggtcagctagaggcggagggaggccagagcctgccacccagctgaccgccagtactggtggctccattatgacatatctgcaggcggaacccagaggcccttagaatggccccctgatgcttggttactgacaggatgcagctttgggacaggggagatgaccaagcattgtgcaaaatatcccgttgtataaagcacttggtggaaaggtcatggcctgcagtaccgagtggccacctccgtctgcagaatcataggtaatgtttatgttctttatctaattcagtaaaatagcataacaattagatttttatatactatattacagtatacccattgtaatgtgtaaatatgtaaatcataaatagtcttgaagtggccaggtgcagaggctcacacctgtaatcccaacactttgggaggccaaggtgggaagatcacttgaggccaggagttcaagaccagcctgagcaatatggtgagaccccatctctacaaaaaaaatacaaaaattagccaggcatggtggtgcgcacctgtagtgcccgctgctctggaagctgaggcgggaggattgctcgagctcaggaggttgaagctgcagtgagccgtgatcgcgccactgctctccagcctggatgatgacagactgtgaccctgtctgtaaaaaaaagttcttaattttaaaaagtcacaaagtgtttacagaagctacattgtaacacctgctctagcacttggtcatgctgccatctctgtgtctctccggcaggattctgtcatgccttcccaagagcctccagtagacgacaagaacgaggacgccgaccttccttccgaggagacagatggaagtaggcgctgctttcttccggccgggtagagcctgggcatcacctcaccctgctcacctctgccttctagccacgagtcctttctcagtcccatctgctctgcaggggtcattgtcttcaagcctggccacccttccctggggctggggatgaggctctccagggcctcctctcaatccccggcagagatgagcagggtgagctggccctccctggaggctgctgggcagggatgcctccgtgaagtgctgttgtggttgcccaggggtgcagagcctcttcctctaaccagctccgggagttctcgaaggcacttagtgcagcggccaccatggccgggcacctcccacaatctggctgctgcacagagctgagccctatctggggaaagcctggcgaggtggctgctgcacacacagcgtggcagtggcatggtccttggatttttgtgaggttttgtttgttgtggggaaggacttgttttattgctaagaagcattcagagagagatctcaaacaccagttggacttacagcccaggtttgagcctccacacctgcacctctgcacgggggtgtgagagcctcactttcacttgatgcatgtgagttctgtctcattgggagaccacagaacataaagcacttatgagaccacagaacataaagcacttagttcacacagtgcctcacgcaaaagagaggcctcacaaacaactgcctgcccacctgctcctccacccacctatcctctatacagatattcatccgtacatcatccattcacccacctagccaaccaaccagccctcatccagccaaccannnnnnnnnnnnnnnnnnnntccactgacctctctatctatccatctattgttcactgacctctccttccatctatctgttgtccactgacctctccatctatccatctatcttgtccactgacgtctccatctatccacacatctgttgtccactgacgtctccatctgttcatctatctgttgtccactgacctctccacccatctgtctgttgtccactgacctctccatctttccgtctattgtccactgacctttccatctatccagctattgtccactgacctctccatctatccatccatctattgtccactgacgtctccatctgtccatctatctgttgtccactgacctgtccacccatctgtctgttgtccactgacctctccatctttccgtctgctgtccactgacctctccgtctatccatctatctattgtccactgacctctcatctatccatctattgtccactgacctctccatctatccatccatctattgtccactgacctctccatctatccatccactgtccactgacctctccatctatccatccactgtccactgacctctccatctatccatccattgtccactgacctctccatctatccatccatctattgtccactgacgtctccatctgtccatctatctgttgtccactgacctgtccacccatctgtctgtagtccactgacctctccatctttccgtctgttgtccactgacctctccgtctatccatctatctattgtccactgacctctccatctatccatctattgtccactgacctctccatctatccatccatctattgtccactgacctctccatctatccatccactgtccactgacctctccatctatccatccatctattgtctactgacctctccatctatccatccatctattgtccactgacgtctccatctatccatctgtctgttgtccactgacctgtccacccatctgtctgttgtccactgacctctccatctttccgtctgttgtccactgacctctccgtctatccatctatctgttgtccactgacctctccatctatccatctattgtccactgacctctccatctatccatccatctattgtccactgacctctccatctgtccatccactgtccactgacctctccatctatccacctattgtccactgacctctccgtctatccatccatctattgtccactaacctctccatctatccatccatctattgtccactgacctctccatctatccatccattgtgcactgacctctccatctatccgtcttctatccaggcctccattcatcccccatctagtcatcctccatccatccaccagacatccactcctgcccctacccacccattcactagacaccaaaatccggtgacgaattatttgcagatggacccctggggacgtatgtcacgaatgtacatccccaggtcccatggtcagagtcggcaggtgtgagtggggcccaggaaactgcattttcagaagactctaaattagaatcagacatggctgctgtgtggattcacccttcaccgtcaccctgcagaggagcaaggtccacagggtcgctgtgttcccagtgcgttcctgaccacaccgtaacgccccttccttcctccctctctcaccagttgcttacatttcctcatcccggaagcatgacagcattaaagacgactcggaggtgagtgtgtggagcagctcgctgccatttccgacgtcctctggaaagtctgtgagcctgtctctggggtagtcacggaaatctagatgtgaaatagacatggtccggggtgttgctaactaatcttcacgggtgtggatgtctagaaggaagtccttattcttgggtcttacttcaggcatgtccttgatgaatacctgcaggcagctgtccccgcaggtggtctggggaccacaccctgcgggggaagccgtgccccacatcctctccattcaggtggtacagtggcccaggggctggcttttgagctgcaatttttatcaagttgtgtctgcaccatgccttccgaattgtgttgcctcatttggccatcctggcaaaccctctgaagccctttcatgtccttccccaacttgagccaagaggctcaactgagcctcacgtctgtggccagctctgcaccataaaccctgagaagggaacagaagagcttgctgcgttctcagcctctgctcgtaaaacccagggaaggactgcactagcgaagcccactcctttccagagcaccaacaagtgtcaccctcacaactcgtgctccttcctggccatcctgtgtctggagggaggccggggcacttagaaagcagaatctgaggctgagcacggcgactcacacctccaatcccagcattttgggaggctgcgcacatcgcttgagtccaggagctcgagaacagcctgggcagcatagcgagaccctgttcctacaaaaataaatacaaaataattagctgggcatggtggcacgggcctgtggtcctagctgcttgggaggctgaggtgggaggatcgcctgagcctgggaggtggaggctgcagtgagctgagatcgcaccactgcactccagcctgggcgacagaggaagagtctgtctcaaaaaaagcagaatccggctgggcgcggtggctcacgcctgtaatcccagcactttgggaagctgaggcgggcagatcacgaggtcaggagatggagaccatcctggctaacacggtgaaaccccgtctctactaaaaatacaaaaaaaaaaaaagctgggcgtggtggcgggcgcctgtagtcccagctactggggaggctgaggcaggagaatggcgtgaacccgggaggtggagcttgtagtgagtcgagatcgtgccactgcactccagcctgggcgacagagccagactccgtctcaaaaaaaaaaaaaaaaaaaaagcagaatccattttgccgcacagaacagcacctcccaaggaaccgcctcctccaccccgacctccttgccaggtgtagcttgcgggaggcagaggcttctgttcttcctcggagcgcctttctcctgggtatttctaataattatttctaataatgtgtgcctgccggtttgggagctcttggcaggcattagctgcattcgctttaccttccttcccctgagggagggcactgatcaggaaggatgggcccaggccctgggccacatgtccctgtggccacctcttcagccccactgatagggctgagggcctgggggtccctcccacctgcagctgtgaccagagccatggtctgtggaacgaacagcttctagctttctagcaccttcctcagaagcacacagccttaaattcttacctttcatgccccagtttagatgggagtttgggggtgggatatgtgggacgcagaactgagactcgaatcatgaggccctgggctctgaggagcaggtctctgttgggaccgcatgagtgatgcgtggtcctctgagtctcccgggaacccccctctcactttctggggtcttgttctccctccctaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggtaggtgccgcttctcatggggcccgggggcccgggaacgcgctgccctggggcctcctccgggctttagcggaattaatccatgcacgagagacctagcctcacgttgacggagtttgtgcaaaatcaatagtcatgcatcgtgtaacgaccaggatgtgttctggaaagtgcctggttaggtaatggcactgttgtgtgaacatcacagtgtgcactccacaaacccaaacagcacagccaactccacagccaagatgcacagtgcagctcctgctcccaggctgcaagcccgtacggctgttagtgcactgcacactgcaggcagtgaggggaccaccacgagagcactcacgtgtctaagcttagaaaaggtgaagatgggtatcgtggtctctgcaaccttctcatgtatggccaaccactgatacgttgccttccagcagactgcggttgagttttaggatgtcatcacccttgttaggaaatctctggggttgagctgaactggacgggtgatggggtgggacaggaagctgcccagaggcactgccctgctccgtcctgcacaaggccccagctttgcagtacatgctgagctgccgtggctctgtgtagcagatcttcccacaccagctgtttctaggggagaagtttgttgattataggatcaatggtttatttgttgaaatctttttttttggaaacggtcttactctgtcacccagactggagtggcttgatcacagcccactatagcctcaaagtccccagctcaggtgatcctcccacttcagcctctggagtgttgggactacaggcatgagccaccacccccagctgtataatttttgtattttttgtagaggcagtgtctcattctgttacccaggctggagggcagagcatgatcacggttcacctcctgcagcctccacctcctcctgcagcctccacctcctgctaggctgaggtgatcctcttgcctcagcctccagaggaaccaggactacaggcatgcaccaccatgcccagctattttttgtgttttttgtagagacggggttccactatattgcccaggctggtctagaattcctgcgctcatgcactctgcccccctcagcctgctagagtgctgggattacaggcatgagtcactatgcctggcctgtttgttgaaatcttaattctgacttcatagacctttttcttttaattaaagtaaaatacacatgacatagaatttgccattttaaagtgtacagttagggccgggcgcggtggctcacacctataatcccagcactttgggaggccgagacaggtggattacctgaggtcaggagttcaagaccagcctgaacaatatggtgaaaccccaactctactaaaaatacaaaaattagccaggtgtggtggcgcacacctctaatcccagctactcagaggctgagacaggagaatcgcttgaaccagggaggcggagattgcagtgagccgagatcacgctactgcactccagtctgggcgaccaaatgagactctgtctttaaaaaataataaaatatgcaaacaaagtgtacagttaggcggcttttagcatattgagatacagagttgagcagctatcacctctctgattccagaacattttcctcaccccaaaaggagaccccatacccactccctgcttctgctctgcgtcagccccatggcctccaatctgccttcttcctctgcggacttccgtcttctgcacgcttgacagaacggagttgtgtgtgagcttttggtgtctggcttctccagtgtccgtccatgtggccgctcgctcaggccttcctctctctgcctggccgggtaatgttccgttgtccagtggaggccccacgtttgtgcgtgcacctgccaaggggcattatagtgttcccacccttggctgttgtgagtggtgccactgtgaaggttcgcgtacaagaatctgtttgagtctatttccagttcttttgagtgcaaacctagcagtacagttgctgggtcacatggtagttctctgttcaactgatggggacctgccaggctgcttcccacgcagccgcgccgtttcacctccccgccaacaccacacgggcctgtttctgcaggtcctcagtgacgcgtgtgattgtgatgatcgctatcctggcaggtgtgcagtggtggctttgactcccatgtctctgatgactgacagtgttcagcatctttcatgcacctgttggcttctggtatttttggtcttttgctttcattcctgaatgcaggttgcgtctctcaggattagataaaaggccaacgtgtgggtggcagtaatgctgttgtcaccaagtgctgctagcacagaaggcaactggctgctcgtcgagccccgatgggccacagagggggtccctcctcgccagccatgctcggggctgggagggcagagctggggctggggctgagcctctactacctcccagcagggcgtgtctgtgcagtgcacaggctgtccaactggcccctcatccctgggtgcagaactcaaaagtgggtggcagcgtccatgccctgcgccgaggaacagaggccccaagaggtgtggtgccctgctgacagccccgctgctggccagcggcagcacaggaggattccagccccctttgcagcacgtcccggtcagctggaaagttaatgccacgtatgagagcaggtttgcgggaccctgagaaaagacatttggaagagtcgctgctgcggttttgttctgtcttgaaatcatcctctgtgggccgggatgccgaggtggggactctggggttgtctttcgagaagagcctgattgcaggagttgttgaatgcttggatggtttctagaaatttctttctccccacaaaaagactgcactctctggggccaggcttgcctcttgttcccccaggagtcactggcaagccccttcccaccgattctgcagcgccagccccacgcagggccttgaactcagcagtgctgtgtccaggaggttccactcagtttgggtgctgagtgatatgtgggtcatgatgccaacgccgacgtccctgcggggccacagtgggtgggtgctgctggtgagggccactgggggacgggtggtggcaggtgaggggtggaggagtcaccgccgacccactaggtcttcagccactggagatgggaggagatgcgggctggcgaggagctcggcttgtggcctggggtggcgtgagatacccgggtgcacatgttgagcagccgtcggggggcaggtctgcagctcagggagaggccgggctgggagctctcggcgtggaaagatgagactcgaagccactccattggatctgcctccgaagagaagggagggtggccgaggaccaagcctcgaggaggaggagggcgctgaggaggaatgacacagtctcagaggctaaatagatactcactaatggtttgttgatttgtttccacgaaacttccgggagtgggggcaggcaacacagtaagaccctgcctctacaaaaaataaaattgccaagtgtggcatgtatctgtagtcccagctcctctggaggctgaggtgggaggatcgctggagctccagaggtcgaggctgcagtgagcagtaatcgcacccctgtgatccagcctattttgacgcatttctttcactgtcatttttctaaccccgaagacaaggggttgacctaggaaggcttgagaacttcgtccagctctactttctggggtcaagatgagaccaagctgttggatctttgtcactctaaagttgactttgaccttgcagcattttgctgaactgcagcatgaattgggagggtgacagtcctgtggctgaagctagtgctctggtgatgggtgtgggcttatcactcggtagcgctgggaccttggggaatctgcttagccctccacctcaatttccttgtgtcctaactggagataataatacctgcctcctggaactgttagggcaaagcctggaggccagaggccagtataccaccagaggccagcatacaaccagagctggtagctttggtgatcgtggtgaagatgatggtgatgatgatggtgacgatgatggtgacgatgatggtgatgatggtgatgatggtgaggtagtggtgatgacgtggtggtggtgatgaagatgttgatgatggcggtgatgatggtgatggcgatgactgtgatggtggtggtagtgatgacattgaggatgacggtggtggtgatgatgatggtagtggtgatgacaatggtggtgatgacagtgatgatggtagtggtgatgacaatggtggtgatgacggtgatgatggtgatgacagtggtgatgatggagatggtgatgacggtgatgatggcagtggtgatgacagtgacggttgtgatggtgatgatggtggtggtgatggtgatgatgacggtggtgatgaaggtgatggtaacagcgacagtgatggtggtgggggtagatggtgccaatggtgatggtggtggtggtgatggtgatgacagtgatgatgcagatggtgatgacggtggtggtgatgatgacagtgacggtgatgatgacagtggtggtgaaggtgatggtgacagcaacaatgatggtggtgggtggaggtgggagggatggtgacaatgatgacggtaatggtgacagtgacgatgatagtggggggtgggggtagggtgtatggtgacagtggtgtgacggtggtgatgatgacagtgacaatgatgatgatggtggtggtggtggtagaggtggggtggatggtgacaatggtggtaatgcagttcctaatgggtgttttcttttcctgtctgcattgtcttcctgaaagcggaggaaagagactcctcccttgcctcccccttgcccaggatgcctgtgaggagcattcgggagcctcattaccactccctggtttctatttcaggatattgactgggtacagacagagaagcacgtgtttgagcaggcatccagcaaccccttcctggtcggattacactcctgcttccagacgacaagtcggtaagaaaaagaagggtatttctgatattctgcagatttcagatgtgaactgcacagaagctaagtctggtgtgatgtgtcaactgtcacctgtaaggttctcccagttgctgtacgggtgttttcaggccagcagactctctttgttgttctccttggttggtgtcatattaagtacatttcatgatctgaagttatttaattccatttacgaaatacttactggaggtatcccactgagtgcaggcattgggtcaggtgctggggctacaaaagtaagcaaaagaggtggatttctgtgcttattaaaatatgtacagcttcaccttcaagctttatatatactggaattctgtggctttgaatacatttgaaagctgatgatctaggatattaaatgtatgccctgtttaaaattttgggggccagttgactttgacctacctgatttgtttatttgaagagttattaagtatgttctgcattgagtcctcaagaccatccccaggttcgatgattggctaggaggactgctgggatcaatcatggccgcactgggggccacagctggcatactgcactggggagataaaggagacttggccaaggaaaaaggcacatggggaaaattccagaagaaaccagtcacaagctcccaagagccctctcccagttcctccagcaatgaattgtgacaactcatggtttttgtcaagggctggtcatgcaggctgcacacgaaccaaaattccagactcccagtggagagcaggtgttcagcattgcgttagtcagggttctcctgagaaacagaaccagttgtgtgcacgtgtgtgtgtgtgtgtaaagagatttattataagatactggttcatgggattatggaggctgagaaatcctataatccgccatctgcaggctggaggcccaggagagccagtggcacagcttgaaggcctgagagccaggagctgatggggtcgcttccagtccgggtctgaaggcctcagagctaggagcaagggggccagaaggtggatagctcggtagtcagggaaacgcagccttcctcctccttcttgttctcttcacgtccccaggggcctggatgatgccagtctacttcagggagggccgtctgcttactcttccagaagccccctcaacaggcatgcccggaagtcatgtacagccagctactagggcgtcccgtgcccagtcaaggtgaccgttgaattcaccatcacgagcataaggcatcctgttcaggcacacacagtttgggcacagcaagcagctcttattccaaagctttttttttttaatgtgcttttcttgtttttgagatggagtctcgctctatcacccaggctggagtgcagtggcaacatcttggctcactgcagtcaccacctcctgggttcaagcaattctcctgcctcagcctcctgagtagctgggattacaagcacctgccaccacacctggctaatttttgtatttttagtactctgtgttggccaggcgggtctcgaactcctgacctcaagccatctgccctctgcagcctcccaaagtgttgggattacaggcatgagtgactgagccccgcctccagagtttttttttttttttttttaaataaagatagggtcttgctctgtcgccccaggctggtctcaaactcctgggctcctgcctcagcctcccaaagtgctgggattacaggtgtccaccactctgcctggcggtcatgcagaagcatgttatatccgtgtagggaactgtttgcagttcacgttcccagccccagctccgggccagctttgcgggccaggcttcctaagcacagcggtcctaggccctgggtgcaaccctctgctgctcggttcttagctgtacatctggcgacttgctctcctccgctgcactcttggctctcctgaccgcagggtcctgctcttgcctgtgcttggcagccacctctgtctgtcggaagagccggcgtgacccggccgttccccgacctgctctacgtgcggtgccgtcctggtcaagggttcctgttttctggctgcttacgcctcctaagtgtgtttcagggtcccccaccctccccacctgaccccagggctccccagtgttggcttccccatgttgggcctgagccatatttgagaaacacagatctgaagtctttttcctgcctcaaagctcctctgattcctcctccccagttgcttctggggtaaattccaagcttcctgtgcgtgtggacgaggcttgtggtgaccaggccccagtgccccatcgtgtgcttcagcgtggcgccctcgcccgcaccgcctgcgcctgacggctctgtcccctttccttctgctcccctgcttcccggagtgagtcaatgcctccctttgtgcattcccattgcgcttttccaggcctctttccgccctgactgccatcccttgcgatttgggaatacgcccaggggaaggcagcccggccccccacacttcctaaatggtgaggttccaagaagggttttgttttgctttggttcttcttcatatgtgaacttgtagggatgtagatgtataaggggtccgatatcccaccctcacttcccctgagtggcccaaagctcagccccttctgcacttgtgtctttggactcttctgtcaagtcacaagttcccagatgcgtaaacctgaacttaaagaattgtcgtctgtggggtgtctgtgggatccccgcagcggcaccaatcactgtcctgtgggagcattcggcattcacagttgggaataattcctatgcatgtctgatttttttgccttttttttttttgagacggagtcttgctctgtcacccaggctggagtgcagtggcacgatctcggctcactgcaacttccacctccctggttcacgccattctcctgcctcagcctcctgagtagctgggactacaggcgcctgccactacacctggctaattttttgtatttttagtagaaacggggtgagctccgggttggggggaggaccggcagctgccttagtccaatagctggggggctgtgaaaactgcccacaaattcttactgaccacacagcaccagacacccacgtgaagcaaagccaacatcggcaaggcggccacgcgtccgggtggcggaaaagtctggcctggcccaggtgggtgtgctcggctgtgccgcctctgctccctggtcactggaggtgactgcaggctttatgaggacttcctctttgtgcgttggttctgctggaacatccagctgaggttttgcgtgggccccttgctgagggccaggtgaataacacgcagaacaggacactccttcgctctgggcggcctcacagctcccgggccatatccagggggaacctggccgatgaaactgcagaggtttccacacaagtttggttcccataaagggtctgtgagtggggaagaatcagaattgctttctttccaccccaaatctggtcttgcctcttctggccggccatgttcgtgtccactgggcggctacagggaattcctgaatgttacagttcaacattagtctcacctcgtgtgtccagatggagagaaacaattcattcgcagttttaagacacaataagcacctgctttatggacaaaccataccccatatctacacagacagcccaccttttccagacagcagccaaaattgaaatgagccataaagtctccaaaacgagaaatcgcttcagtttaagctatttcaggaaaaccaggtaactagagatttagctgaaatgactactttcagcgtcccccgccccattcaactggagtcggaggacactttctcactaaggcacggtgatctcagatggtaggtgagcaaactacccttaaaatacgcccattcactcgctgttctaaaataaaatctcttactgtttgccacggttgattattttacattcattcacactcaatgtttctttaaaaagaacaaacacacacctttgcttatctgtggaagcgcttctcaggccgtgcactgactgagacacttgagtaagctcttcttggtcaaactgacttctagacatgaaaagcacttcacccagcagtgtgcgtgtgtgtgtgtgtgtgtgtgtgtgtgtgtgtgtgtgtgtgtcagttatgctttgaaacctgcccgaagctctggagagggagacagctttactaacagcagagagtgacgtccctggaactggtcaccagcgtcaggaggcgtggcacccggggagggtccgcagggagcagagtgggactccgtggagaggggggcaggcaagggttgggtcacgtaggaggggctcatgggggacaggcctgtgggaaggacgagggcaatggtgtgtgtcagggacagaagagaaccaggcctgaaggtgccaggggctttcgaagctggacttggccaagaggccctgggatgcggaggccccagggattctcagtgcagtgctggtgttgggcaggcactcgtgtgaggagtaggatctgggccgcagaagccagagggacctgctgggcctgtcatggcctggagggaagccttagggggtggggaggaggggcctgtccccatgtgggggagtcaccccggttcgcagaagtcagggcagtgctggccagacaggcacagagcggagccagcctggacgtggaggactcgggggtgctgtggcctgggatggagacgccccgccccgccgggggtgattgtggttgtgggtgtgtgagaaagaggtgagggtgtgacggggtctgaccctggggtgctgcctcctcagggctgcaggaggaggcgccgccgtcggggtggaggcagtagagggaagggctcagtgggtgccacagcaaggacagcctcggccgcgaccttgggaagggcaggtgcctcttcttggggaacatgagtcacctccctttcaaaacccatccgtgtgctggagtcatgggagctcagaacagaaggagagatcctgactgacacccgtagggcccagcgtgggcgcagccgcctcagcctttgttctgccgacacacggtgacggctcagcggccccctgatttgctcacttttcatcggggttgcctaaaatggtaaaagtgccaccctaaaccctagcacttccggagcaggacgcttgggcctgtggcccccacaaggctgtgcacgggagaaggggctcttcccagcatcaggggcctggcaggagccaggggcttggtttgccttttgcattgcgagggcgtcctgcactcttcgggaacactgcggacagctgcgcatgcatcctcccagagccctgggcagtgaggggccctcggggacccccaggacatgggctttgggacacacctgcagtgtacagggggccctgctgtttcctgatgtggtgtcacaggccacacaggactgtgcagaacacgggagaaagggatgcgttgtctgtagttctaatcgggaggcactggccgctcttagaacaggtcagggggcaggtgtcattgccattcggggtcacgttaggaccgggggacctccactgcaggcttggagatgattttgctagtagtgagcagagatgaggtcatggcatctccccttctccatccagacccgaacgtcccatgccactgcgccctgcatggttcccaggatgagcagggataggggtggcagccctggagccacctggagtctccttagttgaaggaactttcaggaccggtcctgaaattgtgcctttgctgcttaactactagataacgacagagaccacataaaacaagagcctctttataaacttgtatcccattttaacgtgcaggaaagaaccttcgtccgcactccaaagacccttgactaaccagcgtcaccatccagacagttttgcctcgtttttccttttctcttgtttatttttccatgtggactttataatcaacccgtctgcctccagaaagaaaaagaaactgggattttcttttcttttctttgagaaggggtcttgctctgtcacccaggccggagtgcagtggcgcaatcttggctcactgcaacctccgccccctgggttcgaggaattctcatgcctcaaccccccgagtagctgggaatacaggcccctgccaccacacccagctaatctttgtagttttagtagagacggggtttcaccctgttggccaggctggtctcaaactcccaacctcaagtgatccacctgcctgggcctcccaaagtgctgggattacaggtgtaagccactgggcctggcccgaaactggcattttcattgggatttgttaagttcacacattacctggggcgaaattgacatccttctaagtgttggatcttcccattcaggaacccggtttaccttttcattcactcacatcctctttcaggagactcttgaagtcttcatgtggttttcttcacttccttgtctaattattattattattatttttacagatgggggtcttgctatgttgcccaatctggtctcaaactcctgggctcaaacgattctcccacctcagcttcccagagtgctggcatttcaggcgtgagccacggtgcctggccacttccttgtttaattttgtcttgagtgtttcatctcgtttctgttataaacgaggtattttttcttctctcagagcatccagcagcaggcagcttggtctctgcgtggtaactgtgggccccatggcttctgagttctcttccttgtagtaactttcatggcttctgagttctcttccttgtagtaactttcatggcttctgagttcttccttgtagtaactttcaggtggttttctggggctttggatgcacagggttagcatctgcaggtggggcagcatcacccacctcagccgctgcaaccaggtcgtgccgtctctgttcatcttcctctctggtgacagtggccagcacctgcctcactggggtgacgttgacactggacggccctgtcctattcctgaccccagctggaacactttgcaccggaagcgcagtgccatcctcaaggcagaacggaagcatttacccatctcgggcaggcagcatttgccctggcatgtgcaaagggtgttgggagggccacaggggagaggagagacaggggctctgcctgcagccgtggaactgggttctggagcccacagaggagctgtccctgcctgagctgttggagacgggaacggaccctcccagttcctgggcccatcatctggtctctgaggacacctgctggcaaaggccctggcaatgatacatacagcctctcagcccccagccactgggagaaggttctagaaaggctgagcagcagcgtgaagctgagagaagatgaccgataactgcatgcagaggtgtgacttgtcctattaagggactttccacccatttctgttttgctatcaagaaaaaacactgaggccgggtgcggtggctcacgcctgtaatcccagcactctgggaggccgaggcgggtagatcacgaggtcaggagatcaagaccatcctcgctaacacagtgaagccccgtctctactaaaaatacaaaaaaaaaaaaaaattagccaggtgtggtggtgggtgcctgtagtctcagctacttgggaggctgaggcaggagaatggcgtgaacccgggaggcggagcttgcagtgaacggagattgcaccactgcactccaacctgggcgagagagcgagactccatctcaaaaaaaagaaaaaaaaaagaagaacactgcaagttgtgcaggggcctccttgccatttgtggagatcattgttacgatttttactccttagggcctcctggaatgaatggtgtcatcgtaatgtagctgctggtattgaaccatccttagattcctggggaaaaccgtgccctgtcttagtgtgctactctgttaatgtgcttctgaattcaatttgctgatattttatttaggattttttttggttgatattcatattgttttagtttagaatcttcaggacacagagctactgctccagtgatcaagggagacacaggatggaaacacaccttttgtcacccacaggccttgggggtacacaacctgctgggaggccagggagcgtaaagagagacagggaccctttattgggtccagggtgttctgcacacaggtttcccatgggaagttttaactgatggacttaaagcaagcaggcctgagctccgtggggccacactgtgactgtcgggggactctgcagtgtggctgcacagtccatgttgggtgtggtatcagtggggctgcagggaagtcaccagggggcagttgcatagggtgggtgtctggatgggccagctcgaggaatgggggatgtggaactggaaactgtcagggcgacagccctgcttctggtgggagaaagtccagcttagatccagaatggatgccgaggcagcctaaaaccatgagcgttccctgcacactctggcgtctgatctctagcttccctttcttgtgcaagcttcattggatttttaaattttcctaatttttcaattcccgggaacattctaaattgcgttattacctcttggcgggatccctgtgcgattgccgggccttgggtgtcgtggagggcagctgcctcgctccgccctggctttcgtgatgttgtgagctttaccctgccgaggctgggtgttctcacccagtcccacggctgcaccctgccttgccttctcctctgctcaacttcaccccaggccgtgtctcctggctccaggaaggtgaggggctgcctcccatgcgtcctttcatgttgaggacacccgtgtttgcctttgcacgtgagccccattgtcgctgggacacactgccctccagtgctcgagtgcatttcctgggcactttctggccttttatctttgatggagaaatccgaggcctgccagcatccccaccagtagatttctttggacgaagtaaaatccttctgtggattcagctttaccgcctttcctcatctgctggtgtcttcctcagagctttaatgtccgtcctgctctccgagtcaggaatctgattttccagcgtgccctgtaatgacggtgctgtcaccgctgtgatgtccgctgtgaggtggggacaggacctggaagtggggtttccaagtgagggttctgggcccgcccgagtcatctgatgttgggtctgacaagccaggagctgtgtgagccggagaacgtcccctaacctgtctgtgcctcggcttccccatctgtaaaatggcgagagctgaacttacttcctggtgatggggtcaagtgcgttaacacagagggacttggagactgacgcttactgagggccacaccagcggtcagcaaaggttgtcttaaagggtcaggcagtaaatatttccacctttgtgggccatgcggcctctgtggcaactatgcgttctaaaacagaagcagccttagacactgcgtgaagggacgcgtgtggccgtgttccaccagaactttctgtacacacatggtggtggcccgcccggacccatctggttaattcttgactctcagggcagcgtctcctgtgcctccaggagagggctgtggttcctccctctgagccgggcaccttgcattcctggaaggggtggggggagtggcgaggagggggcggcaccaaggacagggcccacctcctaggaggttttgtgagcttccctcagcccccggccgccccctaggaggtttcgtgagcttccagcatccccctgcggccactgtccctccatttcccatgtctgttggatggtgccggttccagggcagggtcagggactggatccggctgcggtctgcgtctcgcctggttcctgagagctgcactttgtctttggttgttgatgaatccatttttgctggcgttcttcacgtttgtgtatttgattaagtatcatggacaggcatgtgcagtggctcacacctgtaatcccagccctttgggaggctgaggccggaggatcacttgaggccaggggttcaagaccagcctgggaaatatctcgagaccctttctctacaaaaaatttaaaaattagctggcggtggtggtgcaagcatgtggtcccagctcctcgggaggctgaagccggaggattgcctgagcctgggaggtcgaggctgcagtgagccatgatcacaccactgcactccagcctgagtgacagagtgagatcttgtctcagaaaaacagccccgagggcacgtgtctcatgactcccgcctcccgcctcccatctgggctctgcttgctcctctccccttgcaaacatgagaggagcgttaatgccaggacagggagcagggaggggcatccccagcgcctccaggccacaacatggcgagtgtggctaccaggacacggaggggcagcctcagccccctcccccaggccacgacatggcgagtgtggctaccaggacacggaggggcagcctcagccccccccaggccacgacatggcgagtgtggctaccaggacatggaggggcaccttcagccccccacccccacccccaggctgtgcttcccagcatcccttggggtcaggactgtgtgtgtcactgaggggctacgggtgaagccacacacgcccctggcctggccttgcgcccctgcctgagagcctctatgcaggacagcgcctgtggggcacccaagtgggccgagcccatgtggattacaggtgcacaccaccagcgtgaggagaggagtgggctcggagcatgctcagccatggtcccaggcatcttgtcagcagccagctcagcttgtgtcacgcagagtcgccttagagtgaattgacaccagattgtcctggtgggtttttgctctgaagaaatgtcaaaagtagcattaaggtttttctgtagacaaaaaaaccccaccatcattgcagcttgagcagttgcaaattaaataaattccttcctcagcaagctgcctgggtcctaggccttgggcagagagaactggctttcagcacagttcccgtgattggcttttctctggagaagaaggggaagcggcctccgcctctacctctctaagtgtttaaatgtcccccaaattctctcagcctcctgaggcattgtattgatgcttttctctagaattcatgtatttctttattttctctggaaatggcattggctttgtccccgtcctatgggccgtgatagcttaaagttaggatgaacccacagaggccgtggaggcccttcccaggcgccgcagcagcactgttggggtgaacgtggctcctctcggggggacaggtggaagggaccagcacccattggggcgtgtaactcctggtggcaaaaaatgtgcggtgaagtcaccctaagggtttttgtggttttttgtatttttattttattctttgagacagagtcttgctctgtcgcccaggctggagtgcagtggcgcaatctcagctcactgcagcctgtgcctcctgggttcaggcgattctcctgccctcagcctcccgagtagctgagattacaggtgcacaccaccagccctgggtcatttttgtatctttagtagagatgaggtttcaccatgttggccaggatggtctcgaactcctgacctcaggtgatctgcttgccttggcctcccagaatgctgggattacaggcctcgtgagccaccacgcccaggcactctaagggttttgaataaattctttcttaacgttttctgaccgactcttaggtcgtgggtgtcctccaggggttggaggccttcatggagcttcgttccgtggggttgacgttactgaacgagtccctccacgggtgcactgaggacgttcctgcacatcgagggcaccctcagagctgctctttctgtcattgctattttgtttataccggggattggcaaactttttcttgaagggcccaagagtagacatttttggctttgcggccacagggtctctgttagcaactccctctgccacggtggctggaaagcagacatagaaaatagatgcaccagtgagcatagcctcgttccaataaaactttatttacaaaacagggagcagtggaccagcgagtccccaaggacaagggccaggttaccagagaatttccaggcacatccgttggaggcaggggagacaacaaaagccgaggaacgagccttccccagccgctccccaaaggcacggcttattcttcagggtgcccgactggccacgtggacgtctctccagctcctcacttggggcccagggctctttcgatttttaggagtttgtttccaatcagaaacttcacagatgatttgcagccagttcacctgccctgtgtaaactggcctctgtcctctctggcttaattctgggagcttgtggagggcaggagcagggacaggtgccttgaggcgtaacagtggcggtggtgtgggagcttgcgtgggatcgaaggaaacgggcagagtcaccacacgcttccctccttcactccccgctccacgaggggcagccaggagcagccaccagtcggaagcaaataaacaattcaggtgccagaggagccgctgacctaaaaaaacccgccacagggtatttctgggagattgtatgagaatttaattttgaaaattgagtctcatgaaatgtaggaaaagatcttattaggaagagaaaccatgtggcccagtccctgagacgggaagggcctgcgtggtcctgatgacatctgcggatcttttaaaatcatacgatcatgtctgcgaaaccgggatgccacttcccacctggcttctccctgaccccagcttgttcccttggagggccggtggactcctcagccttgcagcaatgaaatcaggccttgaggccaccccacccgtgacctgcggtgctgtccccatgcaagaaactgcctcgctccagcccccagcagatcctgtcccagcccccagccctggtccaagccacctccactcccacctggtgacgggccacctccttcattccggggcccacccacacttcccaagtccacacacagtggccaagagtgaaggccggcgaggcccccgcatgactccctcacctgcacccttcacgagcggccccgcagcccgtccccaccagcccctctctgctgccagggtgctcctgctgctctttgctctttgcaagactgaacctgcgggagggttcgggcccacgaaggccgcttctgtggggcttctgtctaaggaggccgccgtctgccgaggtgactgcagcctccggcgcctctctccctgcaggttgttcctggtcattgagtacgtcaacggcggggacctgatgttccacatgcagaggcagaggaagctccctgaggagcacgccaggtgggtgcgcgtggacggggccgggtgggtgcgcccggagttggggatgggtgggtgcgtgcggtgttggggggctgggtgggtgcgcacagagggatgacgggtgggtgcgcgcggagttggggggccgggtgggtgtgcgcagaggggaggtggctgggtggggtgtgcacggagggggtatgacgggggcggggggggcggggtgcacgtggagggggccggggaccttctccaggggtcagcagggagctcaagggagggaagtccaggtaggatggcagagggcatcatgtcccccacagtgtgacgtcccctgcattgtgacacattccatatttgctccagagtcacaacatttgggaggtctcctgagttatggtgcctcagaccagtcccccaggccccacccctgaagcagcaccatgcctcatccgagagaagtgagagtctcctgggattgtgctgtcttcatggtggctctgccctggttctgctcttcaccctgttagtggcacagcatggccagcatttcctcagcgttaggagcagaacgagagtggtctgtttctagagtgacctgagagactccttcctgcccttccctttcatctctgatatcttcgggcctcccctggcagccgaggggcctccagcatggttcaggagcctcccccggcagccgcgggacctccaggaccgtttgggggcttatttcagctccctggacctttcctgtcttttgtagtttctccttttcctcatttccttacttaagaacgttgcatgcagttttgtgagtcaccttagattgtttctggcaataggacagtaggcaataaatctagaacagtacacttcccacaacgctgtttttaaaaactgtggcaagatacacacaacataaaaggtagcattttggggcatggaattcagtggcgttgaatgcaccccatgctttgcagccactgctggcccccgtctcatctccagagcacgcccctcttccctgctgaagcttggcccatcagacactccctccctgtcccccgccccagcctcacatcctcaccccagacgggcacgtcccactttctgtccctctgattcgaggactctagggacctcatcggagtggaatcacagtgttggtccttcggtggctcattttcctgagcatagcgtcctcaagattcatccgtgctgtggcctgtctcagaattgccttcctttttcaggctggataatgccccgttggatggaggggccacactttgcttatccgtccatccctcggggggcacttgagtggcatccacatgttggccatggtgaacagtgctgctgtgaacatgggtgtgaagtaatctcttgaacaccctgcttccggttctttggggtatacacccagaaactgaattgctaaccacataagaattccatatttaggccggggcgttgggtggctcacgcctgtaatcccagcactttgagaggccaaggcgggcggatcacgaggtcaggagatcgagaccatcctggctaacacggtgaaataacacagtgaaaccctgtctctactaaaaatacaaaaaattatccaggtgtggtggcgggcgcctgtagtcnnnnnnnnnnnnnnnnnnnnnnnnnnnnnnnnnnnnnnnnnnnnnnnnnnnnnnnnnnnnnnnnnnnnnnnnnntgtgggcagagcttacagtgagccaagatcgcgccattgcactccagcctgggtgacagagtgaaactctgtctcaaaaaaaaaaaaaaaaaggtcatatttaatttttttttttttttgatggagtctcgctctgtcacccaggctggaatgcagtggtgggatctcagctcactgcagcctctgcctcccaggttcaagtgattctcctgcctcagcccccagagtagctgggactacaggtgtgcgccaccatacccggctaatttttttgtatttttagtagagacggagtttcgccatgttgcccaggctggtcttgaattcctgacctcaggtgatctgcctgcctcgacctcccgaagtgctgggattacaggtgtgagccaccaagcctggcaccgtgtttaattttcgaggacctgccggactgtcttccgcagcagcggcgctgttctgcactcctaccacaacgtgccatggctccggtctttcccgcatggaagctgtcgtgttatttgcccgctcctccccttgtggaggctgccacatcgttctctgtgtctttgacagcaggccatcctaaggcgcatggggtggtgtcctggagctttcattggcatttccctccctggccctgtgcactgcactttcaaatcctgggcctggtcattgagaggatgccgggcccgtggtggggcaaacgggagtgtgtggcccccaggctggagctgttggcgcagcctctggcacaggcactgcccccatgacggcatccccacccccaggttctacgcggccgagatctgcatcgccctcaacttcctgcacgagagggggatcatctacagggacctgaagctggacaacgtcctcctggatgcggacgggcacatcaagctcacagactacggcatgtgcaaggtgcgtgccttggaccgcctcccctgaccatcccgcatgtgcgtctcggggcgcctgtcccgcggggtagtgtctacaagaaccctctcccagtaactttgcccccacaggaaggcctgggccctggtgacacaacgagcactttctgcggaaccccgaattacatcgcccccgaaatcctgcggggagaggagtacggtgagtgccgctgccctggcccctctcggagcacacagggccagagatggcttcgggcctggcccagcagccagggagaggtgtccttgaccatcttacacccaaaagccacacactgtctttcccagccggatgtcatcatctggcctcagccccttatttgaattctggaaaacctcccatgtccacttgagcagctccttggggagggcactgcacaggattcctcctgccagggagccccggggcacagggaggggaaagacacagaaagcgggggtgggacagggtgcagcacctgagtccccgtgctgcacgagtggctgggggagaagctgttgtctggggagccccagggggtgcaggagcgtgtggacaggaccccacaggccctgcggctgaggacgccgtgcacaccagagtgtttctgctcctctcccctctctgggcgtgaaacggggacatgggcacgcgtgtgcagccgtgtgtgcgtgtgtgaaacggggacgtgggcacgcgtgtgcagccgtgtgtgcgtgtgtgaaacggggatgtgggcacgcgtgtgcagccgtgtgtgcgtgtgtgaaacggggacgtgggcacgcgtgtgcagccctgtgtgcgtgtgtgccgttgggctgagtgttcgtgtgtcgggcatccatgtgtgttgtgtgcacatgcatactgtgtttgtacacactccacccacttctgcatcctggtgttttcaatgaggcatgcatggtgtgccttcagacatttttacacattttttttgccatcagaatgggtgtggggcaggcagggcgggcaggtcactcgccgctgggataactgggctccccagcggccacaatggaagtctcagtagccagagaaggacagacagcagattggaggactggaatatagtctagaacccagcttgggatggggattccgtgtgggacagcggcagcgtctcacctcagcagggaccagggggacttccggggacgcagagacagctgctgtccttgggcaaaacgggtcagggtctcccacccctcattcgctggaacacattcccaacaggttgactacttgaacctttttaaaaaacaaaatggctgtagaaggaaacacaggagagtatttccgttactgcagcgaaagggcttcttcaagcttagttctgtagaagcagaaacgagagaggagggtcgtccgcaggttccaccagtgcctcgtgccggtgtggtcacaggtgccctggcaggaccgacagcccagaggcagcctgggagacctccgtagtgtcagggacggtggcagggaggccgagctgccaggtggaggtgctggttctgtttgggaagtggaagtcacagaggcctgtgtgccgcctgctcaagcctggctcacactcgtgtcaactgggcatgaaaaccaacgccagccaggttcgtcctgctgccggcccatgtggccccactcggtgatggctgtgtgctctcccccagggttcagcgtggactggtgggcgctgggagtcctcatgtttgagatgatggccgggcgctccccgttcgacatcatcaccgacaacccggacatgaacacagaggactaccttttccaaggtgcgtgccccgctgtgcgttcgtacccctcacctgcacgactgtcttccttccttttcaaaggtgcaggtggaggggtcccgcgggtgcctggagcggcagtgccatgcaaagcgtaccgggaaccattcctcctggccagaccctgtgtcacatgccactccccgggccgtggggtggggttaccacacctgtgggtcagcaggaaagagaacctgtccccattcagctccaactccctcctgccctggccagcagcacatgctggagccccagcatgtccttgaccgaggctgtaccgagctgaaagcacagcccccacccccaaaacccacagccaccatcatgggctccttcccacctggaggccccgggacctgctcctggtctggaattcagtgctgtggggatgtgggatctgggaacgcggctgtctccgcggtgccctctggtggccagcctgcagaggcacccgtgtacctgcgatcttggggctgaggaaggggagctgctggttcacgtccgatcctacgacacgtgccagcgcatgtaaccaggaggcccagggaggacccggcgggactccgggttatagatattgctgggctgtaggaagggaggggctccggggccccaaggctgagctcccaaagctcttgctcagagtcagagtctgggcggcactgggcaaatggcacacaacacaggcaagtcctcaccaggctccgcccttgcagtgatcctggagaagcccatccggatcccccggttcctgtccgtcaaagcctcccatgttttaaaaggatttttaaataaggtacgtttctggccatgctgacaaaatctcgtttgtggcctcggtgttggtgggcagagggccaggcacggctgttggccattttttcatgtcggctgctgtgtatcgggtgtgtgggttgattttccgcttcagtatttgagctctgtgttctgtgaatcgtccgtttttactcacacctaacaaaatgagaatgtgtgcccaaggaaaatggaacggagcttaacgtacggggaaggaactttcaataaaggaaacatctgatttccaccacctgggtcagagcatcgggggagggcttgtcagcactgggagtggccaccaaggagagggggtcatggggcttccgggatggggctgacttgtccttgtttgaactctgacctccaggaccccaaagagaggctcggctgccggccacagactggattttctgacatcaagtcccacgcgttcttccgcagcatagactgggacttggtaaagcatcacaaagcctatttgcacccccatccccatcccaaccccaaatctacccaacccccatcccaaccccaaccccaatatccacccaacccccaccccaccccatccgaaccccaatatccatcccaaccccaaatccatccaaccctcaccccaccaccaacccaacccccagcccaactcccaccccaacccccaactcaacccccaccccaatatccacccaaccccactccaacccctacacccccaacccctccaacccctataatctggtggacagagccggggctgtgtgggccgggtgggctgtgtgagctcgcgcaccgccgggctggtctttgacatggccccacttgcgtggagccaaggctcctgtctcccagaagggtcagctgggaatgggggaccaccctccagggccccgaggagggatggggagacacatttcgtcctccggagccaggagagtgaggggccggacgagctcggcccatggcgcttcctggcaaccctcgactgtgctggcttggtgccgccaggagctagcggcacatgcgtcctgacctgtgagcacattggctgttggttccacagggatctgatagtgggggccggcctagagaagggcgtttgctttggtttcatggccggttttatcagcagttactggacaggaccagcagtcgcagcgttcacggcttgagctttagcgtcgggtattgaaggagagtgagtctgtggacagggtgcgacgtacactggctcgatttaggaatctgatttcggtggtgtgtgagcagggtgcattcggtagaaactactttgagttttgaccgttccccagctggccgtatgaggtcagtactctcctgtgatgaggggcggtgactgcagccccagcgggccacgtgatcaggagggggccgaatgtcccgaggggctctgcgtgcagggggttttgccggactgtaggctggcgtgtgtctgtcaggttaaggcaggtaaggctgcgccgcttggtcgtgggttctgtgtggaagtgcagtctccacccaggatgtttccagcgccgctcggtcgtgggttctgtgtgggaagcgcagtctccacctaggatgtttccagcacatggagggtttattgggaggtgaccttgtctgaagctgaggagcgtctgtggaatttgtttccagctgtgtaaatggttgcagagctactgaaataaaacctttaaaatacactctcaaggaaaaaagcagattggatagctcgttcagtgcattttggaggaggttgaactgaatcaggagaaagcccagctctagctctgtcctccaccccacccaacttttccaggcagcctcggccagcgtgggaggtcactccctggcccctgtggtcagtgggggcccttgtccacacagcccaacaagtcactttctagtcgaaggccttgctttgcctgtgcatgtgtgggaccgtgggggaaggtggggagtgaagtggtcagaacgtgcccacaccccttcctacatacagcccttccagagcccagctgggctgctgccaaactaggacggggccattctctgtcgtgcggttgtcagatgcacacacttagaaatgttctgagcataggcacctgccacggaatcaccttcgcaaattcttcatttaaatttatgcctctggtagcataagggagaagagatctgcctttggttctaactgtcagtcatcctcacgcccaggccggggttagaggtggcgtcccttttctctggctcaggcacccctggcctagtggggttactggtggcgttcccctatctcaggccacacctggcctagctggtgttagtggtggcatccccttgtctctggcccacagaacccctccggtccacacacacactcaggtccaggtaccacccggctgaacccgtagcaggtgcttagtagaattacgtgaggagccagcatccccgctcccagccacctcccctcgcccgtctcagctcagtctcccccgtgcctttcccaccctctctcttccaagcccaccaccgtatggggcccaccagcaccatgggatccagggagagcccgatcctgggtgcagccttggtgccagccgggcccctgatcttgtctctcaaccactcttggtttaccgggagtggacagatgaggacagatggctgcctgtggagtgacgggctccttctcttcggagcactgtctaatctgagtgtgagtccaaccctgcccgagccggaactcaaggagaccatgaagccacccttggcctctagctgggagaggtctgcgtccctgcagcgagcacgccaggtgatctctggcacacacttgccgcgggctgtctctcggaaggtagtcagcggccctggcttcccacctgggtcccaccactgcagaatcacccccgtggctgcccacaggggcggcttccatcaccctgcttcttcctggctgctgcgggctgtgttgtgacttccatcccagcctgagaggcctgcgaagggcttgccaccgactgccagccctgcctctgccaccgaccgccggccctgcctctgccaccgaccgccgaccctgcctctgccgtttccttgccacccatcagctcttgaggcttttaggaagaagtgtggctgttttggccagattgctttagctgtcctcagcagggttggtgtggggtcaccaccacccccatgtgaccttggcagaaggaaggtcctcctcccattcacccaacgcctgcaactcagtggttctgagcaatcccagagttacatgacgtcatcgcgatcactttcatcaccctgtacccagagaagacccgaacccactccagcctctccccacaccctgcagtggctgctccgccaggctgtgtggctctgcctggtctgcacatgtcatggaagtggacctgggcacaccgcggcctttcgtgcctgccctcccctcagcattgtctccacaagctgcacccacacagtagcacgtggcactgcctccttcctgcgctgaaccccacccactgcgtccactgcgtggagactgcacctctgcatccgtcctcagtggacatagggtggcctccactttctggccattgtgaattgtgctgccgtgaacacctgtgaacccgcttctgggtggactcgtgctgctgtgagcacctgtgaacccgcttctgggtggacacgtgtttatttctcttgggcacgtgctcagggcgcagttgcaggtccggtggtctcagtctagcctttcaggggggccacctgttcctgcagcggctgctttctggtccctttgggggccccctcagtctgtgctggacttagttccatggctgtagtgggcacagcttgagaacagtccctcggtgggtgtcagctccatgtgggagtggggcacgtgtgaggccttggtccccacctgtggactcagggtctctttcacggactgcggggaaggcagtgggagcagcaggaatggatggtgaaaggacacagtgcccgccccccgagtgtccgagggtagagctgggacagggtcacagtcaccccaaagccgccccctccttgcctatccccagctgaaccagcaccactcaggcagtcgccgccactggggtgtgactctggggcccggcaccgggtccccaacactgctttcctcctggagcctggcctctgcacactgccctggagaagagaggcagtgtgtgtgcagagggccccgtcagccaggcagatccacctgccttgcccctgcactgggaggtggcgctcatcttgtcgggggctcccatgggccgtgtctagaccccaccctccgccggtccaggcacatcctcaggctcctaatcctgagtcctccggtttggctgtgggagcaaaggccgtggggaagttgctgggcctgtcccgggtgagctttgagtgatggacaggctcattctgaaggaactgggtccagacagcacgtcctggcctggtggctggggctgccactctaagagggtccccatccccgcaggatccccggtacttggcacactgcaaagcctgagtatttgtggatcacgtgatctgtgctagtgactatcaggagtctgagatttgaagcgatggatttcccagcatggtcccagctccccactgatgtgaaaggtggtggtgagttaacagctgagccaccacctgctgcccaaccccacgtgtcccacacggccgggcggtgctgcgctaactcatctccccctggatggaaacgtttgcgtggtgacagccgattctcttgagagtcatttgctgcccatgttgctggggagattctgcctcagggccaggagtggtttgctcctcccaccccgggcccagggctgctggtgggaggccccagggaggagcaaggactctaatgcttcgtgtggtgggagcctcaggactttcccacgtgcgacaggcacgttcctgggagctcggtgggaggaacccagccacgttgtgtgctgcgcaaggagccggcggcagggaggggaaaacggaaagacgcagaggagggcaggtgacaggaggcccacagagagatggctgggtctgggcagcgggtgggagcaggagggaggcggttatgggagacgtggagcagtggaggccgtcagaagtggggatcacagctgtgacctcatggagagggacaagccccacagctgggctggtgccagctccactacccagggccaacctgtgtggccgtaaaattctcaagcctggagtgtgtagaaggcagcagtgccctggcctggccacccgcgaacccctctgtccaccccatgctgcgtggcacagggcaggcgtggggcctctagctggagccttgagtgggtggatcctcggtggggctttaaggccaacctgtttatgaaaatgcatggggactgactgcagatgcacagacaactcagatgcacagacgcccggacgacgtggacacccagacgatgtggacgcacagacgacatggacgcacagacgatgtggatgcacggacgacgtagacacacggatgactcatccacagatgactcagatgcacggacacccagacgacgcggacgcacagacgacgcggacgcacagatgacgtggacgcacagatgacgtggacgcacggacgacgtggatgcatggacgacgtggacgcacagatgacctggacgcacggacgacgtggacgcacggatgactcagatccccagacgactcagatgcacggacacccagatgacatggatgcacggacgactcagatccacagatgactcaaacgcacagatgactgggatgctcagatgaccgctgctgtgctgccaccccagggctctctgggcgtttcctgtggtttgggcaccaggagcctgggagtcccatgctgcccccagggcactacctcctgggcccagccctgcatccggtggcagggctcaccgtcatcaccccaacagtgcagggtggtctcagggacctcctctcatcattgccaagaactggctccaggatgtttccatgtggccggctagtatggccaaagtggaccctggcgtgctgtccccttggacgcctccaggccctgcccagcacgtggggctcgtccatcctgtgcctgaccatgctctgccatgcggggcctagcccagccccccagccctgctgcttctccccaccccacccccgccacctccaccaagccaccagcatcctgcctggccctacggacagcagggtcgtcctgtgtccaaaagcctcctccccctcagccccttcactcgggtctcatggggcccctctgtggcccccagcgcacaaggcacgcacccactatggggcctttgcacagctgtgccctccccaggctccagccctcacctcccccaggctatttctcagatgtcccttcagaactagagcccttgggcccccagccccattgacacggaacgggccccctgttgtatctcaggtcactgctgtggttgcagccacaggggcaacacctgttactgccacagcgtccgacctggggccagcgtgcattcaaacgcactgctctgagaggccaggacgtccatgggttgggcgcagggggcggcggtgggaaaaggtgtcaggcaccatgggtcccgacctggagcccacgtgccagctgcagagatgggcactgaaggcttttgagcaagaggaggaggtaacgctggcccctggggatgctgtcagggaaactgaggcaatcttgagccctcggagcagagaacgggctgggccaggggctggaggaccctgggccagctccagctgggtcctgctctgttcccacccctgctgcttattaaacccttgtaaagcagcacaggactaaggtagggaaagtactttaggaaatgcccctttttcacattttatcggcaggtgtttcatacaaagaatacaagtaactgatgaatgaagggggcatcttgtgtccccacaatcctgctgtgcgcacaccacaggtgagccgttctgcctaagggaacagccccggcccctccctccggctcctccccagcaccgtctcctccacccagtggcctggccgtggatgctgcctgtggcccagctttgagacaccgccctgacacgtgtccagccttacgtggaaggatttgtctgttttgtggcatcctagtagatgccacgttagtagatgccatgttagtagaatggatgtgggcatttctttgtaagttcccaaaagcctatgagggttttttccacgattccgttcccagtttggcttttgttgttgttgtggctgttcttggcccccctgggccctgcagtggagtggggggctgcacctgggagcctcgagctgaggcccagcccctcctgccctgcattttcctgccaagcagcacctgagactctgaagccgatgcctatacaggcagaaacctgccaattccagcttgaacgactggagggtcctgaggatgggggtccctggggtgccatcatgggcagggtgcatctgtttgggtatgctgccccccagctggcggggcaccggggacaggcacagccacactgggggcatttctggtcttggaagccttcttggctcttccggagggaaggcggctgctgggtgccctgtgatccacccgcgagctgggctgttcggcttggtctgcaggggctggggggctgcatttcttttcaccagctgcacccacccggccccatcctggctggcaccgaagggagcagcgcgccgtgacatcctcccctcaagcctggtgaatggtggttccatgaggctggagtcagtgggtgcctgttgtgacagctggatttcagtgttggtacaggagcacacacctaaggggcgggccagtgaatgagtgtgcgagggtgggctagagaacgagcaagggaatgagagagagtgggttagagagtgagtgagccagtgaatgagtgagtgagcaggagtgggttagagagcgagggagtgagtgaatgagtgggctaaagagggccgggcgcggtggctcacgcctgtaatcccagcactttgggaggccgaggagggcagatgatctgaggtcagcagttcgggagcagcctggtcaacatggtgaaaccctgcctctactaaaaatacaaaaacaaaattagccaggcgtggtggcgggcgcctgtactcccagctactcagaaggctgaggcgggagaatggtgtgaacctgggaggtggagcttgcagtgagccgagatcgtgccactgcacttcagcctgggagacagagcgagtctccgtctcaaaacaaaaacaaaaaacaaaattagctgggcatggtggtgcatgcctgtagtcccggctactcaggagactgaggcaggagaatagcttgaatcggagtcagaggttgcagtgagccgagatcgcgccactgcactccagcctgggcaacagagcaagactccatctcaaaaaaaaagtgggctagagagtgagtgagtgaatgagtgaatgggagtgggttagcgagggagtgagagggtgaatgggagtgggttagagagggagtgagagggtgaatgggagtgggttagagagtgagggagtaagcgagtgaatgtctcttggtgctgctgtaacagaatacctgagcgagcctgggtaatttctagggagcagagttctttcccagctgtggaggttgggagtccagggtcatggtgccagcaggcttggtgtctggtgaggcctgatctctgcttccaagatggcgcccaaacactgcattccccggaggagagaggggaggaaggccacgtgtccacatggcagaaggcagagaggaatccatgcccaagctgtcttgacagctacaggagtttgtctgtgagggcggggctcccatcaggttccacctctctacactgttgctctggggaatgagtttctcactgtgaatctggggggcacattcagaccctattgtgggtgagtgggagagcatggctgtgtcactgggacaagtggccatgagtcgggggaactgaggggttttcagtgtcctcacccgtatgtgttgtggcacctgtgccaggcaccagcgttctgccctccccggcacaggcgcatcaccgagtcccaggcccgcctgctgggcattttcctgccaagcagcacctgagattctgaagtcgatgcctggataggcagaaatgggccggcaggaggctcctgacagacgggtctgtgcagtgccagcgcaggcagggtgctgtggccaggtcctacacctttatggtcagggttccaagacgtcatgagacggcttgttcagccagttagttgtcggtgcccctctgaacaaggacccccccaaggaagggggtggcctcgcatgggtggctggggatcctgctccgtcccacatgtggccagcatggccgacactggcatttctcagctcgacaacaatttttctgactttggatattttctagattttgtgttgtaagaaaaaacacttggcagtcaaatactaggcagattgaaatgctgactttctcactgtttcattttgtgattgaagtgcgtgcaaaacactcaatctggtagggatgatgcccgcgcggagctgacccttctcctattgtttttccaagctggagaagaagcaggcgctccctccattccagccacagatcacagacgactacggtctggacaactttgacacacagttcaccagcgagcccgtgcagctgaccccagacgatgagtgagtcccactgggtgcgggtccctggagcacccctcgggcagccccatggcaggccggcaccttgggcagctggtgacccagcctgcccttgagtcccacccgcctggtgtcatctctccagtgggcgttgggggaggattcttatgcgaacgtgactccgcttcccccaagggaatgaacacacggtcacccccctcccccctgccacctttgcccacagggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaagctcctctgatgccttttttccgtgagtggcgcctgccccacatctcagacgcaacccacacgtaggggggcagcttaggagccagcgggacacaggtgggggcgggagttgaagtacctgtggggacacaccgcaatcaagaattgtttcctaaaaaccccggtaagttcctgttgttcttcctgcagagtgtgtcccagccgctgtggtctagggtgaagtgacaccttaagcagatggcagctgggccagccagctcactggaccgatgggggaaattggatcatagagattctaaaacgtggcccaccaaagcacagtagaccaaaaaagagaaaaaactgaacactaaatctgcacaaatcatttctgaccacactaagcagtgcctgcacgatgcctcgtgcgacgcatttgatttttggaagatattcttatctgtcacacagcactgagagttagggaaaactaaaagatgtgcatgtgacggaccccagccttaaagttgaacgtgatgaccctacaaacacccagaaacacaggcactcttcccagcggcgcggacctcctgctcccgggaacacacccgcgctctccgtccacccacccctcaggtgaaggcacagctgtccagagctgaggcttcctagaggcagggctgccagctgccaggtgtcaggtgtggcagagccgtcttctgagctccctgggagagggggtcgcgccacctcatgcctctgagtgaggcctggtgcacaggtgtggaaattgccacgcagccctcttggccaggcgcagagaccccaggcctccatgactcaggggccgctccaccccattgtgcggctggtggcttggggaagagagacgtaaaaccccaagttaggaggtctgtgccgcgccttgccttgcctcaaggtcatccccagcaggtgagcgtggcccaccctacacactcaggtttctcagggtgccactccgtgcctggcgctcagcacgacatggtggattcacacccaagccccaggtgccaggacaagaatgccagcgctgggcatactgccggcccattccccccggcccgagaccctggacacccgcccccccccggccagctcaggcttctaggtggaatgtggagacgggtttcagccacactcccaaccttagctgttgagactcaactccaaagacggaaagttagaaaccccagggcagagtccaggagccgacctgggtctcacacaggtgtcccagaccagcgtggggatgcccaggtggccaggcccagcctgcggccgctgaagttacacctgccgggtgagtagggctgccgggaccccaccttgagtgggagacccccagtgtatcccagaagtggttaacaagcaaactgctttccatgagcctccttgatttgttaaatattgaaggcacttacctaaatactgccgtgttgccagtagcgtgccggttaccagtttggccgttcttgtacacaatatgtgagtaatgctgtgctcatcagaggggagacttttatattcagtaatttgttttataaattaaagtgaaggatgtattgaagtgtggtttgaaaaatcctgatatttgctaatggctccggtcacgacggtgtcttttggaagtggttctcgaaaactctggtgacttgggggctgcacagtgggcctgcgtgggcgcggtgcggggcaactgcccatggagcccgtggctggccggctctcctgtggatgacactcacccttgactgccagggtcattcaaagtcttgcacatccatgaaagactttaatggaaatgttcacattattattttcattaaaagcaggtgtttccaagaagcaaaggtttctgaagccattttctttttttttttctttttcttttttttttcttttttttgagacagagtattactctgtagcccaggctggagtgcagtggcgagatctcggctcactgcaacctc

SEQ ID NO: 13842 - DNA, 11465 bp, Human
atttcctcctgctgcccgggaggtaacaccctggacccctggagtctgcattctgtgagagcgggcaggccacagagaagggagaaaagggacggagggccgaggcgggcggatacggggagcagggagcggggacagggcttactcagcaatcagagaaggcctcaaggaagaggtgacatttcagcaaagacctggcactgtctgtgccctcggtggggcagatgggctcccttcagcccccttgaggcctggcacctggggccctatgtcaggcttggggccttggtgtgggagctgaagtcggggtaggaggggcatggaggaaggggcaggaggggctgagtctcactgatgcctgtgttagtcttgtctcttgccatgcctcagtttccctcctccccagggtggggtggatgagacgactctggaggacgtatctgagagagtggggttggagccccgtaccggcaggtgtaggcgctgtgtctgctcttggaggttgggcgttcttggggagttggtgagggaacgtgctgtccctgcaccctggagcccccatgccctcctggggcccccgggagtggaggatgcaaggggcccccttcttcttccttgcaagacccacatggctctgcatgtgggggacattcctggcagggggcgctgagggccaggatgtgagtgcaccagggaaacagcagatggggctcctctcccaggctccagctgtggggtgggagtccatgctcctgcgtgtctcttgggggcttttcctccactgggtgccacctggtcccccaccctgcctcagagtattggggtctgggctcgtccaccctggatgctggccaggagtgcacctgcctctggagctcgggacgcttggccccacaggacggtgtcgcacaccacagccggcctaacttcacccctgcctgctccctctccagggccggcctgcagggctgcacactttctagttggggtgcaggtccccgggctcctgccacagattcctgtggctggccaccctgccaactctcctgcaggtgagggtgggcgcaatccccaaggtcctttccaccagatgccactgagtcccccaggggccagggctggaccctggagggggtcacctggctgaagtcaggaccaggaggggcagggggcagtcgaggggcagggggcggtcctgggccaggcgtctggcagatgggcttgctggaggtgggggttcctggtgtgcagcaggcggtgccagagggggtgactgggacctgctctgggcaagcacaggcggtgcgtgacagacctgggcttccattgactgcatcacgtccagcagcaggaaggggccacgggggcactggcgtcgtcacgtgggtcacgaggttccatgtgatgcagggagcgaggccgtcacgagggactcactggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtgtgagtgaggtggggaaacacagatggactttggggggctcccccttctacaggaaacccggagtggactggaatggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgagcccccgagcctcctctccgtctgctcgcagatcccagttctgaccccagggcctcccacagatctcttccccatgcccctgtcctggccgttgctggctccggcgtccagcccgtcccctgctgcctggggctctcgggtcaacccagacccccagcactgggctcaccacagtggggtgagcagcagagccacagccctacccagcagacctcctcctgcgtgtgtcccccactcaccactccgtccacgggcagctggtgagcccccatttggccggatgtgggcacttctgggggctgggtgtctctgggcgtctctgggcggggccctcgagcaggtgacccaactccccggcagccctgaccttggtgacaggtgataagatcagtgtgcagcagggggctggacccaggtgggtggggtggggatactctccatgctcatgtggcactcctgcctgtccagccactatccccatcaggggcccccgactgcccatcagccagcccaggaacgaggccacggcagagccaccctccccgatgtggccctgatcagcctgtcacccactgtctggcttgtgagcctctggggcccatccctggctgcccctgctggctcttcaggggtcagcaggtccaacctaggccagcaggggggccggcaggttgtctgcccagtgggctcaatgctcccaggtgtggggtgtggggtccctggcgagggcagagttccagttcccagggctccgcgctgccaggcagcgtcatcagggctggaggaggggcggtccccaccctatcccgggctccagcggtcggcaaggttgttccatgagcctggcctggggcccgcttctgtcctctctaccaggcactgccgctcctccccattgcacagagggagattcaggctgtggggccaagcctggcagagcccacagggcagccagggcatctcccaatgcctgtcctgacccccttaggtgctgtatctcaccttcctgggagccccctgctacgccccagctctgccgtcctgcaaggaggacgagtacccagtgggctccgagtgctgccccaagtgcagtccaggtaggtgcagccctttggcgggccagctctgtgggccgagggcagacactcttgcccccttctgccccagacacccctgtgttctctgcccccacagccatgggtgtgatgaagccctggggctaggtgtgcagacagtgagggcagaacccccaggccagcagcttggactcttcaccctgggggaccctcacagtcacactgcacagggggtgggtctgagagacgtggctggcccaccgtggccagagacatgggctcgggggcacataccagagccgggccaggtgtcccaggaggccccatgtgcttccagaactttccgattttccccagagcagctctgctcatggctgatggggctgctgtgtcccgtggggctcatgggccatttgagtccccttagctggtgtctccctgcttgggctctgggcgcgggtggagtgatgggtgggctcccgaaggggcctcccgcagacttgcgaagttcccactctctgggcggcaggttatcgtgtgaaggaggcctgcggggagctgacgggcacagtgtgtgaaccctgccctccaggcacctacattgcccacctcaatggcctaagcaagtgtctgcagtgccaaatgtgtgacccaggtaagaggccagcacagccggcccagcctccgcttgggcagcctggatgcccccgcaccctgcaccctctctccatggccacagtgccccaggaaggccccggctgccccaggccaggtcccaaccccatctccatggatgcaccctgcaggggacgccttgaggtcagcctccggcccccgtccacctctgtctcacctctcactttgtcaccgccaggtgggccatcctgagcttggcgactgacccttatccctcgtccttggctcctctggtgcccggggtgggtgcccagacctctcctgtgcccacgtccctagctgcaaagtggaatgggatggtgctgggactctccggccggcactcgggcctgctgcttccccacagggcttcttgtccctttctcctccagatattggttccccctgtgacctcaggggaagaggtcacctggaggctggtgcccacctgagtccaggcagacagaaaggggaaccagacccagaggtggcctttgagtcactgagcgcagagcctgtccatgcggccaacggctctgtccccttggagcctcatgccaggctcagcatggccagtgctccctgcggccaggcaggactgcacctgcgggacagggctgacggcacacctgggggcagggcctgagcctacagggaggcacagggcaggtgggctagccatgaacagaagaggaagctggagtgctttgggggttcatgcatgtaggctgggatttggggctcacacctcaacctgcatgcccagttccatgcccctcccctcttgtgaaagcacctgtctacttgggctgaggatgtgggggcacaggtggcaggtgaggctgccctcaggaggggcccaggcccagcttgtaccccacctccaccagtacctgaagaagtggggctctcaccctacctgcctctgccattggaatggcctggtttgcacagatgggaaacccgtttgcggggtgggtgtctgggtgggcacgtggggcgaggacctgcctgcgggaccctgccctggaactgacagtgcaagctcggcgtcctgcccatctgggcagaaggctggtttctcccatcaacgaagccctcccaggaccttcctgcaagccctcgtcccacacgcagctctgccgtcccttggtgtccctcccggcctcaggtcctccatgctgggtacctctgggcacctcgtttggctgagccaggggttcagcctggcagggcgccctggcagcagtccttggcctgtggatgctgtcctggcccgtggatggtgtcccggcctccacgtacccctctcagcccctcctcttggactccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggtaagcggtgggtggcggacacccctcccatttccaccctggtccccagtgccccgctgtctggagccccaggtttcctcgacggcatggcctgcccaggggccctggtgagacagaaccttggccagccccaggcccacccacttcagccctgtcctggaagcagcccagtggggaacaggtgatggaggcaggggaaggggcaaggaagggccaccccaggttgctccacctcggggttctgggacttcccagtccccaggcctcgctctcgggcccctggtctggagcctgggtttatgggagtgaccatggttaatgccactgttcaagctaagtctaggaggagtaagtgtccagccctggcctgcatctggccgggcagcccccgcagcactgcaggatgtggacacagagggactcccggactcatgagatcccagctactcaaggccgggacagccagagccaccaccccaggccccacctccaagactctggacagggagcctgcccctccccgctggtcctcccatcacccgtagagcacccaggtctagaagctcacagacaagcagtccctagccgccagccccctcctggcctggtgccctcagccccctctgtccgtccctctcttctcaggcaccgagagtcaggacaccctgtgtcagaactgccccccggggaccttctctcccaatgggaccctggaggaatgtcagcaccagaccaagtaagtgaacccgggggaggcccagctctgtgccctggggagggggctccacgttgcttccctgggagatgaccgtcttctccagcagaaaggcttgaaggtcccaccctgagcggcaccctggtcacatgcctgcgtccaggagagctgcagggctgaagcctgtgtgccccagataaccccttccatgggcccagacaaagcctcatcagatctgagcttcctggaggctcaggatgggccttcccagaagcaggcccagagggaggctgcctccagatcccctgtcccctggggctgtgggtgtccctgaatgtcagggccatgggagggcccctgggcttcaggggttggggaaagtgaacactctgctctttgtccaccttcgggaggacaccttcaaatgctgaccctgggcccctaactgacctgagacttcagagcttcttgggaggagctggggtcccccagcggagcctgggatggagcagggatggctgccccagggagggggcggtggggccttccatcctgctctgccctcctcgtcctctggccccagctcagtcctgtccatctccagctctaaccatttttgtcccgacactggctctccctctaccttctgtccttgtctgccactggtctcccgtgctctggggtctctgcactgctggctgcctcccgcttctctcccctctccctctgccgtcctgtctcctttgcccagtctctccttgtttctcttctcctccttccttctctccacctccccatagccgagcttggaaaagtcagacagacctctgaggtctcatcctggagctgccaccagcccagcctccctgggacctgtcttcactgcctggggccctgggagccagggaggctccctgaggctgagtgaacactgggcgctgcacctgcctctcccacgtcctcggccccactcccgcaggtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgagcacacggcggccccatcagggctcatgtccccagccgtcacctcttggagctctgtcaccccaagcctgggaggtggccccagagcttttccaggatccgcggctcctcccagggcagccactgcaggctggggcaggtgggctttctgctgtggccagagcccaggtgtcagctggcctccctgggggaagggaaggtgggacccctgaccgtggagccctcagccacccctgcccacgcactctatgaccctgtgctcctgcctgccccctgtgggatgtggggagcaggacaggccctgctcagctgggagaagctctgggctgagggtcaacagccgccctgctggggacaaggctttgtcctcattgaggagagtaaggccattcattcattcattcattcatccacctatccgccctggtctgggcacctgtgctgtgcctggcctcctgtgcctggcctcctgggcactgaccccgctgtgtggacccggctgtggccctgggagccctgtgcacagcccccggggacgcagcttctaagcattgaggtctgaagggaaagtcagccccatcctccagccaggcggcagcaaagccacctgatcctcacccggggcctccaatgcggggaggtctcggggcctcaggctctagggtaggccgggcagcagcttagtctcacccaactgggcacctgctggtatggtgggcagggcctctccactgtgaagcgcttgttcccctcccatagatgacggttgaattagggttagttatgcacttgggggcctcagctggggaggtgggccgggcgcccccagtcctatcacccatgctgggcctcctggggacaggctgggctagcagtcccaacacagttggcctcctctgctctcagagagggtcagtcccttggggacggtctcccagggagaagcaggagttgtgcctccgccaccgctgtgagaccattgccatgagcctgtgtcccctgatcagacactgcccctccctgacctgtgtgtctgtgtattgcaggtgatgtagtcaaggtgatcgtctccgtccaggtattgatcctcctccccctctccctcccccctccaccttcccacctcccctctccccgctggggctggtgtttctggtgtacatggtgggggctcccagttctctgagggtcctgagtctttcaagtacagccacggtagctcaggaaagaacccaccccctcaaactgaaagcagtaaaatgaacccgagaacctggagtcccaggggggcctgagcaggcagggtctccacgattcgtgtgctcacagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaactgtcacctcccggtgtttcttgctgaacaaggagttccaggatggctgctgggctgttcgggggacccctgccctcctcccgtcatgcctgggggttcactccacccagagaggagccctggccgccccttcatatcccaacagctgagctctcagtgggctcttctgacctctgtggctccgtccgaggctattgctgtggattctgatgctcaaatggtgtcagatttgcccagtaaaaaccccagatctacatctgacctacacttcccagctgtgtccaccgagaaaccccagtatcagtgacgcctgctgtgcccagccctctccacctgctccgggaacccgccaggcccaggtcccgctggcaggggcttcaccaggcctctgagccacacattcatttaatggtcgggatgaggcccctttccccacatctgaagttagaagcggtgaggggaatgaccctgcagccatgccatgaggatggaggccacatagcccctccgagcatgcccgctccaccccgccctaccccctctcctttccttgtcacctgcctccagcagagcccccaggctgagccacccaccccaactcctctcctgccaccccttgtcctgtggaagctttggcttagcgtcctggggtgtggagaggcccatgcaggccaggtggagccctgggcccctagaaagcagcacttctggctgccccaccccgtgtcaccctctccccaactggaggcgtggtctccagggaccacgggcctccctgtgcatggaccggctcctgaccaccgtccagggtcattgccagggtaccttttcagaggctgaccccatagacctggctgccccccagtgctagatgggagccaagcacagcctgcccttctgcccacagtcccgggggcaggtgggagcatggggccatggagtgagcgggcaggggtggcagagggctccctggtcaggggccccaacttcccttcccccagggaggccacctgacatctgggctccaggcacagcaggaagcccacctgccccaacctgtagctcctcctcctgggaggagccatggatcctggaaaagctctggggccacctcccaggtttggggggacagagctccaagagacgacggctggggacacgagccctcatggggccgctgtgtgctcaccccttgattttcttcttttcatgcatgagattaggccaagtgtggagaaatcaatgatgttgacgatgaggctccctgagagaaatcacacccagcgggagctgctgctcccaggtctggcctcggtcaccagccacctgctgcatccgcgggagtggggccgaggacatgggagtggcaggtgcagcccccggtactcactcagccccagggagtgtccctggctcccagggctctgggaggtgagggcaggtcccgggggaggctgggttagtggcagctccgggatgagacctcagaggtctgtctgacttgtccaagcccggctatggggaggtggggggaaggaaggaagaggagagaaataaggagaggctgggcaaagaagacaggacggcagagggagaggggagagaagtgggaggcagccagcagcgcagggccctgagagtatttcagcggcaccgctgtcctgggccgcccggtgccacatctttgaaaacagttgtttaatttaagcttgtccactcagtagctgttgaatgtgggaggttatcttgttctattcaagttgctataaaaataaaaactaccatagactgggtggcttaacaagaacagaaattcggcagggcgaggtggctcacgcctgtaatccccacactttgggaggccgaagcgggcagatcatttgaagtcagaagtttgagaccagcctggccaacagggtgaaaaccggcctctactaaaaatacaaaaactaggtgggcatggtggcgggtgcctgtaatcccagctactcgggaggctga

SEQ ID NO: 13843 - DNA, 18508 bp, Human
  misc_feature (1)...(18508): n = A,T,C or G
cccggggagaaactggtttcgtcagctgtggggcagcagctgcaagaagagaccacagatgcttctcaccgtgcttcctccctgctttccattctccttcatatcgaaagaaggaatttgggtatacgtagacaccataacctgagtattgagaagacacacacaggtaagcacagacacagagatgagggatgctctccagtgctgaaggagggagtgcagctcccttgagggccttcaaggggttggtacacgtcaccttcagcagaccagaggcgacctgtggggctcatgagctctcctgtcgactgttgggccattcatttgctcatttgtttatgtgacaaggatgaggacctacttggtgcagagaagacaggcccagtaagaggagggctggcttgaaacaactgcaggtccttgagagaccagaggtgctcgggaggtggtgaggagcaggttgggagccttgttgcaggagatgagtgagccaggggaaggcagagcggcagtgtcagtgaggcacacaggggaggagcagactctcccatcccctgccgtggcccttcagtggcctcctatcgctggggagaaaatccacactcatacccaaggatggcctggccggcttcatctcctcctagttgctgggtgtgccacccgccaactcctgcagttccaggaatgggcagggctccctccctaccagctcctcaggcacattttgtgggcagggtttatgggaaaatgtcggggaggagggcagggggttactacaggctactgtatctgtcccaaatcagggtcaggttctacctgaagatagtagtgttagctctgagttcattccagacccgtttatttgattctagaaacagttcctatcaaaacctgctcttttttttttttttgagactgagtcttgctctgtcgcccaggctggggtgcagcggcgcgatctcggctctctgcaacctccgcttcctgggttcaagcgattctcctgcctcagcctcccgagtagctggaactacaggaggcaccaccccgggccaatttttgtattttttagtagagaccgggtttcgccatgttggccacactggtctcgaactcctgacctcaggtgatccacccgcctcggcctcccaaagtgctggaagtacaggcaaaaactgcttttgaaacgcgtcctagcgtttctggacagcaccggccaggaagtcaggaggcttggtgctgctcctgcgcctgccctcgccccaagtcctgggcttcgggatccccatggcaaccccaggtcccgctggctgtgaggctgcggccggaacccggtcttcccggctaggagcccgcggggggcgaccccctgcagggcttggcctgctgcgggaggagggctcggggaagggtgcgagccgagcccgaggcgcacggcgagtcctgtgggagtgggggacgcgggggcggccctggctccgccgcggcacctggacctctactttccgaggtgagcatttgggggtcgagggcgtagagcgatcgcaccctgaatggagcccagggcagccagcgacctgtcccgtggcccgcagtcgttaccgttccggggcggccgcctaggcgggtcccgacgcggcccgcgggagctcggggtgccctcgcccgccgctgccatcttgccgccgagggttctcttagcgaccagcaacgcccgcttccattggtctttgtcgcaagggggggtgtggccacgggcctagtccctgagcccgcgcaatctctggagcgaagctagccgggcccggagccagaggacgcagctgcgcctgtgcgcgtttccgccgctgtcgtctcttccgccgggaggcccgcccgccaacggcctgcgcgtctgcgccggaagcggaaatggttggagcccttggccccgccctcgcgccatcttgggggccctggaggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgaggtgccaggaagggctgcgtggcgcgggaacggccgggcagcgccgcctccgcttcttccgggctgtcaaggccgcgggcgggcggggccgcgctgagggccgggcggggagggccgtcggggcccgggtggccgcggggaccgtgttcccgacccgcggccctgaggggcacgggtcgcgcctcggggtcgggcccgggacggggtgctggggggtgcggcggagccctggggcctgcgagggtcgggggagcgggagaggggccgggcgggggctgcagccctcgagccacccgggccgcatctcgtccgcatcccctgcttggcatctgggggaagcgggcagtcgcggcccccacagcgctgcgagttgggctgtattccagagtaatgtgccctgtccccatcctgcgtccaggtcagcgcttatctgtaggatttagtgttaagctctggggtgaaggcgttactgacgggctgaagggaaactagttacatcggttttgatcgtattctaaataggcaataaaatcataaattctccaggctgacttagtactggtctgtggccccactgataaaggtatcgttcgtttctctgccaggtgtcttacagcacagagggctgctttcagcctaagtaccttcagtgggcttttgcccttttccctttatgaagagtagagactggccgctagtcctggaagcactttatttttagttgagttgacatttcccaggaagatgcagttatccccgtaagtggataaagggttctcagtaattcagactctcacatggcttctgccgtatgcctgaggtgacggcgacggcggtaacagtgtgtcagagccaggtggagatataagatggtcaggcccagaggagcggggagcccaggctggaatgtggccttgggaaggaggaagagacggggtctgggagggcatttcagaggactgaacaacaccagaggcgtgaagcttggtgcacggcagccgggggctttcttagtcccggaggaattggggatggggacgtgaagagaaaggtgggagccagactgtcaatgctcccggacgccaggcagaggacttcatcccaggcttcagtgctcctggacgccaggcagaggacttcatcctttccacgtgcagagtgatggaccacagatgtggatgaatgtgacgggcctggaacaaggcacatagagagtcttacactttctggcacgtcctcatggtctctgcttggactggttttatctccctttctgttttgtttgtgaccaggcataaagcagtcaccttcaacaggtaattgatgggctgtctactatgtaatggacttccaggtggcagggcccagccccgaaccagacaagggacccctcaaggagcttcattctagcaggagaaaattgagaagtaaaccagaaaggtatcaggaaacagttgtacacaaaataaaaatagggtgatgtgatgtaagggactgggggtcagtgtgggcggtaacggaggcctgtgaagaggaggtgggcttcaaactgagcagagaagaggactgcagagggggcagctggtgtgagggctggccctgatccaggaacagggctggcactgccttgcccggctccaagggtgctccacgggctgcccactgattcctcacgagagccttgtggagaaggcatgagaggtgctgttgtcccatttcacagactggaacctgaggcatcctggaatagcctgtcctagtcacactggcagagagtggtagagccaggatctgaaagcaggctgttggagtccaaagttcacgttcttgctcctgccgccctgcctcaggctattcctggcaatgcgttcagtcagggtgcaagctgtgtttggtatacgtgtgtgtttggtatacgtgttgtgtgtgtcagacaagcaggattggctgatggcgttttgagtaggttttctacatgttcagttggagagtgagaagttctgagctttgcctagagaacaccctttggcgggagagctgggtattttctccctgacattactctcatcacctccagtccagtaaaagtgctttaatgggaaacagtctgagtaaaacggggaaacttacaaggagctataggacgaacaatgtgacgggtggctttcagatggcctggctttggcctaaatagggtggccattccaggtgacacattttagtgtagcctctatttaaatatggagttctttcagtggagagtaaaggtgctcctcctctgtgtctggtttacacggctccgcgagaccaaagggcccctcggtctccttgagcagcctggcactctgcacagaggatccaggaacggtgtcatggagccacattctgcacagacttgatgatgtggagggagctgcctggatcacttcagcgcatcagttgtgatgggagagccaaggcacttgagggcgggattgcgtctggccacctgttgccttccacctgaagggaagatttccccagtgctcacagtgaggatgggactggaaaagcgttggtttcaggaaggtgcaggttctggctcctgcccactgcgaacatgctgatgggccagggcaactctttagtctttgtgagcttcagttttcttatctgtaaatgagaacaataagactgaccccaactgttgctgaggaatgatgtctttgctttcatgtctggtatttcttagagcctcattttacagatgaggaaactgaggctggctgcgtgctcagagggtttgctgaaggcctcacagccgcttagcacaggtgggactttaagccaaacttgagaccagagtctgtttctcctcactgccctgccgagggagcagatggggggtggtgggggaggtgaacgtcacccctggcgtcttctctagctcaggggccaggaggcctctcatctttaaagtaggaatgacaaccggcaggccctgggtactgagctgtgctttaccgaagagcggcaggtcctgacgccgtctcctctcaggagtggggtggcggcgtgctcagctgaggagccaggtggcagtcaggcttggcttggcctgcccagaagcagggctgtggcaggaccttggacacgtggcttccactgtttgagacttggtgaaatgggggtcatgatgcccttcacttgagcatctgggaattaagtgggtgaacaatgtgacctctggcacctgggttctcaggtgaattcctcatggcatcacagcagtgttgaaataggagcagatacgttacctccgcttgccagataagaaactgggacgcagatggatggactacctgagagttgtagataacattttcctgttcatggggtggaggacctggccctgagaggacaggatccctcctgctcctgccagaccagagacccaggacagggcgtggagcagacaaggtgcctgggcgggggaaccctgagggatccacagagggtgcggtccttggagggaggacatgcagtgccacgtgccatggaccagccagtggaccccatggccagcaaggctgctcctggggccagtggggtggacagtcccgcccacgcaggtgactgaggtgccagtgtgggaatgaaaatgcggcctgtgctcctgggcccatgcgtctcacgctgcccttcctctccagggaagcctgtgtacctgctactttttcccgaacaattcatggtaaaaacacaaatggtatatggacaaaatactgaatgtggaagaaacctacttgacagtgttggtgaaaatagggccaggatttcacacccgtgaatgctttttactgaaaagtattttgtgtttttctcccagttacagaatgtctgaaggggacagtgtgggagaatccgtccatgggaaaccttcggtggtgtacagatttttcacaagacttggacaggttggtgggttttttagtagatgagtataaatatttgaaaaagaaacgggactcccagcattttcgggaaggatctgtttgctggtgttcctgatggagaagttacttcgcctcaggctcaaacttcctgaagacagcgttctcttcactgtgaagggccagctgtggagagatcgggctctggggccacacgtggtctatcaaacatatgcgttttctgtttctgttttccttttaccaagctttaaaaatataaaacccagtctcagctcccaggcaggacagatgcggccgtggctgccgttctgctcttgctgtccctctcccagccacccacgtccccggtgctggtagccccacctgccccgtgtcagctcggcggttctgtccttgagggtgagaggctcttgtgtgggctgcgtgtgcattgcttggtgagtgagggacctagagctgcctttgaacgctggagtccgaacctctgtcaggaaaagcttgggtcactggcagttccaggtgctgaggatccggctcaaataaaaattcatcaccttaattaaatcacatatgaaaagcgattggcgattaatgaagttgggtgacaggcatatgtaagcttctataatctttttacttttgtgaatttggaaatttctcacaatttgaaaattaaatttctaaattaaaataaaaaaccatacatatgtatatttgtaaaaataaatacataaaactaagggctccttcggtcatgtccacagccgcctggacgcacacacatgtgggtgtggctgctggggctcaggctgtggccagtgggcctgggagcggggcaaggctggctgctggctgctgcagatgggggagctgacttgagatgtgacgataagggctgtgctgtagggtggggactttgagatgcacagtcctctctttggggtgaggctgggtcttccccatagtgatcccttggggccagcacaatgtcacagtctcctaggagattgttttgtaatagtcttgcttaagagatgaacctgcttcaggaattattgaaaataaactttggattaattgtagtcacttctttgtgctgatacatagatgatctcttgctattttaactcactcttttagctgttttaaaaattgaaagccaaccctagcagaaggtacattttgtggcagggtcagtacagaagttacaggacctgcttcatgcttttggactcttgtctttctagatttatcagtcctggctagacaagtccacaccctacacggctgtgcgatgggtcgtgacactgggcctgagctttgtctacatgattcgagtttacctgctgcaggtaggtgtgggctgaagtgacgagacttggctctgtccacgttacctgggcgtggtgtttgtggggatgttgttgatccagtctgtcttgcaggaagtggtctctagtaatcaattttcagctaaacgccaaatgtcagaaagatctcagtgactgtctttaacgaacagggttgtttatgattcacccggagtcgcctcgccaggcttctcagtatacccaggccgtcctgagcccagcctggccctgccctgggcacgtccaggcctggacagtggagccgctggtgtccctccgaccctgctgcatgatgctcaggacaaggttgcgctctgtggctgcctcattccttgggtgaagagtccatgccttgggtgtcatgaatgactcggcgtccaaagggtttatgtagcttttcctgagctctcccttgtgtgaggccaaagcacagtgcaggttgagacgccgagtcaagtaagagagacagtgaccgaagggggtcttgagggtttccttcgtgtgttttcgggcacccctaggtcaggtgatgtcgtctcagacttcacctgggtgctcctttacttgctggtaaacacggggtttctaggagcaaacctgtaagatgggaattcttcgtcggtctttagaggaggttacataatcttatgtgcagagcagggcatgttgaaagccttgtctgggctattttctcctctggggactgtagaagatacttccttgtttaaagcacacaccttaatttatttatttatttttgtttttaaattggaactgggtccattctctgatggaaagaatgacctagaaatcttgaatcagggacttcaggcaggagcagggggcgggaagagtgcagcacccacaggtcagttttattgcgttcgaaaccaagctcgtgcctcatttggcgtctcttcaggtgtggccctgcagccgaggatggacacacagacatcagttagccctcacatccggcgttcggccgaggatggacacacagacatcagttagccctcacatccggcgttcagccagggatggacacacagacatcagttagccctcacatctggcgttcagccgtctgactggaaaagcttttaggcagaaagacttcttgtttgtatgagaaagttaaagcatttatatttttatttattgttttgagatggggtctcactctgtcgcccaggctggagtgcagtggcctgatcttggctcactgcaacctccacctcctgggttcaagtgattctcttacttcagcttcccgagcagctgggatcacaggcatgtgccaccatgcctggctaatttttgtatttttagtagagacgaggtttcaccatgttggccaggctggtcttgaactcctgacctcaggtgatccacccgccttggcctcccaaagtgctgggattgcaggcgtgagccaccacacccgacagaaatttaaggcttttgaaattgagaatgcggttctggcttttaacgggatatgcttaatcattttaaaaaatgaattagttgcaaataagtgtgctgcactcaggcatcttgccaaaattctccccacttttcatctcttgaggaaggcttggcataagcacacttttctggatttcccagttgtggatttcttctgggcaaaggtttaaccctcctggcagagtgtttttggcaatgtgaattgtctgttggaggaacatcagccagcacgcctccagtcacagttgagagtctgtcttctgtttctgatgaagctgctcctgggtggggctctgggccagcatcgctcaggtgcccgggccacccgagcctgtggtgtagcttgagcatgtgcttcttgagaaaagcctccttttctgctgcgctccttgtggggcgtctgtggcttcagggatcacatgtgtctaactggacccttgaagagctttgctcatttgggcccttgcttgtccgctttgtctctgttcccacagagtataatttgagataaattgttaccatgggatttcactgtatttccttgtccttgctatgagtaagttttgtgttaaaacaaagttagatcagttaacaaagttgagagtgaaccggagtgcaaacgtgaactggctcaggctgatggacggtcagagtgcaccactgactctctttccttctctttcagggttggtacattgtgacctatgccttggggatctaccatctaaatcttttcatagcttttctttctcccaaagtggatccttccttaatggaagactcaggtagggtagcggctgtgcactgggctgtgtgggcaggttgggcctttcttttctgatgggattgcccagtgttctctggaaacacccgagactcttctcttggggttgaaatgtacttgtaatgttgggtgatcaggatatgtttgtagaatgactcttcaaaccctcctgacagccacgaagtgggtgttcattctgttttcccactttgcagatgaggaaactgaggcatacagggttaggtaacgtgttcgaggtcacatggcaccacagacagtaggggtctgaggtggacagtccgactccagcccccgtcccaccccagtcagtggtccctctcagaatcagcggaggcagccatgacgaggttaccttttcccgtagccagagggttccacaggcagctcactgtggtgcacagagaccgccgggactctaatgccagcatcgggtcgggtcaggctttgggcggccttctctggtttctgaggagctgtgagctgaagtgttcctggtgcttcgtgctccactattggaagacttacgcagctcctgggcctgcctgggccaggtaggggccctgagttcatgcctgactggccagccccaggcgaggaacaaacaactgcattccaggacgtggtggccattgagggaaaacccacacgcagctccctgccaggaccctcctcgttctgggggaacctgctgtcagggagtagggtatgctctcactgtgtggccagaagcctgtgagtcttctgtgtaggatatgtgatgaaaagattgctgggaacacagcccctctctgttgttgctgtttggaggagactagaaaataacaaagagcccctttcctgtaggcctcagttttcccatctgtaaatggggagcggcacccatcccagtgggggaggcggggtgagagtgggcttggcacagctgctggtgggacaggcctggcgcccgggttccacggtcagcgcatcctcggccccgccctgttctctgccgcttgctttttatgttaatttgcctttgttttcttctgtgcctttacgtggtgcagctgacgtgttcctggatgtttatatgtggttgaattcttcgtgcattgaaaacgtgtggaagtctaaaaacattctgatagcaccttctgaaagcagtgaattggatgtgtcagttgaccacagacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttggctggcagaggactagccttctcctggagtcatttttgagaggggtttgagccgaggtgtccgtgtctgcacgggtaggcagaggtgggtggcgcagccgtcagagggacgggagcgtgtgcatccgtttgtcttatccctcataccccactctgggagcacaggaggaacccaagtctgttagatcagtaaactgaaggagcctgctgagctcgtggggctccacgccttgactttgcagccgcagatggagtgtggtacagaaagatcaggggccctggaagccaccagaagcttggactaggaagggagagctgagcctccagggccgtggcatctgttggccatgtgctgggacgggagggagcactggtggccatgccacagtgacaaggtgaaggccctggatggtccacaagacacagcctgggtttctctccagatcgcaggcccagccagcaggcatggggcccccagcctcagtactgatgctttatactttgtgtagttttaagaagaattgtgtctttcaagggagtaagagaaggatgtttctgtggttagggcagtacatgtctgtgagctacatgcaaagggtcctgctgctgctgtgcccagggtagacccctcctttccacagggatgcttctgtttgcggggacggtcggtgcagctgcaaggctggaggcggccggcaggtgcccggtgctggctgcagatgcggcgctaaccttctctccccacttgaaggcatgcggctaccaagggcatccttgtggctatggtctgtactttcttcgacgctttcaacgtcccggtgttctggccgattctggtgatgtacttcatcatgctcttctgtatcacgatgaagaggcaaatcaaggtaaagcagaggcgctgccgccacgccggccgcaatcgctgttctgttacccgcagcattgggggagctgtgctgggctgtggtgggtggtggcagagtctgcctggtgtgaatgtggagctaagtggcaccgtcttgtgtgtgacgaggacactgctccgttccccagcacggccggctaactaaacggggagcgcagctgtgggagcgggcgggctcttggtggaaactttgtggaagccgggtgggagagccccggcgagtgcagtgtcccggtggctcctcttagggtgcccagtgccccgcgccagcctgcccgaggaggagggtgttagggggaagttagccgagactgcggactgtgcccttgacggtgtggccttcgtgctgcgggcctcactctgtgcccggggtgttggctgcagagagggccctgggccacctcacatcccccttgcccttcctccacgggaggctcacgaagcactgggattgatggggtttcaaacctaggcctcgtgggctgtggaaggtcttgctgtgttgatgtgggcgcaggaagccactggggctccgattccacttgtctgatgtatagaaaagatgggggacctttggccgctcagatttggggacagtgtgactgactggagagcggttgtgcagtaactgagtctgtgtttctctccccagcacatgattaagtaccggtacatcccgttcacacatgggaagagaaggtacagaggcaaggaggatgccggcaaggccttcgccagctagaagcgggactgaggctgcctcacgtgttgcaagaacagttttgagccattgttaacaatgccttttttcttcacataaagtagttgattacgagggagtcaaattttctttttaaaaaggagcttcaatgatttgtaactgaaatatcaggttctagaagaaactggcgcttaaaccaaatcgcatggatttctttttcagtgacgttcaagtgtttctcacggatggaattctagtcagctgcaggcgggaagccaggcgggtggagcccatgggagcaagggcgagtggccggtccccgctgtgccaggtgggcaggcaggagcaaggcctgcgagggaggaacgggccgctccccgccagccgccttccccagcagccgcaggtggtgccagccactccacagagcccgagggatgatctagcctgattcctgcgtgtccgaaagaacttaacgttttaaaggtgattgtcaagtaactgtgtggggttctaatgccagtttcctaattccatctcactggagatgtttaaagttggcctctatcctaatgactcaaaacttggttcttaactaccatgattgcttttgagggcccggaattataaatatatattatattttaattgtttgagattattttgacacatttctttgatacgtagagtgttttgtttttaatttaaatctgtcctcatgcaaccctccatgaggggcagcgaagctggcagggagcagactggctttgtaggttcagcactcggccccccactgcgggagaggcggaacccacttgcatgtcagcgtttttgattcgagaaaagaaatactctcaacgttttaccaagtgattttacctccacctttactaaagtctttacctaaaacatggcagtcgctggacacaggaaagcccaccttttgtttggccttttcgaaaggtgacccatattgcacagcagaacatcacagctgtggtcccagatgagacactgacatgcgagtgaaggcctctcctcctgggccccgggctgcgcaggctcctcactctgggcggtgtttcctgtctcagaattgacacggtgaatgcttagtgtctggattttcttgtgccagtgtttacatatctgacatcgagctcctctaagaggccacgttcaagcttgtgtgtccctgacccaagatagccagtgctgctcccaggtggtacttctggtaccgtgttgagacacttgggattctcagactgtggacaggagtgtttgtcatttttcatactgttttcttaataagcgctcaggcctaaggtgtgacaggaagtcgcacgcgcttggccagagcacagtgaagcaaaggactgggtgctgatggatggagccacggcggcatctgcccacccggccggagcccccagtgcctctcctggtggtcctcccagtctagagggtcacggcccccccgccctcctccgtctctggcaagctgaccttgactaacccaggaatacagggtcatcctcattcctaagtaagtcaaacagcaagacatggtttgcgcgggtctttgccggaagccggtcctgctggccaggtgttttacgtcagcagggaaatgtggcacacgccctcgaggcattttaacactgtgcttcaggaaatctcaagttccatcttgtgttagtaacgtacccacattttgctggagttagtttattaaagatgcctacggtgaactctctggcgcaggttaaatgcagttttgaaaacctggaaacatcaaatggaggcgggaaataggctggggccgagctgaggggctgaacacagcagtgaccgtgggtcagcaggtcgcctgcccagcaggccccccaggagagggctcgggcgcccctggcagcccccatacccccaggacctggctcgtgagtgcgtctgggtcaggaagagacctctctgtgcgtctcaggctgagatgcagatttctgttttctaaaactggaagcgaccttgacgtgtattgaaggtgtgtgtgccaaatgcttccgacggaggtgctggccttggttggtttctctctgccccgtgtggtcatcaagtcctgggggatgtgctctgcccagccgccctcggggagagcagcgccgcctcccatggggccgtggggctgctgttctcactgcactggctgaagcaacccgccagcctccgtgccccaccccacccagcacgcactcattcagtccattgccttaacacaagcctgatggggctgttttctcacaatataaacgaataaagtgtcttctggcctacttctgaattacttctcaactgtatggtttggggaagggagggaaacctaaaatcccgtccaaataagtgaaattcctgaagaagtggctgagtcctaccaggttggggttagggaaatgttctgggttcaggcgcccctcccagggctgagaaagcgcagccagggacagctttctgttctctcccagggtggctaggttagtatcttacatgacaaaaaactgagagtgttctaacttctgtgcaagcaaggttaatcctgagactaaatcttggcgttcagactcccgtagaggtcatctgtgtccaggcccacccgggcgccggctcagcggtagtgccgaaggtagatgagcttctggggagggaacttctcccggcagaggggacactccgcctgcggagaggagaaagggggtcacagcagctggggccactgggccatgcccatccccatcggcatttcttttcctgtccacattctctgcacatgacacacaacataaatgttgtatttccttcaactaatgaccaagaaagccagccttttttcagaaggccgagtcccagtgggggctggggcggggctgggggcgtagggctcagggtgtggggctcggccgggaggttccctcctgctcccgcagctgacacagcccaggaagcccagctcctgggaaagcgtgcgctctcaccctgccggcatcttcggtgggtgtgagtcagtgtgctagggttttcaagtgtggtgaggaccccgggaggaagggtgtgctgggatgcgtggtgcaagcgtggggcctttcagggctggccactaccccaacctgcattcggcaaagcctcaatacacgtgaatttggaactttaaccccctcaacgaacccacatctgacctacctgggagcctttaaaaagatgcccacctctgtaccctcaaaactggagggtgctcagagccagactccccacttctgctgcagccaggtgcatcttgccggcacagccgctgaccaccccaggacggcagcaggctcccacctcaccttgctgctgcaccacgcggtgatgcactcccagcagaacaggtggccgcagggcgtggctgttgggtgcctgcgctcctccaggcacagggtgcacagggggtttctggaaacggctctctcctccaaggaggccctggggaaggtggggcagagcgtcaaggtgggtgcaccttacaggtccttgtgaagtgcccaggacacccccagcccccatgtgtggcccccgcacgcacctgcggtgagacaggccgcggtgcagcctccactccttcctggctcgctgccgctgcctgaaaccgtacagctgcagccccatggacagcaccaggtgcagcagtgagatgacccccagcagcctgtagctaacacgggccctcaggtcctctccgggcaggctgcggacacggagctgtaaggcagatggcgccacactcatcaggaccctgaggggatctggcctcagcgcctgctgggagggtcacacgttcagttggcacagagcacgttagaaccaggcctctcactggcatggggagtgcccggcagaaacgatcaagccagggggcaggttcagggagtctgaggtgcctgcttcgtagcctagcatgacggagaggcctgagctccagaccagccttggcatcaccagtgcagaaagagtcttagctatgaggctggcagagcaggtgaggatgtggggatgtccagggaccacctctcagaaaaggaggcggggagcggaaatgtggggctgcagacgctgcccaccagctaccctgctacagggaccgaagccccagtgtaacaaggcacgtggccccagggacactgctgccaccctcctgctggtgacacaggtagcttctgaccgtgccactgaaggacagctggctgccctcggcttcccgtgtcactttccactggctgggaaatggagacagccagacagcctcagcccagggccgggaaccacatacagaggtggcaggtcacaccgccagcatgggccctgggtgtccagccacttcctggctgtcctaggagagagggagcctcccatctggtttgagccccacttccatgcccctgtcacagcagctcatcaaatccctc

SEQ ID NO: 13844 - DNA, 46902 bp, Human
gccactgcgcccggcctctaaaacttttaaatacattttcactcctgctctaaaacttgcctctcactctgccttacgcccctcagtcgaattctttcttctgaggaggcaagaactgaggctgctgcagacccatatggatttgctgttgctaacagtaccattgttccaggggtctggagagacaaggcaagagaaagtcctcttcagacagtgcgatgcactgtgtaatctcagggagccgttccacaaactggatactaaatgtgatgccgtcacatttcttttctagctaaccaccccaacccaccttccagtgcgcaggaatccacaccctccttcttgcagcctcatcctccctccaaattgccctcaagccccggagctttcacagcccacaggggacctggtggctccgttccacacctcaccccagcagggccagcctgagttaccctgtgggcctgcggctgcctgtcaccgccgccacacgggggcgccatagcaagccaacatccccgagtccaactgggcggccgggccaggcgccggggggatggatgctctgctgcccacctgtccaggctgcggtggccccgagggcagaagtcccgcctcctccgtgctgggcacggctcttaagacttggccgtctccgtcgcccctcagcccacacccctaacagccatgtcccatgtccctaactatacctgggaaggcggtaccaaggtccccttcgttttccaacccccaacctctccaggactggctcaagcgtggggcaggggcattgcctcttctcagaaacccagcagcatctacactccctgggcctctacctccagcccgggggacctttacctgggctaggagtgggcacacctggccttcccctgccacgactttcacgctgggtggtccctcgggataggaattgggaactaaaacgcccagaattggcctcatcttcatacgggatgggcaaggagacgcgggttacgacagagggggaagccctggtcattatttcgaaaataccttctcctccgctacccccgcctccccggcacatttcccgctttccctggagggcggacccagattttcatccctccaactccaactccttcgggcctgagccagcgcctcagatggggcttcgcctggtctaggagggtccgcaggcccccgagtctctgggagaacagcctccggccacgccgtgcgctctcggtcgcagacacaggcgtccctgggtcccgcaggatcctgccaccagcccgcgggccccgctggcggaccacgggcgctaggcgtggactgtccgggcggaggaggcgccccggggcaactggagaacaactttgggggtctggggttccaaggagaagtttgggaacagtcggcgttatgcggacttttgcaggctgggatggggtttccgggcaggtttgggggaaaaaggaaggggcctaagaccgcgcgcggaaagatgccgttatttggaggcgccgaagcgggcggagccagccagcaggacttcgcgccgccgccgggccagagcgctgaggatcggcgttgccagggacaacgcgttctgggcggagctgctgctggggcggacctgagtctgaagaggtgggggcggagcctggggggctgagccagaagcggagttgtgattggtgaagaccacatgctcggggtggggcctgggctggggcggtgtggaggttggggcggagctctggggggcggggcggggcgggggagggcccggagcgccggagccggaggcggagacgtggttggcggggactgtgcgccctgggaggggtcggagtcggcgggggcggagccgagcgggcggggagggtgctgggtcgcgcctggcctggggccgaggcggcgcgcggcgctgacagctgagtcggctcgcggcctcccggccccctcggcgcccggcccgaccctggcctggcctgccctgccccggagccatgagccccgggctgctgctgctcggcagcgccgtcctgctcgccttcggcctctgctgcaccttcgtgcaccgcgctcgcagccgctacgagcacatccccgggccgccgcggcccaggtgagcggggctgggggcggggcctggctggggtgctgggactgggggcctggggacagcgtctaagccggcgtccaggccgggggtccggcctcgcctagtgcgcgcggccgctgggagtcggcggccccgagaggggcgctaactattcttagtaacaaattactcacagccgcagcagctgctgggcgcccaccgcgcacagctgggccccacaaacgtgatggcagccacagccctttcaggtaggcgctattgttaacccatcgttcagacgaggagactgaggcgctcagaggcgaagtcacctgcccaaggtcacacggttggtaagcctagatttaagcccaggtcagcctgcctccaaagtgggcgctgttaactttgggacttggacagggtcagcctggattggagcacgctgtacttcagtcatgtttccttttgcttgtatttctgttctgggacaccccatttgtcttctccttagtacttacaattgcattcttggtccccacccccacgcaacttacacccccctcaacttgccaacccccccccacccccagcttagctttgtgaagcttaaattaaatgtgtcatttccctgctccaagggcttcccatcacttgacaactaaatgcagttctaaattaagtcggctgcatggcccgcgaggcccctgccgagcactcagaacccactctgcagcttgctctttcctcttgctttctcactactgcccccagcctttcttctcccagcctccccctccccccgcccccccccgcagcttccctccccccgggtccttttctcaagcctgggcctggcgggcttcttcctctgcttgtctcaaacaggccttgcccagcaccttgtgtaaagaccacccagccccagacttctcaggggccatcacctctgaggttaccttctttccacctgttgactgtctgttcacctgttgactgtctccccctctagaatgtgagccccgggaggacagggacactctgtgttcgcttgtgtatccccagtgcctggcgtgttgcagatctcaataaatatttgttgaatgaatgaataaacaattgtattagacacactttttaaaatctcaggacatgaatattctggaaggcacccatctccagcacaagccagatgtactggcgttagaagcctgaatctctgcttgatgggttcaggaaagatctctgtggctggtgacatagggaggcacctgttctccctgctggctctctgcccttctggtgctctctctctctctccttgcttagctcctctgccttctactttacctggatgcttcttcccccagccttccaggtttggcttcaatgctaactcctcagggaggttcctcctgctcccccaaaaatattatgttcattttataaaccctgaaatcactgtaattttcctttacagcataatgttaattgggcaattatttgtgcaagtttttcctaagtgtctcttttccatgggccccctgtctgtctcagtcactgctgcatctccgacatgtagcagcacattgtacatgcatagtagacactctatgaatagcaattcaaggttgaatggtggaaatctcccgtaagttccgtggtggacactatcaccctctcaagttttcagagaagccatcagcacttagaattgaatgagtttggtgcttgttctgataagtttcatcgttacttggtcttctcataaactcaaatgacctgttctggtctctgtgtcttgagaaagcagaatttaaatcatcttaaaaaaaattgaaatgtaacttgcattccacaaaatgtattctttagtgtatgattcagtggtttttggtacattcacagcactgtgcagccatcgccaccgatttcagaactgttttgtcaccccagaaagaaaccccgtacccattagccatcactcctcattttctcccacccctcacagccctggcaaccatgaatctgctttctgtctctgtggatttgcctgttctggacatttcatataaatggaatcatacaatatgtggccttttgtgtctggcttctttcacttagtataatgtttcaaaagttcattcatgtagtagcatgtatccttattgctttccttcttatggctaaattcttcccaaatcttataccacagagtctacatgtgacctgagtgtgtggggtgcggagggagcagtgggaggaagatgaatataatcatgattgggctatttattctaaggaggtgaactgaacaatgcatatataaaaagattttggattaaaaattggttagtggtcaaatataaaactgcactaaatgaaagttctggaaactcttctagcagaaacccgatgccttgacattaaaagcctggatctttaaactatgattggcgatactgtggttgacgagagatctgtgtgttgagtctccagtagtagcatttgcccccgggtaccccagggctttgccagctggcaggcaaggaaccctctcgctgcaagaggcaactcttcatcttcctcattctacaggaggccctccctcagtgcccctcctctgtgcttttcttaccacatcctactgcaccgatccgtgtaacagctgaaaactcagacccccacactcagatcccacacaaacacctgtagcttctttatttctctgtcactgttctaacttccctcatcagcccctactctcctggtaatgtgggagtggatgtaaacttgacaatgaaaggtctttctctcccaatttttatttatttggggataaattgactcctcctggacagttctggttccactccgatttgcccagttgctggggtggggctgttcagcaaggagcagggtggccagccatgggggagccccacagctggctctggcgggtggtgcatctgatgagctttgggtgcccagctgagcactcgccaccctgcccctctggcatgagccacaatcatggtccctcaccctcacgcttacccctagtgggtagcccgctcctccactactggagcattcccttcatccctctgggtgacttcactgtgggctctccagatggcctctcctcgttcactggccaaggttttctctgcccacaggagagcttgggtccccactcagccaatcatgatgttgcaggaaactggatgtgctggagaggtgtggggtggtgggcggtgggggattgcctctcctctctcccagggctgctctgctgtgtccagtctatcaccagggacatgccaagtgggcttctgcctgccggggcgctgagcaacaagtccccatgtctggccatggtgttagccttacctgcttgtttttaacacctgggtcttcctgttctgttgtcgcctccccagcgccccctgcaggtgccagaaggaatgggtttttttttcccctttcttggtgggccatgaggaccccacccctctctgtgccctctgtcttcctgagatggcactcaccttccttcccatgtggcagggaaccccaggggttagggtggaagctctgggctcagactctgtcctcacttaagtgactcaaaactgagaacattcccccagaatgtgagctttgggaagcgacaatgaggacactagattactctggaaatacatccaggcatgtgtgatgatcacagcccatcttcctgcaagttcaaggccactcacctggcgtgggcctccactgcgggcaggcggccaccccgtacttccttccccagggcgtttattcgcctactctcccttcctgcttcagtccccatcacctccccctccatccgcactctcagcttttattcttgcctcctacttccctgagcaaagggagcagccggtgagagtttccttcctgggctccactgagcagctgcccacctcctgccccaggcccacgcacaccttccagctgttccgggagggtagcccaggccaacctgccccctctgctcagcaaccctgtcctaggagcacccccacctccaaatcagcacttttcctcctcttctgcatcatccccatttttatataatatgtaagaattcaaagcttggaacaaaacctttcccttcaccctctcgttccctgtagctgccgccccctatggtaacccacctggctgactgcctgcctttgggcctcccttttctcccctctggttctctctgccccatacctctccaccaaacttgctgggggctcggttcccggtgatctccatgttgtcgcacccagccgtcagccctggatcctcgtctgacctggcccccagcagcctgggcagagccgatgccccctccgccttgtcccgcatcctcctctggcttctcacccaactctcctggctctcttccctcctccccagtgctcccgctcagtccacttggctggctgtccctatgctcccaacttctcagtgatggcttagttcttggtcctcttctctgtctgtatccattcccttgtggcctcatccaatcactgggctggaaataccacttctctgctgtgggctctcaaatttatgtctctagcctacagcccttccctgggctccagatctgagtgtctaacttcctgctcaatagtccaccacaaaccttaccggtcccaagccaagctcctaatttcatctgcttgtctgagattggtccccccaaagctgatcctgagataagaaatgaagtgtaagtagtttaggaggtgggggatgatcccagtttgagcagtgggaggaggagagtggataaagaaggtaaacaaaccaataaaacaagttacctcttggggaaacaggtgcaattccctgggaaccctggggacttgtgtagagcacatgcccagagctaccccagaagtggaggggctgaggtcattggtggagggctgctcaaagtgggttcatctcctgtgggcagagccagagacggccctggcaaattgcagggggtgggcacggtggctctgccaccccaaccagctcctcctcatcttggtagatggtcgctccatccattcttccagcagcccaggccaaaaacacagagtcatcctcacacccccatagccaaacggcacgttccagtattccgcctcacagagcattcagaatctgacctcttcttatcattgcctccgctgccctgctctgttctgagccctcgtcacctctcccagtccttccctgtcactagtgtccctgcttcctcccctaccctggttactctctgcactgctgcaaaacaatccattcaaacccaagtcagatcccatctctgctctgctcaaaaccctctagtggaccccagctcaccaaagtcaaagcaaaaatctggaccacagcccacaaggctctacatgacctgcccccagtcttggtgacccaccttgtactctgtttccctcaagtactctgcccgagccacactggcttcctcactgtccaagcacactctgacctcaggaccttggcacctgctgttcccattgcttggaaggctcttcccccgcttcttgcaggtctcatctcacaagccaccctcttagagggacactgcgtgccctgcctgcattaacccatttatgcctgaggttgcaattttttgaatttgaaaaatcagaccttggtgttgaccttgagcagtaggacataaataacttccacaagcttagcgttccaataatggaacactaggcataaatgggttttaaacggacacccacacactcatccccagcccttcctcttccccgtactctgttctctttttctcctatcaccctctgacattgtctttacttgtttatttactctccgcctttccctgggagaatgtgattttgttgtcacccattggggatgctgcattgagcttggtaggaataaagtcatacaggagacaggaagtcatgggccccttggaatgagcttcaggatgacactgcactggcttctttacaatttggtgaacacagcagatttatatgaccaaaccatcccttgctgagatgggctttggggagccctggtaccagctgtgcaattgtgggcaaatgacttcaccctttcatctcggctgtcctatataatacggttaataacagactgatcagccatgtggggaggttggaggggtgaagcctagcgtggtggtgcccagcctggtcagtattggggaatatctgagggtgatcccacacaatattattgagtcctttctatctgccagcccccaacttctgtgccagggagacaggaaaaaaaactgtttcttctccaagggggtgtttggagctggtcagacctgggtttgcatcctgtcttcattcttactgcctggtgtccctgagccagtgctgtaacctccccatgcctcggtcctcctgtctgtgaagtgggcctagtaataagatcttgtggggaagggagcgttctttcctgttgactgctggtaagcctaatgtttcctgtttcttctagtttccttctaggacacctcccctgcttttggaaaaaggatgaggttggtggccgtgtgctccaagatgtgtttttggattggtgggttctcatttgtcacttgttgcccttactccaggttcccttggggcagctcccccaacccaatccagcacacagactcccagcctcaccttcccctagcccaggttactcccagccccagcagttcctcccctgagtggaggcaggtgaggctggcttggaagccatgctctgccattcatccactgcaggaccttagaccagccgtcagaagctctctgagcctcagtttcctcatctgtaaactgggtgggggggtgtgaccaggtaacagtcattgtttggtgtgacacttttttacatttttcaaagtactttcaaagatgcgaatcatttgattcccaggacaaccttttgggacaatcaaagaaggagtgtttccaaccctattccatggctgtggaaactgaggcctgctgggggacatgactcggcaagtgagcaacagggcagagccttgcccccagggctcctgggccccaggacagcactcttttggtagcatgcattgagcaccttctgggacgggaaacatcggtttctcagctgggcggggttggtgatggtcatacctcaggtggttgacagtttccttcgggtcactttggtttccagggctaagaagtatggacctgttgtgcgggtcaacgtcttccacaaaacctcagtcatcgtcacgagtcctgagtcggttaaggtaggaggaagagtggtttccatgagggagttccctgcctttccttgggttgggggagtgaagcctggtcccagagactttggatgaatgttccagagccaggcgcatttcggctggtttcccaaagatccagaaaggaatggcatctttccctctaagcacccactccttggggactcttgcaagcattgccttttgatgtggggagtagatggggaccttgctgtccccatttgggttggaagttttgcccaactagtgcacacacgtttagtttgcctctctttgcctcagttccttcatctgtgagatgggaattataactctatctccagggctatgataagaattaaaaattgatcagtttatttaacaaataatatgtcaaaacatccttaaagagtgcttactatgtacttttctatgcacttcacaattagtgacgcatttaatcctcataggagtagggactcttattagtcccttggccaacatggtgaaacctcatctctactaaaaatacaaaaattagctgggcatggtggcaggcacctgtaataccagctactcgggaggctgaggcaggagaatcacttgaacctgggaggtggaggttgcagtgagcagagatcgtgccatggcactccagcctgggtgacaagagtgaaactccatctcaaaaaaagggccaggcacagtggctcatgcctgtaatcccatcactttgggaggctgaggctggtggatcacctgaggtcaggagttcgcgaccagcctggccaacatggtgaaaccctatctctactaaaaatacaaaaattagctgggtgtggtggtgggcgcctgtaatcccagctacctggggggctgaggcaggagaatcgcttgaacccgggaggcagaagttgcagtgagctgagatcgtgccacagcactccagcctgggtgacagagtgagactccatctccaaaaaagaaaaaaaaaaagaagtgaaatgagggaaccaaggcaggtggcattgtctgtcctgtctgccatgaaggttccaagaatgggtatctgctgtggagttggcagaactgggctcaactccgggctctgccaccaactggctgtgggaccttggacaagttgcttcattctgggcctccatttcctcatctgtgaaatagagttggtgcctctgttacagggtggttgtaagaatagaactaaaataatataaatgagccatctagcccctgcctggcacacagcaattgctcaataaacaatgatgcattttttttcttaccatgggtgcgcagcagatgtgtggggcaattctctgcaatggagggtggctgtggtgactctgagagggataaaatacaacttacagtcaagacaaggagacaggttgaatgaataaccaggaatctctagcagaatgttaaaaataatttttcattaaaagtttaatttcaaacatagacacaatttaagacttgtaaaagcatgctaccaaaaaccatgcacaaagactttcgtgatgcttaatgagaaaagaagtttaaagatatatattgatatagtgaattatactgattgattgatattcaaatgttaaaccaatcttgcattcctggtcatgatatattatcttttaattattgttagattcaatttgctaatattttgttaagagtttttgtttccatatttatttgattcttgtaatgtctttgactggttttgacatcaggttaatactgacctcataggataagttgggaagtggtaacttcctcctctatcttctgtaaaagtttgtatgggagtgatgttatttcttcttttaatatttgatataattcaccagtgaagtcatgtgggcctggagttttatttgagggaaatttttattttttttaagttacaaatttaattttgtttacattgtatgttttaaattttaaattatgataaaatgcacataacataaaatttaccatttttaggtgtagagttcagcagcattaaagacattcacattgttgtacatccatcaccaccatccatctccagaactttttcatcttccctaactgaaactgtgtatcagttaaacaataactccccattcccctccccccagaccctggaaaccactattctaccttctgtctccgtgaattggactactttatgtgcgtcatacatgtgtaatcatatggcatttgtcctttcgcatctgacttatttcacttagcataatgtttccaaagtgaattaatcttgtagcatgtttcagcatttccttctctagttgacatatggcattcagattttctgttttcttgagtttgataattcacatatttcaagagatctgttcacttcacataatttgcttaaattattggcataaagttgttcatgagattttctttctttttttttttttaatgtctgtaggatctgtgatatgttccctctctcattcctgagagtagtaatttgggttttctttttttttttttttcttgatcagttcaccaaaaggtttatcaattttattcatctttccaaataagtagcttttagttttattggttttcttcattgtttgtcttctatttcattgatttctcctctttttttttttttctttttgagatgaagtcttgctctgtcacctaggctggagtgcagtggcgtgatctcagcttactgcaacctctgcctcccaggttcaagtgattctcctgcctcagtctcccgactagctgggattacaggcgcccaccactgcacgtggctaaatttttatttttttggtagagacagggtttcaccatgttggccaggctgatctcgaactcctggcctcaagtgatttgcctgcctcagcctcccaaaatgctgggattgcaggcgtgagccaccacccccagccaatttctcctctttcttatttcctttctgtattcactttgggtttaatttgttcttgttctgatttttaggatggagtttaaacaattgattttagacattttttctgttctaatgtaagcatttagagctatacatttccttctaagcactgctttaggacaaatttaccacaaattttgatatgttttattttcatttggttcaaaatattttctaacttcccttgtgatttattctttgaaccatggattatttggatgtatgttattcaatttttaaatattaggggatattctagatatctttctgttattgatttctaatttaattctgtaaagtcagagagaatactcatcatcatgatttcagtccttttaaattaattgaaatttgttttatggcccagcatatggttcatcaaagtgaatgttaatgaacccttaaaaagagtgtatgttgtgttattgttgaataaagtgttttagaaatgtcgattaggtcaatttggtcaatagtgttattcaaatcttttaaatcctttctaattttctgtctacttgttctagtggttgcagggcaaggaatgttgaacccttcataatcatagatttatctatttctactttcagttccattagtttggcttcctgcattttgaagttctgttatcaggtgtgtacacatttaggatggatttgtctttatgatgaattgactcttttatccttagaaatgttcatctttattcttaataacattctttactccaagtatattttgtctactttaagccattccagctttattattattattattattattattattattattattattttgagaagcagtttcgctcttgttgcccaagctagagtgcaatggcgctatctcggctcactgcaacctccacctccagggttcaagtgattctcctgcctcagcctcccaagtagctgggactacaggtgcctgccaccatacccagctaatttttgtatttttagtagagatggagtttcaccatgttggccagtctagtcttgagctcctgacctcaagtgatctgcccacctcagcctttcaaagtgctgggattacaggcgtgagccaccatgcccagcctccattccagctttcttatgcttagtgttgcatgttatatcttttttctgttatattacttttaacctatctgcatttttatatttaaaatgggtttcttatagatagcacacagttgattcttgctgttttatacagtctgacaatctctgcctttaattagagtgcttaggttgtttacatttactgtaattattgatatggctgtgtttaaatctaccatgttactgtttgttttctatttgtcccatctgttttttgttcccttttcctcctttcctgccttcttttggattaagtatgttttagtattctgtttcatctctactattgtcttattgattgattgattgatcgattgagacaggatctcactctgttccccaggtttcatagctcaccacagcctcaaactcctgggctcaagcaatcctcccacctcagcctcctgagtagctgagactaccaccatgcccagctaaccactattatcttattggttccttttctctctttcttagttgttttcttagggtttataatttcatctttaacttatataaatatatcttcaaataatattataccacttcatctcagtctactgttaagatttttctctttatcactgatgtcagcaattgattatgatctgccttggtatactttatttgctgtacttttctttgttaattctatttgggatcctttgaatttcttagatatgtgggttccatgatcatattagtaatacatgttttatagttcttgtctgctagttctatcattccattatctgggcctgggtataggtcataatatcctgctttgtggcatgtctaatgattttttattggatactggacattgtgaattttacatttttgggcactaggttttgttatattcctttagagattctttgacttcattctgagatgataaagttacttgcagatcagtttgatcctttccaggcttgctttaaggcttttataagtgggagtctagagtagacttttacttgagagctagtttagccctactgctaaggagtgaccattctggggcctctgcggaaggtcttgtgtctgaggtttgtctattctgggtagtggaaacttgaataattattggccccgtgtaagctctgagaattcttcagtctgtagtcacccagtaattcttctttccccagaagttgttttggccagtcttctgaagttccaccctacatttgcatagattggtatacatccgaagacctaagggaccccatgcagatgctgcgtaggagctctttccatgcatagcttctccctggtactttgtcctgctctttctatgcacagcttctccctggtactttgttctgctctttctatgcatagcttctccctggtactttgttctgctctttctatgcatagcttctccctggtactttgtcctactaattctggcctcctttggtctgcctagcctctgatctctgtctattcaacttggcacgtctgctggactgcatttaggtcttttctctttgtgctgctgtcctggaattgcctctgggtagaaagctcggtaatcctaggtcataggtctcacatttttcccctccttctcttgaggttcacaatcctgcactgcctgttgtccagtgtctgaaagtagacatttcatacatttcccaggttttctggttgtttatggcacaagggcaagtccttagcagtttctccttcccgggtggaagtgtgccatcggtgtgtgtgtgaccagaggaagcagcaaggcactgggggttccctgtgcattcctcacatcccatagtttatgtcaccaggccatcacaggatccccagcctctgggacagcaggccatgggggtgcctggttgtgggggtcacctggtcagaccctgactgaggctactctgccttaatggtagggatcttcagttcaatctaagaatggctcacttagacctcaggtgactctagggtatttgagaggggcctgtagggtgggcatttactgtcacagtcttcctcttggtgggacagaacttgggttacaaatgacagtgtttgggttacatttgaggtccctggaatgtggttcctgacacaaagtcaggcatttctggggcttcttttcagctgaaaaatcgatattaaacccccaggagctaatctcagagaaggtagcagcacctgggttaaccgatagttgagtcatcctcttactgcttcccagcacccacaggataaagcagtagcccagagggcaggcctctgggctctgggtcctgcagcacgttccccctcatgtacctctgcctgaatgtaccaggggacctgtggtcccttggtctggatcatagccgtctctcccctctctccgcagcaaattgcctggattcaaatcctgtgtctaccatttactatgtgtgtaaccttgggtcagttttcaacctcagtttctccatctgtatgtaagatgagcataaaaacaacacccgcagccaggcgtggtggctcacacctgtaatctcagcaacttgggttgactgggcattgagtgaactgcagggtgcagctgtgcacctggcatttattgagcacctgctatgtgccgggcaccattcttagcacttcttatgtagaattgacactcttcacaacaaacttgccaggcaggaactcttatatccatctaagatgaggaaactgaggggcagaggaggtgagtaactcatccaaggtcccagagttagcatgtggtgcagcagggatgctgagcccagatccaaattgaagctggctgactacacagcccacgctgttaaccactgggcaatcctgcctcaagagctgttggctgatgttactgttgttaccatccagctcttggtgaggtaagttgagctttcctccggggagtttcacaatcctgcactgcctgttgtccagtgtctgaaagcagacatttcatacatttcccaggttttccggttgtttatggcacaagggcaagtccttagcagtttctccttcccgggtggaagtgtgccttcacacttccttgactgcccggcttgagtgcatgctagcaatattaaatgtgtgccaagtgcccttcctgtgacccagaagcccttcctctcccggaagggcttctccccttctcactctggtttcagagcagcatttgccttttcctgttttgctgctttggaaggtgacatggtatggggttccgagtgtgacattggagtgagcaagccctccccacgctctctgactgtacgtccacaggaaaatcacttcgcccctctgtgctgcattttccccatccccacacagctgatgttacttgaagatagggacgattgtgtgggatcatgcatgggaagtgggcacactgcggctgagactcagccaatggtgattatttggggcatgtctcagaagagcatcttgcagctactcatgggtgcatgagcctatgttggttttttggggatatttagaagttcctgatgtcaaccaagtacaacaaggactccaagatgtaccgtgcgctccagactgtgtttggtgagaggtaaggaggtatggtggaaggcctgggtgggaggccaggagagccctgctgtgagtgagggccagtgcggtccagaatgtggggtgtagaattgaggcctgaggccctggctgccaggcatgtgatgagtgccccgtaaacagtggccccactcttgtcacgagcagtttcctccttctcccccaacctccagatggcagggaatatagaggccactgaggttgggtaacacgatcatccttttcctttttaagttatttttaaaattccggtaaaactgacataacattcaccattttccccaccttagagggtacagtctagtggaattcagtgccttcacaatgtggcgcaaccgtcgccaccgcctagctccaataccgtttcctcatcccaaaatatgaccccaagcccatcaagcagtcgctccccaccccccaccctctttcccgcatcacgtgtgtgtctcctacagactcttcggccaaggcttggtgtccgaatgcaactatgagcgctggcacaagcagcggagagtcatagacctggccttcagccggaggtgagtgtggccggaggctccgtggctcctgcctggccagaggcagtaggggctgccgaagtgtaggtgggccttggggagggaagtgtccacccaagggggcctccctcagctgaagggagagaggaaaaaggggaaagacagggtgttaatagtcaaaagggagagagagagagacaggctgaccaagtggggatgaatgaggcccccatgcagtttgggaacatcaagggctgagtgcccacgatggccagaagcatgggggttcctgtcgtccaagagctccccacatcagacctcatcactccttgtcagggcttcttcttttattcatttgagtttttatgttttggtgatatagttgtgctttgtataacgatgtttcggtcaacgatggaatgcatatgtgacagtggtcccgtaagattataatggagctgaaaattgctattgcctagtgatgctgtaaccatggtaatggcgtagtgcaatgtgttactcacatgtttgtggtggtgctggtgtaaacaaacctgctgcactgccagtcatgccaaagtctagcagatgcaattatggacagtacgtaatattgataaatgataattgactatgttactgatttatgtgtttactatacttttaaacattcttttagaatgggttccttctacttacagattttttaaaagtttactatacaacagcctcaggcaggtccttcaggaggcatccagaagaaggcattattatcataggagatgacagctccatgcctgttattgcccctgaagactttccagtgaggaaagatgcggaggtggaaggcagtgatattgatgatcctgaccctgtgtaggcctaggctaatgtgtgtgtttgtgtcttagtttttcacaacaaagttttaaaagtaaaaaagaattaataaaaaagcttatagaataaggatacaaataagataatatttttgtacaattgaacagtgtttgtgttttaagctaaatgttattacaagagtcaaaaatatttaaaaaatgagaagtttataaagtaaaaagttctagtaagctaaggctaatttattattgaagaaagaaaaaaaatttttaactcagtgtagcctgtgtctggtttttataagtctacattagcgtgcagtaatgtcctaggccttcacactcaccactcactcactgactcacccagagcaacttccagtcctgcaagctccattcacagtaagtgccctatccaggtggaccatttaaaaaaatcttttagactgtatttttactgtaccttttctatgtttagatatacaaataccattgtgttgcagtaacctgttgcacaggtgtatagcctaggagcaatagtctagaccatatggcctaggtgtgtagtaggctatactgtctaggtttgtgtaagtatactctatgctgtacacacaatgaagacattccctaacaacacatttcttagaatgtatccttgtcgttaagtaacacatgactgtactttactttttaaataactattatggaggtataattcacataccatacagctcacccatttaaagtgtacgattcaatggcgttggtatattcatagaattctataaccatcaacacagcacattttagaacattttcatcaccctcaaaagcagtcattcagccaggcgtggtggttcatgcctgtaatcccagcactttggggggccaaggcaggcggatcacctgagatcaggagttcatgaccagcctagccaacatggagaaaccatatctttactaaagatacaaaaattagctgggtgtggtggcgcatacctgtaatcccagctactcgggaggctaaggtaggataatcacttgaacctgggaggcggaggttgaagtgagctgagatcactccactgcactccagcctgggtgacagagcgagactccatctcaaaaaaaaaaaaaaaaaaaaaaggcagtcattcctcatttcttcccaattcccctacctgctggcaaccactaattaccttctttgtctatggatttttgcattctagacattttatataaatagaatcatgcaatatgtagtcctttatgcctggcttctttcattagcatcttgtttctaaggctcatccatggtgtcatctatattaatgcctcattcctttttattgtcaaataatattccattgtatggatataccacatattgtttacccattcatcagttaatggacttttgggctgtttccacttttgggctattatgaaaaatgctgctatgagcatttttgtacaagtgtttgtatggacatatgttttcatttctcctgggtatttacctagtggaatttttgagtcacatggtaactctattttaacattggaaagaaggtaatctttgatataattttgaatttatagaaaaattgccagaatagtgtaagggactcttatatatcttttacccagattcacttattatttattatttaaatcaccatttgctttatcatttcttctctttatgagtgtatatgtaaatatatttatcactgtgtgtatatacatatatttatattttttatatagtacatattttaaaaaaccatttaagagttagagacattgtgctccccacctttaaatacttccatgaacaatgactacaaactatagtttatcaaaatgagaaaattaataatattaatctaatactgttatctaattcacagttcatattcaaaatttgtcatttgtacagttgtagctgttttctttgtctaaaatctaatccatgttcatgtttttcatttaattcccctgtcactttagccccctttattctagaacagttctcagcctttctttggctttctttaccttaacatttttgaagatgacaggacagttttgtagatggttcttcagtttgaatttgtcagctgtctctctgcactgttagactcaggctatccctctttggtggtaatgctacagagtgatgctgtgtcctctgtggggcattgtatcaggaggcacatgctactgatttgtcccattgctggccatgttaagtttgcacagtggttgaggtggtgcctaccaggtttctccactgtgaagcaattcttgactatgtaatctgtggagaactgtataaacatccttgccagaactcttgctacagcctcctcattggcctaccctcctcctgtctccctcctccaatgtatccactcaccatcctgaagagatcttgctaaagctcagatctgaccatgccactcccctgttctgaagccttcaatggcttcctatcatctgagagatgaagatcagaccccattcaccctcagtctgcccctaaacccctccaacctttgcatcccctctccccagcctttctggaaaccactgtgctttttctggcatctctgctgttcccactgcctcaatgtgaacctctggggaattcctgttcctcctttgatacccagctaagatgtcacctactgaggctgagttcatgcctccatcaaggcacctgtcacacccaatgtagtgcttccattcatgtccacctccctcactagaccacggatccctgaaggcagaagacgcaccctgtccctgagtcctgcgcccagcaccaggcaccccacaagccctccaggaatgcccatagagtgaatgaatgcgtaagtgaatcaatgaattggaatagtctcagtcttactggaaagttgtcagaagtgaaaatgggaaggagtagactggaaagagacatttatttaagaaatacttattgtgccaagagccagggttgcaaaggccagccaagcaaacttcaggaagctttgaggttatgggaaacatcaattctaaccagatgatggcccacatgatcatgacataaccatgtcattgtcttgaggaagcatctccagcacatagaacctcatgtttgaacagtgctttatagtttataaagtgctttcacagacatttttatttttttaactttttatacacacagcataaagtttgccatcttaaccatttttaggtgtgcagttcagtggtattaaattcattcgcattattacgcaaccatcaccagatatttttattttttaatctcacaataagatgttgtcttagagatgactgttctatagtaaatgccaaatttacaaggctttatgaaagaaactttagaagatgcctgtgtttatgaaagtattattgagccttggtgaatcctaattcactaatgaagaaaaaataggaaccactgatgagtttcatctccaaccattacccacacagaatataattttgtacttttaataaaactgtgagagtaaattgctagtttctacttttccagattttggttttatgggaagacctcagtctgagtccaccaagggagtcaggattttattgttcacctaacgctgtagcccagttttgtttctacaatagctgcaagagattcagtgtttgtatgataaccggccacatactatctggataatcaacttaaatgagatttttttaaaaagacaactacaaatcatcttgcaaataaatatatacttgccaaccatgtaagcattatgagaaaaagtcaagggtgctgtgggagcatatattgcacctacctggggctcaagagttactgcctgaggaagcggcctttgagtgtccatctggagaagggagacattcaggtagtgatggttgtgggggatagagggtgagtgctccaggagaggggatgtgtgtgcaccagccccatggtgggcaggagcattgtatttggaggagccaaaaggcccctggaacaggaaggcaatgttataggtggaggtcagcgagaagcagactccagctcttaagctcaggtgaagattttcatccccctcctaagagcaacagcatgcttcaaagtgttttatgttgcaaagggaccagatgagagtggagagccccaggctcacctgctgccaggcatgtgcgtcggctagttgggcaatgaaaagctggttactattttagtttttcttctcccattctctctctcttttttagagacagggtctcactctttcacccagactggagtgcaatggtgtgaccatagcttactctaaccttgacctcctgggctcaagtgatcctccggcctcagcctttcaagtagctggggctacaggagtgtgccaccatgcccagctagtttttatttttattttttgcagagacggagtcttgctgtgttgtccaggctggtctggaactcatggccgcaagcaatcctcctgctctcgccttccaaagtattggggttataggcatgagcccctggccctggccccatttctctttttaaaaattttctatttggaaataatttcaaattttcagatacgtttcaagaataagaataggacaaagaatacccatgtactctttactcagattaatattaaaagattaacatttctaggtccgggtgcagtggctcacacctgtaatcccagcactttgggaggccaaggtgggtggatcatgaggtcaggagtttgagaccagcctggccaacatggtgaaaccctgtctctactaaagatacaaaaattagccagccatgctggcacatgcctgtaatcccagctactcgggagcctgagacagaaaaattgcttgaacccaggaggcagaggttgcagtgagccgagattgcaccactgcattccaacctgcatgacagagcaagactctgtctatggaaaaataaataaataaaaataacatttcttttaattataaaagcagcattttctcttagcaaaatttcagaaacatgtaatgtacaaaatggcagtcccctccttccagctcccttggggttgccatttttgtgagtttggagtgcattcttccatatctctttctaagctctgtgcctgggagggagccctgtgggttgggagctctggggtgcaaatggtatctgaggactcatttccacatagagttggacaccatgattgctcaaggacaggcagtgaagtgggaaaacaaaatgctgcagctggtgcccagggcagggcaggtaaggagagcaggcaacgggagtagagggcaggaggggaaccgggattgccctctcatggactgtaggaggcccaaagtttctacactgtcacgtccctttgaggtcagggctgaagggccacagtgaccaacagagtacctgtggaactgttaggacaagagcaagggaacagcatccatcctgagtggaggagaatggtgaaaccccagggtgtagttcagttactacaactccaacctgcaatctgggtctcaaggggaggccagaaagactgggagggaccacccaccttcactctgcacagtatcctctctgtggagagggagggcacatggcagtccaccatattgggctggccagtggccgttgatgcctgtgctgtttctccagctccttggttagcttaatggaaacattcaacgagaaggctgagcagctggtggagattctagaagccaaggcagatgggcagaccccagtgtccatgcaggacatgctgacctacaccgccatggacatcctggccaaggtgatgggtgacagtcgggcatgggggccaggagggccacatggggtagaggggtctcttctctccctcttcccttctctcttcccctccctcctgctcctctaacataccagcaattcctctgtgcttcatatattctgtatacattctgtctccttcaatattcaaagcaacctagtgtgagattggggctagtaactcattcttgagcaagggacaggtgcagggcctggcctgtagctggtcaatggcagaagcaagatttgatctcaggtctgcctgactctcagcccaaaggctgccttccctctgcactccctatagggtatgacttggctcttcaccccagtagactcagcagtgggcccagtaaccccaaaccccactttatgtgggggcggggcaggtcagggaactgcagtgtggggacagtgactggattcctctttatcacattgctattcctttatcatttttgctatccattcacttcactgtgaagctagtatagaatgaacacttaaggaaggttgcatttcaggggaaatgcatcttgtcaaggaagaaagccaagtttattgagtagctactatgagctacttcatcctcatagcattccatggggatcaaattatcatgggtcattgtaagcagctgatgatatgatgcatataaacccttagcccagagtccaggtgtctagcagaatgatgccaggctttgccctggatctgctgcccttctgtgccccagggatgaccttgcccttctctctcccccaggcagcttttgggatggagaccagtatgctgctgggtgcccagaagcctctgtcccaggcagtgaaacttatgttggagggaatcactgcgtcccgcaacactctggcaaaggtactgcctcagcaccccctctggtgaccagccaccagagctgttgtcttcatttgctgaagaacctccttcagtgattttttttttttttcccagaatgggttttgagttctggtatgtctgaagtgacttctgaatcaggatttgcatgcattgcctaaagtaaaggcttaaaatcaaattgccttaaagtaaattaggagttaatctttctctcatgtgaaatgatccccaaagcaggcaatgtaggatgactatgatggctccatggtgtcagattttctggatccttctgtcttcctgttccactgtctcagcacatcacctcattgtcataagatggctgctgcgaaaggtgcaccctgcctgccactgcccgtgcccacatggggcctgggaaccaatctgccccacccgctgcagctaccaccacctgcacgcactgtccagggaccagacatgccccacccactgccagcacccgtgcgcatcatctaggggcctgaggaatggtctaccatgagtgctgccaccagcgcctgccactgagagggcctgaggagaggcctgccccacttgccgacactggcccccacatgcatcatccacgggcctgaggaatggtctaccatgactgctgccaccagcgcctgccactgagagggcctgaggagaggcctgccccacttgccgacactggcccccacatgcatcagccaggggcctgaggaatggtctaccatgagtgctgccaccagcgcctgccactgagagggcctgaggagaggcctgccccgcttgccgacactggcccccacatgcatcatccaggggcctgaggaatggtctaccatgactgctgccactagcgcctgccattgagagggcctgaggagaggcctgccccacttgccgacactggcccccacatgcatcatccacgggcctgaggacaagcctgcccagcccaccacccactgttgcctgcacccaagcatgccatctggaggcctggggattggcttgccctgcctaatgtaggtagtgcctgtgtgcaatattggaggacacctgaggataggcccatccctcccgctactgctggcgcccacatatgccatccaagggcctgagcacaggcccatcctacccactgttgccaccagtgatgctcaaggactggcctgcctggcatctccatcctcagcaaagcctcaggatggcctccactaacaatgacagtctaagccactgagaaactcagagataccactgacactgattacagctgaagaaattaaacagaaactatgttactgtgccaatccataatcaagccaaagcaccctacccacccaacactataaatgcccctatagaaaagtctttccctatgaaagccaatccataaaattggaagaagtaactattacactagatgcacaaaggggcaaaagaaacatggaaaaagcaaggaaatactataccttcaaagaaacaataactctccagcaacagattccaaagaaaataaaatttattatatgtctgaaaaagaattcaaaataatgatattaaactctgagatacaagagaacacagataaaaatgcaaagaaatcaggaaaacaattcatcacctgaatgagaaattcaacagagagacagatagatgtaaaagagaaacaaacagaaatcttaaaactgaggaattcagtgaatagaataaaaatataattgaaaacttcaacaatagactagattaagcagaagaaagaatttctgaacttgaagacaggtcttttttgaagcaacccaatcagaccaaaaaaagaaaagattgaagaaagcctttgtgacatgagacagcagtaagtgaccaaatattccagttccgggaatttcaggagaagagatgggcaaaggcatatgaaacctatttaatcaaataatagctgaaaacttctcaagtcttgcaaaagatatagacatccaggtacaggaaatatagagatccaggtatagtcatgctttgtataatgatgggagctcaaaaatctccgagtagattcaacccaaaaaggtctgccttctccaaggcacattatagtcaaagtgttgaaagtcaaagacacagagagaattttaaaaacagcaagagagaagcatgaattcacatataaaggaatcagactaaagtagattgctcagtgaaaatcttacaagccaggagtgattgggataatatattcaaagtgctggaaattaaaaactgtcagtcaagattatagtacccagtaatgctatacttccaaactgaaagagaaataaagtctgtcccaaacaagcaaaaaccgaggtaagtcatcactactagactggccctacaagaaatgtttaagggaattctgcatctggaagtgaaaggacaatctctatcatcatgaaaacacatgaaagtataaagcccactgatagggcagatcagcaaatgagaaagagaaaggagttaaacattactattatagaatgtttaccaaactgcaatgataaacagtaagagaggaagacaggcacaaaatatatacagaaaacaattaatcaaacaaccagaaaacaattaaccaaatgactagagtaagtccttacctatcaataataaccttgaatgtaactagattaaattcccccacttaaaagatatagattgactgaatggataaaaaaattacccaactatatgctgcttacaagaaactcacttcgcctgtaaagacacatacagactgaaagtaaaggaatggaaaaagatattccacacaaacacaagccaaagctgtcaggagtagctataattatatcaaataaaacagactttaagtcaaaaactgtaaaaagagacaaggtcattatataatgataaagggatcaattctgcaagaagataaaatacttctaaatatatttgcacccaataccagagcacccagagatagaaagcaaagatctaaaggaaaagatagactctaatacagtaatagctggggacttcaacaccccactctcagcactggacagatcatctagacagaaaatcatcacagaaacattggatttaactacactttagaccgtatagacctaatagacatttacagaacttttcatctaatagctgcagaacatacattcttctcatcagcacatgaaagattctccaggatagatcatatcttaggccacaaaacaaattttaagaaattgaaatcatatcaagtatcttctcagaccacaatggaataaaactagaaatcaataacaagtgaaactttggaaattgtacaaatacatggaaattaaacaatatactcctgaatgaccactgggtcaatgaagaaattaagaaggaaataaaaaaattcttgaaacaaatgaaaaggggaacacaacataccaaaacctgtgggatacagcaaaagcagtgctaagagcgatgtttataacagtaaacacttacatcaaaaaagtaggaagatttcaaataaacagccaaatgatatatctcaaggaattagaaaagcaagaacaaatcaaagccaaaattagtagaaggaaataaatatcagtgcagaattaaaggaactaaagactaaaaaagtacaaagaccaatgaagtgaaaggttgatttttggaaaagataaaatcaataaaccaagccaagaaaaaaaagaagacccatataaataaaagcagaaactaaaaaggagacattacaactgataccacagaaatacaaaggaacattacagatttttatgaaccactatacactaacgattggaaaacttaaaagaaatggaattcctggacacatacaccctgccaagatgattgaacaaagaagaaatagaaaacctgaacagaccaatggtgagtaatgagattgaaatactaataaaaagtcttccaacaaagaaaagcccgtgaccagatgtctttactgctgaattctcccaaacccatgaagaagaacaccaattcttctcaaactattccaaaaaattgaagaagagggaactcttcctaacttattctatgaggccagcactaccctaccctgataccacaaacagacaaggacacaataaaaaaagaaaaactacatgccaacgtccctgatgaacatagatgcaaaaatattcaacaaaatactagcaaacaaacctaatccaacaacacattaaaaaggtaattcaccatgattaagtgggatttatcccagggatgcaagggtgcttcaacatacacaagtcaataaatgttatacatcatattaacaggatgaaggacaaaagccatatgatcatctcaatagatgcagaaaaagcacttgataaaatttaacaccacttcatgattaaaaactctcaacgaattatgaatagaaggaacgtagctcaacataatgaaggtcgtatatgatatacccacagctaacatcatacttagtggggaaaagctaaaagtctttcctttaagaactggaacaggataaggatgcccactttcatcactcttattcaacgtagtactattaatagaagtgctagccagagcagtcaggcaagagaaagaaataaaagacgtccaaattggaaaagaagaagtcaaactgtccctctttgcagaagacatgatcttatatttagaaattcctaaagactctaccaaaaaactcttagaactgatgaatgacttcagtaaagttgtggggtaaaaaaaaatcagcatacaaaaatcagtagcaattctatacaccaataatgaactcatggaagaagaaaccaataaagcaatcccatttacaattgttatgtagaaaataaaatacctaggaataaatttaaccaaggaggtgaaagacctatacaaggaaaactacaaaacactgatgaaagaaattgaagaagacacaaacaaatgaaaaaacatcccatgctcatggatcgaaagaattaatattgttaaaatgaccatgctacctaaagcaatctaaagattcaatgcaatctctgtcaaaataccaatgacattcttcacagaaatagaaaaagcaatcttaaaatttgcgtgaaaccacgaaagagccaaatagccaaagcaactctgagcaaaaagaacaaagctggaggcaccatactacccgatttcaaaatctactataaagctacaataaccaaaacagcatggtattggtttaaaaaataacaacagacatagaccaatgtaacagaatagacagcccagaaatatattcatgtatttacaggaaacagactcaacaaaggcaccaagaacatacactggggaaagggcagtgctgggaaaactggatatctaaatgcagaagaattaaaccatacccctgtctctcaccatatacaaaaatcaccttaaaatgaatagacttggccgggcgcagtagctcacgcctgtaataccagcactttgggaggccaagatgggcggatcacgaggtcaggagatggagaccatcctggctaatatggtgaaaccctgtctctactaaaaatacaaaaaattagctgggtgtggtggcacacacctatagtcccagctacttgggaggctgaggcaggagaatcacttgaacccgggaggcagaggttgcagtgagctgagatcatgccactgcactccagcctgggcgacagagcgagactacaagactacatctcaaaaaaaaaaaaaaattaatagacttaaacataagacctgcaaccataaaaacactagaagaaaacataggggaaatgctccaggacattggtgtaggcaaacattttatagctaagacttcaaaaatacaggcaacaacaacgaaaatagacaaacgtggccaggcatggtggctcatgcccgtaatcccagcactttgggaggccaaggcaggcagatcacttgagggcaggagtttcagaccagcctggccaacgtggtgaaaccctgtctctactaaaaattcaaaaattagcctaaaatacaaaaattagccaggcatggtgtttggcatttgtagtcccagctactcaggaggcagaggttgcagtgagccgagatcatgccactgcactccagcatggctgacagagtgagactccatctcaaaaaaaaaaaaaaaaaaaaaaaaaagacgtgtgactatattaaatgtgactatattaaactaaaaaggttccgcacagcaaaagaaactatcaacagaataaagagacaacttgttaaatgggagaaagaatttacaaaccactcatctgacaaggaacacaacagcaaaaaaaagaaaagcaaataattccattaaaaagttggcaaaggatctgaatagacatttctcaaaagacaaatggccaagaggtatatgaaaaaatgttcaacgtcactaatcatcagataaatgcaaatctgtgagatatcatcttatcccagttagaatggctattatcaaaatgacaaaaaataacagatgcgggtgaggatagagagaaatggaactcttatgcattgttggcagggatgtaaatttgtatagccattatggaaaacagtgtggaggtttctcaaactaaaaagagaactaccatatgattccgcagtcccactactgggtatttatccaaagaaaaatcagtatatcaaaggaacacctgcacaatagccaaaatatagaatcaacctaagcatccatcaacagataaatggataaagaaaatttggtgtagctgggtgtggcggttcatgcctgtaatcccagcactttggaaggccaaggcaggtagatcccctgaggtcaggagttcaaaaccagcctttcacatggtgaaaccccatctctactaaaaatacaaaaaattagccaggcatggtgatgggcacctgtaatcccagctactcaggaggctgaagcaggagaatcacctgaacctggaaaatggaggttgcagtgagctgagatcgtgccattgcactccagcctgggcaacaagagtgaaaccccatctcaaaaaaaaaaaaaaaagaaaagaaaatttgatgtatatacacatggaatgctatttgcccataagaaagaatgaaatccttacatttggagcagtctggatggaactggagatcattatgttaagtgaaacaaggcaagaccagaaagacaaatattgcctgttctcccacatacgtgggagctaaaaaagttgatctcatggaggtaaagagtataatgatagttactagaggctgggaaggatgagtggggggatgaagagaagttggttaatgggtacaaacatacagttatgtagaaggagtaagttttagtgtcagtagcacagtgtgtgactatagctaacagcaaggtattgtatatttcaaaaacagggagatttgaaatgtttccaacacaaatgataaatgtttgaggtgatgaatatcctaaatatgctgatttgaccattgcacattgtattcatgtatcaaaatatcacatgtaccccatatgtgtgtataattattatgtatcaattaaaatatatagatttttaaaaagatggctgctgcagctccacatatcacctccttattccaggcatgaagaaggaagaaaggggaaaggtgatagctgagttcatctcagggccccctcccgttccctgggacttcggcccctgagcttgcagccgccaatgccgccccgtctttttggcagttgatcgcactctacttcccactgcttgggatttcttccttcgatgcaagcctagctgcctccactcatcaggggtccctttttaccttgcagggccacgtggatgttttaagccatcccgcccaccactgctaaggatttggtgcaggaaagggaggctgaggcctgggctcagtctgccatcttgatccagtctccctggctgcttcatcttttctagaatttctcacattctactgacctcccagcttgccagtgccgctaacgtcatttcggggtggtgggggagaggggagagggaacatgcgtgttcacttggccatctggagctgaaactcttgtttagttcctgccagggaagaggaagcagctccgggaggtccgggagagcattcgcttcctgcgccaggtgggcagggactgggtccagcgccgccgggaagccctgaagaggggcgaggaggttcctgccgacatcctcacacagattctgaaaggtgcaagggccccctctgcggactggggagggcggggtgggccaggacgttccccaggtgatacatcgccactgactctgtttggcttaagaggagaaacacagttagttattttatgagccatggggaaagggagcaaagatttgctgggaactgagactctccttgtttttcagctgaagagggagcccaggacgacgagggtctgctggacaacttcgtcaccttcttcattgctggtttgtagctttggcggtggccaagggcccggagctctgcagaaatgctgtggaccatggatccctcaaacccaactctttgggattttttgggctatctgagcagagctcaccgcagggctagggggctgggctgaagggagcagaagccccatctcctagctgtcttgggggcctctgacctggtaatgcagctggcaattgtggggatgtgtgaagctggcctgtcagctccagagagcttggctgtgtgaatgcaggcatcccctcactcagaatttgtggggaggcctgcattagactggcacaagaagagatgctaagcagcttcattcatttgctcatcagatatttcctgaacatggttcttcacctagaagactcctcttcagccgtcagtgagccctcgcatgcctcctccccagggaagcacaggctgcctcaggcactcagctagaagctgaccacaggcctggggctcctccccaccacccatctcattgtgttaagctgtttatttatttgtggtaattgagtgacgtctgttccccaccagacttgatgagcgaagggtcaggttgttttgctcacctctgttctcctggggcccagtgtggtagggaatcccatgaacattgaatgaaatacacgaacaaatgattgacactgggcactgggaagatggaggtgaacaagatgagggacagtttctagcctattggtggaggtggaaagacagagagacaaatactgatggacgaagaggtctgcaggtgaaaggcatggaggaaggccctttaggtgggagaagcacttgcagatgccccaggagattagaagcggccagtgttaaagcaaggctgcagggcgccattccctgcaatggatagaaaggacttgcggaaccaatggctggtcctcattcctgcagctgggaacccaggtcctggatgaggcttctggacagacctagcctcagtctcctcatctgtaaaatgggggccttgaggagctctccaggcttctatccagccttccagagagggtttattaatcccgtctcgtccctccagtctatccctgagccctgcgtccagatgctatgggggactggccgagggcacggtgggttgtgtctgtctttccctttgcctgtgaggaaactgaggccgaggagggaagtggcctcctatagtcacagcccgcgatgcagagctggggccagggctgctgtgttctcccaccctgctcccaggctgagggctccgctggctgtgtgaatggcccacctccacaccctaggagctgggccctgcttcccagctctgacttgctgtaagttataggcccttctcctgcattcaagcaggcccctcaagccccctggctcctttagagtaaactcacgtctgttccctcccaggccagcttggaggggttgactctatcaccttggccagaccctgccagaactcaaaatcagcctcccgaaatgtccaccaccccctcatagaacctcagggtcatggggggcttttgtgtgcaccctgcatcctgggaaggcgaggccttgggctcacggactttgaattgtgtcccccccactctccctgctgtgtgaccacagagacccattcctctccacctccactttctcttctccaaaatggaggtgagcacctccccgggccaagtgagacctagacgatggttcaaggaaggggcttttagagccagatgcctgggggcacatgccatttacatgccagcactggctggcatagaggcaggcacaaactgtctccttcatcctgtggccccatgtggagcaaccaccgtcctcccttcccacaggtcacgagacctctgccaaccacttggcgttcacagtgatggagctgtctcgccagccagagatcgtggcaaggtatgggggctgctcttggggctggcaaagaggtctgtctgatttcttgttcctgagggccacctgcccccacctcccatggttgagtcccctcaacatgccctgcttcccctgggccttggcacatgctgttccctctcttggaagcgctctccctgcttttcccctggagaacacacctcctcctcccactcctcttctagaaagggcttctcagatccctaaaggagccaccccacgtttcccctccgagcctgctcccgactcatgagtgtgtttccctgggattgtttcatgtctatttcagccatgagaccagaagctccaggagggcagggaccgtggttttttccctccccacagcgtacccagtgcctggccagggcctggcagtgaggatggagcagaatccctgctaaattgccaagagcgtgcttgtcttctgatggcaagacaaaggagggtgtccctggggaggtggtatttgagtcgggccattggtttccttaaatacaaacaggctccctctgggacagttgcatggagtggctgaagcaagtgtcaaagctctctgaatgcaccaacaggctgggtgggagctctggggaggtggggtcaggccttcaattacaattattagtcatcagcagcatataagggcggaagtgaaagattgtgtgaaaatatacaatctttctagggtttaaaaataagtataattgtaataagcatttcgtataaaaattttgggaaaagcagaaaagctataataataataataaacccacccatggcaccccacccacccagcggcacttcgctgttaactgctgagtatctgttcagcaccttctcacctacgcatgagcagctttgccgtgttttttgtcacctggttgcacagctggcttttattccccatgagccttatcacagcattgcctacctcattgtaacctcctcccaaatccactctttaaaaaattgtggtaaaatatacataacataaaattttacattttcattgtttttaagcccacagtttagtggcattaagggcattcacattgtgaatgtcatccccctccactatttttatttttacttttttgagacagagtcttgctctgttgcccaggctggagtgcagtctcagctcactgcaacctccgcctccccagttcaaacagttctcctgcctcagcctccagagtagctgggattacaggtgtgcaccaccacacctggctaatttttttttttttttgtatttttagtagagacggggttttgccatgttggccaggctggtctcaaactcctggcctgaagtgatccacccatcttggcatcacaaagtgctgggattacaggtgtgagccactgctcctggcctccgtctccagacctttttcatcttcccaaactgaaaatctgtccgttctcgcctccccatccctggtaaccaccattccacttctgtctctgtgtgtttgtctattctaggtgacttatgtaagtggactcatacagtatttgtcttttttgtgactggcttgtttcactcgaataatgtcctccaagttcatccatgttgcagtatgtgtcagaactcccttccttttttttcttttctttttttttttttttttaagacagagtctcactctgtcgcccaggctgcagtgcagtggcacaatctcagctcactgcaagctccacctcccgggttcacaccattcttctgcctcagcctcccaagtagctgggactataggtgcacgccaccatgcctggctaattttttttgtatttttagtagagacggggcttcacgggttagccaggatggtcttgatctcctgacctcatgatccacccgcctcggcctcccaaagtgctgggattacaggcatgagccaccgtgcccggcagaactcccttcctttttaagacttactaatgttccattgtaagcatcggtcccattttgcatattcatatatctgtccatgggtacctgggttgctcctaccgtttgtctattttgaataatgctgctatgaggatgggtacacaaatatctttttaagtccctgctttcagttgttttgggtttatactcagaagtgggattgctggatcatatggtgattctatttttaattttttgaagaatcaccataccgttttccataacggctgaaccattttacattcccaccagcagtgcgcaagggttctttctgatttgtccacatcctctacaatacttttgtgtttattgggatgagaaccatcctaatgagtatgaagtggtccagatccactctttttttttttttttttttgagacggagtctcgctctgttgctaggctggagtgcagtggctctacctctgctcactgcaaactccacctcccagattcatgtgattctcatgcctcagcctcccaagtagctgggattacaggcacccaccaccactcccggcgaatttttgtacttttagtagagacagggtttcaccatgttggccatgctggtttcctacagccaatcccaaacatcagacacaaagggtggatgttttagggcccctgcaacatagttcccagtggtttgggcactgttttggatgtggccatcgctggatctctttaacagtctttgggctgggcacagtggctcatgcctgtaatcccagcactttgggaagctgaggcgggcagatcacctgggggtcaggagttcaagaccagcctggccaacatggtgaaaccctgtctctactaaaaatacaaaaattagctgagcgtgctggtgggtgcctgtaatcccagctacttgggaggctgaggcgggagaattgcttgaatcctggggggagggcggaggttgcagtgagccgagatcacaccactgcactccagcctgggcgacagagcaagactttgtctcaaaaaataaagctacaagtaacagtgtttgtgagtggggagccccatgcgtctctcttcacgcttccttccagtgcccccttcttaaagctaagtaagtcggggacaggctccctttggagacgaacttgtctttgtcttaccccacaggctgcaggccgaggtggatgaggtcattggttctaagaggtacctggatttcgaggacctggggagactgcagtacctgtcccaggtgtgggaagtaggagggaagcttctgggcggatgtgggtgatcatgtcatcatgcctgcttcctccctggacctttcaggacagtggttctcaaactttgctgcatagggtcctcccccggaagatttaaagtatcctgaggcccaggctgccccagactaatgacatcagagtcaaagagctccccaggtcaccccagtattcaacttaggttggaaactggccctttagtaaatggtgccgtatttgtgcttcccggctaggctggggttccagatccttaagcttcccctggtggagtcaggctcagcagcgcctctccatgctgccgccgcacagcaggagggcttgcagcttctgctgtggctctctggaatggtgggacccctgattcctggtcccagctctgccattgtggccttgcacactcccttctccttctggacctcagtttctccatctgtcacgtgacggtgaggctgatgtcccaggggcctgggacccaggccagggtgagggtatgcactcagcctgtgggtgggaaagacaggggtcccaggcatgccgccggccggcatgatctgtggcctctcccgactctccttgttatctccccttgtggcttctctaggtcctcaaagagtcgctgaggctgtacccaccagcatggggcacctttcgcctgctggaagaggagaccttgattgatggggtcagagtccccggcaacaccccgctcttggtgggtggaggccctgggggtcctggggtgggctgggctgcttgccccaatggtggtgaatttgggactcaccaggggagcctgtggccctgttcccatcattgcaacgggcctcactggctgccctggtctttctcatggagtctcaccatagccctgtgagggctttttcccctcctcacactgtccagcagaagattacagggggtcattctggaagggaggtgccccatttacagctgaggacactgaggttcagagaggttaggtcactttcctggggtcacacagctggtgaaaagcagatatggaaattgcccagtttcacagttgacccaaacttgtcctggttccttctctcctcacgttttacagccctttctctctcggctttctccccagacctcctttattttgtgtctctttgtttgcttacttgttcatttatccattcatccaggcatttactcatgtatgatagcccctaaacccacccccaaaccaggaaactaggatatagtcactccctgctcccctgacaaggaatcactaatctgaattgtgtgtttgccattcccgtgtgtgtgtgtgtgtgtgtgtgtgtgtgtgtgtgtgtgtgtgcctgtgtgcattcacgcagtaatatattgtaggacttgttttttgactcagtataaagttggtaagatttgtgtaggtttctccacaaggccgtaggacaaccaccatcgctgatcagttctcaggtgacaggcatttgagaggtgtccagtttgtccctatctcgagcaccacagcaacgatgccatttctgtccgcatgtccaggaacagtgtgcaagccagctcctcggacatttacccagaagtgagagggctgggttgtaggacccctgactgttcagctttacaaacgaacgccacattgttttccaaagtggctgcaccaacttggatgcccagtagtggtgagagagagcacctgctgttcttcatcatctccagcacttagcatggtccgattttgtgtctgctgccatccaaatatgtgtttttaaaaaagtatttcactgtggtcttgatttatgctttcctgattactaactagtaagcgtgagcatctgaccctgctttctctgtctctgagatgtgggctcagtttcccttttggggtagtgtgttttttcgtattgctatgtagagcgttattttattttattattttttacggcatacatttatttactattattttcattattttgtttttaaatagagtcttgctctgtcccccgggctggagtgcagtggcgccatctcggctcactgcaacctctgcctcccgggttcaagcgattctcgtgcctcggcctcccgagtagctgggactacaggtgcacacccccacgcctggctaatttttgtatttttagtagagatggggtttcaccaggttggccaggctattctcaaactcctgacctcaagtgatccacctgcctcggcctcccaaattgctgggattacaggcgtgagccagcgcgcccagccctagagctttcttttaaaaactcacgtgttaatcttttgtctggtatgtttgtcatctttgtggcttgtcttcattaatgtgtttttgatgatctgcatgtcttaatatttttaacaattacttcttttgctttgtcttgtttaagaaatccttctctatcctgagttcaggacattcacttacattgtcctcagttttacatttttcttttcaaagttgagcttgtaactacctggaattgattttgtgtgtagtttcaaggtagggacctttctgtattgacttgccagggctgttgtaacaaagtgccacagactttggcttaaacaacagaaatttattttctcccagtcctggaggctggaagtctgagatcaaggtgttggaggttggtttcttctgagggctcactccttggtgtgcagacagccaccttctccctgtgtctccacatggtcttccttctgtgtgtctgtgtcctaatctcctcttataaggacaccaatcaggttggattagggcccatcctaagtacctcattttaagttaattacctcgttaaagaccttgtctccaaacacagccgcattctgaggtactggggattaggactccaacatatgaggatttgtggggggcaaaattcagcccatgacaggatcctttttatttttacctgtgaggaaggaggagccccagtccctgctcccagcccctctcctcccagggttctgccctgcctcctccagcatccatccaagcctcatctgtggccactctgccatctgttttgccaagctttcttttttaatgctcctgtaccaataccactgtgccttaacagccatctccttagatccccttacagccagcaggggaagccctgtggctcactctcagcctgggggtgccaccctgtgggctttgagtgggcagactgggctccaaccccacctctgctcctggctggctgggtcatctccatcaggccttcggcttcctctttgttaggtggggggagtggtgagcatcagtaggatgacgtacatcatgtgtctggcaacaatccccggcacatcttaggtgccctaaacccagcccccacaccggatgctcccacacacttgctggagctcagctccagggctccctgcaccctctgctgcactgacccccagcacagagagccaggggtggaacaggcttaggaggagattttgtcccagtgtttggaggccaaggacacagagtgagcgtcagccccactcaggaggcaccacacgtgcacgtggaaggctggtggggtctgcagttcctccactcccacccctgctgaagtaggccttgagttgaagagaaactgaatataacagttctcgggatctagaggaagttggcctcacagagtcagatctgagtttgaatcccggtttggccatttatttgcctggtgacttcaggtgagtcactgagcctctctctgggtctcagtttcctcatctgtaaaatggggacaatgacggctcccctacagggctgagcccagcacaggatgacgcagtacgcccagctggcacagtcaactgtccccgctcttcctcttaagggattttctagggggccagtgcaatggacaccaacctagatgaggggtgaagacatggggggaggagagtgggacccactctgctctgagtagccctgttgggtggcctcagtggctcaagaggtgccaggggaacaacctgggaaccagagatgagcggaccctttgcccgcagttcagcacctatgtcatggggcggatggacacatactttgaggacccgctgactttcaaccccgatcgcttcggccctggagcacccaagtaagtccctcctggagctgcccatgagtggggctggcgggagaaggacagacacagcggcctctggtctgagccagaggcacccactcagcccacatagccttccagatccctgtgaggtggttgtggaggaaatcacagctcagagaggttaagtaacttgcccaagtggcagagcaggggtctggccccagctcagtctggttctaaagctcatgctcataagcagcaccaaatactgggaagctgggtgacttcacctccccaagccttgaggttcctgtctgagaaatgggaccatccgtggctgcatctgcaagttgctgtgggggtcaacgcgttaaggtaccgaagccatggtgggaagagctggactccacagcctgcctgagtgttcagatccaggctctgcccagagctggatgtaaatttatgacctggagtgagttgttttgcccctctgagcctcagtttctccatctgtgaaatggggacaacagcagttccttccaggagggtaaaaggaggagaaaaagaatgcagatccagccctcggcagagtcagcggttcatgctttgcatgcaaagtgcccagcccctggctcaaagtctgtgttcatccagacctgggttaactactgtcttccttatgttgttcctgtggggacgcctggggctgctggcctcgtgattcctctctttccctgcaggccacggttcacctacttccccttctccctgggccaccgctcctgcatcgggcagcagtttgctcaggtaggaggggcagggctgtggttctgcccaggagtagctgcaggggtgggggctcatcctgagccgggaagcatctccgaacccctgctctggggctgctgggctgctgggctgtgggctcgggacccagcggagccagacccagaggactggctgtgttttgcacggaggagagcgcaaaacaggaggctccccaggctctcacaggctctccaggaggagagccggctgtgacatttgctgctcattcactcactcattctgtctttgctccttcattccttcctcattttgcccgctgggcccagatggaggtgaaggtggtcatggcaaagctgctgcagaggctggagttccggctggtgcccgggcagcgcttcgggctgcaggagcaggccacactcaagccactggaccccgtgctgtgcaccctgcggccccgcggctggcagcccgcacccccaccacccccctgctgagggggcctccaggcaggacgagactcctcgggcaagggccgtgcccgcccacctctgctgcccacggccacccacccttctcccctgccccgtcccctgggccacccttcacgctggcttccagcgggccctctgccgaccgcctgcttcacacccctcagcgctccctgtcgcctgcggactccatggcccttcctggactggcccttgcccaactcccagccaccaccactgtccctaccactgagcccttgcacaggccacttgctcagacgagacaccctaactcttgctcactccctaaagccctcttcaggggtcacctcctccaagaagccctccttgccaccccccgccggcaggggcccctcctctgtgctccctcggtcacctgtgctacctctaacaccacactgaccacactgtatcgtgagtgtccgttgacgtgaccaattgccctgccaggctgtcagcgcctcaagggtagggtctgcgtgtgatttgtctctgagccccctgtgcccacccagggcccggcacagagtcgatgctcaataaatgtgtgttgactgcatgaatgacctggaaccaggccatgcgctctcgcctcagcttgctcgtctgtgaaaagggggagatgcggaggctggcacagctttggaagccaccagcccgcagatgccccgcagatgccctgacaacgctgccttgggagagactgccccaggttaccagcctgttccctgtgctgtattcacggccatgcccctgggtgttgtgtgaggttgggcctgggtgggtgactggctctgagagctggatttgagaggtcagagaggcccctgggcctctcttgggagcagcttggtggagctgagccccgtgcctgtgggcacctgctgccctcctgacctggcaggggggcagggcaggtgagactgcatccctcgtggtggtgatgggagaagccgtcccttcctctccagggccgtgtcctctgagctcatccaaggaagaggtcctgccctgagtttctccttcggccattgggagcttgtctttgtgcagagagaaaaagcgccctcatggcccggtgcggtggctcacgcctgtaattccatcactttgggaggccaaggtgggaggatcacccgaggtcaggagttcaagaccagcctggccaacatggcgaaaccctgtccctacttaaaaatacaaaaattagccgggcatgatggttgggtgcctgtaattccagttacttggagtctgaagcaggagaatcgcttgaaccggggaggcagaggttgcagtgagcccagatcgcaccactgcactccagcctgggcgacagtgagactccgtctaaaaaaaaaaaaagaaaaagctgccctctcccctgcctgggccatgtgccccctgggaagaccccctccccaaacagggaaggcacagatgtgtgccggcccgtgatgtgcattgttggcctccttcggtccttgccgcagtcttgaatgatagctccaagggatggtcccatcaagcagataaggaaactgagactcaggggcgggagtgacatgctcagtacaggtggggcctggggtggctctgagaatggaggagacaagtgtctgggttcccagcctgcccctctccccagcccaggtgggccctgagaatgcacaccccggcctctgggcagagggtcgggccccgggatgcctcgagaactgcagcgttcttgcagagcgagggtcctcctgctcccctagcacctcgcctgaccacgtgggcacctggccagcccatcatcaagctgcaccctccaccctctccatttccagctcgctgtctgaggggcccccaaactcaccactcactttgagaatggtatgcccgggctcagcctccagccacctggtcaaactcatccctggccagaagcagccccttcccacagccaccccaaatgctgctgtctcccagcgtcctgttcccaagcccccagctgggcactgttccccgacctgctctgctgtgccccccactccgccctctgcagcccttctctgagtctctgaggttcaccagtacccacacacctgcccacgcttcccacagtccatgccctctgcctcctgctgtggctgggcctagtccccacagtacagcacctccttcacagtccatctaaaagggccacaggccaccaagcctcagtactgcagcaatgcaacccagcattgtctggaggggcctggagggatcggctccctccagagacttcaagttcccggcttgaccatcccctgatttggcaaatatctgtctgttgctgagcctgagccttcacaccatgatttcttcaaatcctgccaggaaacaggagccaactatgccccatttcacagatggggaagtccaggccagagccacagctgggccatagtggagtcagcacttgaacccatggccctttgcatccagtggccttccacaggctcagcatgccctatccctgcaggcctgggcttgtcttctgcacgccccaggaatcccagatggctgggaa
